United States Patent 8,344,211 (PLANT NUCLEOTIDE SEQUENCES AND CORRESPONDING POLYPEPTIDES) - sequence listing, part 19

SEQ ID NO: 72804 - DNA, 713 bp, Zea mays
  misc_feature: Ceres CLONE 1556682
  misc_feature: Encodes the peptide sequence at SEQ ID NO. 72805
ccgcggtggcggccgctctagaactagtggatcccccgggctgcaggaattcgtctcacccctagaaaaaacacacacactgaccgacacagcagctccgctcgtcgatcagctctcggctgaccactcatcgccagtgggtgcctgccgaccaggtctcgccgccgccaccgccgcggtagagaggggagggagagggggaaaaaactggcccagatcgagaggtacagcacgaaaaagagaggcaagagagataggggaccggagggcggcgggccggggcccaagaccgaggggctcgtgcgcaggaagctgatgaggctcctgtcgctcgtccccttcggctggcgtgctggacccatcgacgacgcgccgccggcccgtggacacgccgccgccgcgaagaaggccccggaaggaagaagggcaaaagggcccgcccacctcctggggggtgctggcgggtgcaccccaacagtgggcgccccttcgttgggggaaattttggaaggaagacaagaacaacccccaaccccgttaagggtaaggaaagggggggtcccggggaaccttcccggggggggttgccccaggccgaaagggggggaaaaaattaccgggacacttttaggggggcgggtttcccttcaaaaggtttgcgcccaaaaggggttttctggttttgaaatgggggtttcggcaaaacggcggaa

SEQ ID NO: 72805 - protein, 132 aa, Zea mays
  misc_feature: Ceres CLONE 1556682
MRLLSLVPFGWRAGPIDDAPPARGHAAAAKKAPEGRRAKGPAHLLGGAGGCTPTVGAPSLGEILEGRQEQPPTPLRVRKGGVPGNLPGGGCPRPKGGEKITGTLLGGRVSLQKVCAQKGFSGFEMGVSAKRR

SEQ ID NO: 72806 - DNA, 690 bp, Zea mays
  misc_feature: Ceres CLONE 1556685
  misc_feature: Translation starting site: 180
  misc_feature: Pfam Name: AIG1 Pfam Description: AIG1 family
ctccccgcggtggcggccgctctagaactagtggatcccccgggctgcaggaattcgtctcacccctagaaaaaattcgcccaaacccccgccgccgtgacccctgccagcccgcggccttcccctcgttctaggcttcaactgccggcctcgtgtcttctgggcaagtgaagagagagatggcgtcgccaataccgcgcgagtgggtcgggctgcagcagtttcctccggccacccagaccgagctgcacgagctcctcggcaagctcaaggaggaggatgtgagcacattgacaattctggtgatgggggaaagggcggagtggggaagtcatctactgttaactccatcgtcggggagaggatcgccactgtcagcgcttttcagtctgagggtctgagaccgatgatggtgtcccgcacaagggcagggttcaccttgaacatattcgaccctcctgggcttttggaaggtggaaccttaatgagcaggttggtgacatctttaaaaaatttcttcggggaaaaactttgaaggtctccgggagggggatcgttgggatgcctccaaaagggaaccccttgatgggcagggtttttagagccttccccatttccttttgaaaaaattttgggcaaaaaaattggggtggggtgaaccccggtgtaaatctttcccccccggggggg

SEQ ID NO: 72807 - DNA, 669 bp, Zea mays
  misc_feature: Ceres CLONE 1556688
  misc_feature: Translation starting site: 175
tggagctccccgcggtggcggccgctctagaactagtggatcccccgggctgcaggaattcgtctcacccctagaaaaaggatagagcagcagaggcagcgacacgatcgcgagcgcacgcacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagcaaagcatggtgccgacaggcagctgtggttcgcgtccagcagtccctctcctacctcgatggcacgctgcccggggactatggcttcgacccgctgggcctctcggaacccggaggggcaccgggggctcatcgagcccaatgggctgcctacggcaagtgattcaaggccctacccctgctggggccggggggggccctccccccggaaacttcggcaaaatgggcacatccccccggaacccccctgcctgggtttagaaaggggttatccccgccgcggggccttaaaattatggggcaaactctaaacgttctttgttttaaaaggggcccaagggggtttcccaaaccccccccccccccgaatggga

SEQ ID NO: 72808 - DNA, 655 bp, Zea mays
  misc_feature: Ceres CLONE 1556690
  misc_feature: Encodes the peptide sequence at SEQ ID NO. 72809
  misc_feature (39)..(39): n is a, c, t, g, unknown, or other
  misc_feature (49)..(49): n is a, c, t, g, unknown, or other
  misc_feature (388)..(388): n is a, c, t, g, unknown, or other
  misc_feature (398)..(398): n is a, c, t, g, unknown, or other
  misc_feature (655)..(655): n is a, c, t, g, unknown, or other
ggagctcaccgcggtggcggccgctctagaactagtggnatccccgggnctgcaggattcgtctcacccctaggaaaatcagccatccccttttgctgcaaatctttccctgaattgtgggtctccgacaatggcggcgctcgctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgcctgatgggctgctggaccgagggggggggccggantacctcaccngaaaggtccctggagactatggctacgacccttttggcctggggcagaagccagaggacttccccaagttacaggcctacgagctgatccatggcagatggggcatgctccggtgccccttggcgctgtccatcccaaaagcctggcaacaggttcggggctaactgggggccctgaggctggtctgggttcaagaaccggcgccgctgctccttggaacggaaacacccctccaatacgttggggaacagcatccn

SEQ ID NO: 72809 - protein, 143 aa, Zea mays
  misc_feature: Ceres CLONE 1556690
  misc_feature (86)..(86): Xaa is any aa, unknown, or other
  misc_feature (90)..(90): Xaa is any aa, unknown, or other
MAALAPSKILGTQLNFAGSSRYATAAPTAGAQKIVSLFSKKPAQKPKPAAVSSSSPDISDELAKWYGPDRRIYLPDGLLDRGGGPXYLTXKVPGDYGYDPFGLGQKPEDFPKLQAYELIHGRWGMLRCPLALSIPKAWQQVRG

SEQ ID NO: 72810 - DNA, 717 bp, Zea mays
  misc_feature: Ceres CLONE 1556691
  misc_feature (328)..(328): n is a, c, t, g, unknown, or other
  misc_feature (348)..(348): n is a, c, t, g, unknown, or other
ggagctccccgcggtggcggccgctctagactagtggatcccccgggctgcaggaattcgtctcacccctagaaaaacacccggcggcagcgggcagcgcaggcgagcagaccaagtcgcctgcagagtgcagactgcagatacagtccgtgctctgacggagcaacaggagaagcagagcgagccgaggcggagtcgacaggcgagtggttccaccgaccgtctcccctgccgcaagcgaacgggtgagcggggcgccgtggatctgatgtccctttgagatctactctgcttctgttctccctacagcttggtgccttatcatggnagaagcggggaggggctgcngcttgctcaagggtggttgtgacgcacggccgggacctagccgtcccgggattttacgttcaggggaccccttacttcatcgtcccagtttgccaaaaaggaaggtttccaactgggacccggttccaattacaacaacaaaatgggcccaggcttttcctggacctggaacccttggggggggggggaaccaaatcttgggaaggggcctttcggctccaacgtgggggagaacccaacctgggggaaaagtgaaccggggaccccacaaaaggtggttgggcctcaaaaaaagtttcccgggaacctacccccaaccggggagggcccccaaaaaattcccaagggttcgcccctccacaagaggca

SEQ ID NO: 72811 - DNA, 652 bp, Zea mays
  misc_feature: Ceres CLONE 1556692
  misc_feature (652)..(652): n is a, c, t, g, unknown, or other
ggagctccccgcggtggcggccgctctagaactagtggatcccccgggctgcaggaattcgtctcaccccttgagaaaatttcgtatgtatctccccatatgtatgcgcgactgaagaactaaccctgataaatgcttagatcatatatggaaacgctcagtctgagtttccggatttctttgtcgccattattcgctttctcctctccttgtgctgttctgtcttcgctggcgacaacaccatcgtgaaagtcacagatgctgaagatacgttggctgccgcagtggctcactcgtcagtggatgctgactcggtagagatccttgatagtttcgcgccgaagaacttttcggattgagaccattcttgagttctggtattggcacagtttataagactccacaccaggctgaggactcgttaccaattagctattacagaacgccgtggttggttctccccatcatcgagaagatcttcggatggcaagacttccagacaattctggctggctggcttaccctaagggcatacgctgctgatcaaattacttttagaccacgatcctggggcccgaaatggagcttaaccgggtttttttccttccacctttggtgggatcgggttgaaatccgggctttggaacgggtn

SEQ ID NO: 72812 - DNA, 483 bp, Zea mays
  misc_feature: Ceres CLONE 1556694
  misc_feature: Encodes the peptide sequence at SEQ ID NO. 72813
  misc_feature (221)..(221): n is a, c, t, g, unknown, or other
ctggagctccaccgcggtggcggccgctctagaactagtggatcccccgggctgcaggaattcgtctcacccctagaaaaaatgcaacagatacacacacactcgggtaaagctatctcgagctagctagctgctgtaagccgttgccatggccaaaatgggttgctctgcgtgctcgtctccttcctctgatgcccttggcctccctagccctgacgcangacttctgcgtcgccgacctgacctgcagcgacacgcccggcggggtaccccgtggaaagtccagggtcaccgccaacgacttcttatttcagggcctggcccggccggggcaaaataaaccccctccttaaaggcccccctgaaccccggcctttcttggggccaatttcccgggggttaaacggggtttgggatttttttgggccagggtttaaatttaaagggtggggggggttttttccccttttaaacccccccccg

SEQ ID NO: 72813 - protein, 53 aa, Zea mays
  misc_feature: Ceres CLONE 1556694
  misc_feature (10)..(10): Xaa is any aa, unknown, or other
MPLASLALTXDFCVADLTCSDTPGGVPRGKSRVTANDFLFQGLARPGQNKPPP

SEQ ID NO: 72814 - DNA, 662 bp, Zea mays
  misc_feature: Ceres CLONE 1556696
  misc_feature: Encodes the peptide sequence at SEQ ID NO. 72815
aatgctggagctccccgcggtggcggccgctctagaactagtggatcccccgggctgcaggaattcgtctcacccctagaatgcgcacgcctgtggacgctggtgagtgaacaccagccgtattggcccgaccccgaccgatcctcgcctgctgcagccatggcgacctccgcggcgctctctaccgccgccaatcccacccagctctgccagtcccgcgcttcactgggcaaggcggtgaaggggcttggcctgagcatgggccgcgagcgcgcccactcggaccattgtgtgccaagcagcgagcatcatgtccgccgaccgcgtccccgacctggcagaagcggaagctgatgaacctgctcatgcgccgcgccatctcgttgcccaccgtcggcatgagcctcccctacagagcctgtcttggtacctgccggctccgggaacaccggcggcgggacctacgcgaaaggacaagctgggcaacgacatcgcgggtggtagcgtggctcatcacggtcggtcccaacgaccgcacgctcaagcaggggctcaagggtgaccccgcgtgcctggtggtggagcatgacaagacactggccacctgctggatcatcgccgtgtgcactcacctcagctgcgtcgtgccgtgtaaccgcgcc

SEQ ID NO: 72815 - protein, 103 aa, Zea mays
  misc_feature: Ceres CLONE 1556696
  misc_feature: SWISSPROT Homolog: EC 1.10.99.1 Plastoquinol--plastocyanin reductase
MNLLMRRAISLPTVGMSLPYRACLGTCRLREHRRRDLRERTSWATTSRVVAWLITVGPNDRTLKQGLKGDPACLVVEHDKTLATCWIIAVCTHLSCVVPCNRA

SEQ ID NO: 72816 - DNA, 384 bp, Zea mays
  misc_feature: Ceres CLONE 1556702
  misc_feature (10)..(10): n is a, c, t, g, unknown, or other
tggactcccncgggcggccgctctgaactgtggatcccccgggctgcagaattcgtctcacccctagaaaaactctctgtctctctagggtttttgattttagccgccgccgctgctcatctcacatcccttcgagaagaacgcctggctcctccgccgaatccgataccaatggccccgtcttttcttccgaacctcccaacaacggcccgaaacgggcccttccaagttccccctttcaaaggggcttcaaccctttcggcccgggggcaaaaaacccccttattgggggctccctgggggggggaaccccccccctttttccccttaaaggggaattggaaaccttttttttaaaggggtttttttttccccccccccccg

SEQ ID NO: 72817 - DNA, 574 bp, Zea mays
  misc_feature: Ceres CLONE 1556708
  misc_feature: Encodes the peptide sequence at SEQ ID NO. 72818
  misc_feature (508)..(508): n is a, c, t, g, unknown, or other
  misc_feature (542)..(542): n is a, c, t, g, unknown, or other
gatagctggagctccccgcggtggcggccgctctagaactagtggatcccccgggctgcaggaattcgtctcacccctagaaaaaaagcacgtctgtttctccccagctccaagccggacgacgcagcgtagcagcagagagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgttctccgccgcgctggcgctgtcgtcggtgctgctgtcctcggccgccacctccctccgcccgcgggcgccgacatcgcggggctgaccccgtgcaggagtcaagggcgtcgcgaagcgcgagaagaactcgatcaagaagctcaccgcgtcgctgaagaagtacgcgcccgaaagcggccccgcgctcgccatgaaagccaccatcgagaagaccaagcgcccggntcgagaactacggcaagttccgggctgctggggnggggccaaacggcttgccaaccttcttcgtgc

SEQ ID NO: 72818 - protein, 70 aa, Zea mays
  misc_feature: Ceres CLONE 1556708
MAALAAASTAAFAAKPRARLSVACSAATGDSSSVSLASSVKTFSAALALSSVLLSSAATSLRPRAPTSRG

SEQ ID NO: 72819 - DNA, 692 bp, Zea mays
  misc_feature: Ceres CLONE 1556711
  misc_feature: Translation starting site: 115
  misc_feature: Pfam Name: Ribosomal_L21p Pfam Description: Ribosomal prokaryotic L21 protein
ctccccgcggtggcggccgctctagaactagtggatcccccgggctgcaggaattcgtctcacccctagaaaaacactccttcgtcatccatgcgtcccctccccgccgcggccatggccaccgcgacgctgcccctccgcctcctcccctccaaaacgctgactctctccactctcccctccctgcgccgctccctctccgtcgccgctttggagccccggcgctggcgcctccgagccgccgccgaggaggcgcctgaggccgtggaggttgagttcgtggagcccgagacggaggctgaggagaaacccgcggtaccggagcccatcgaggctcagctggccgccgcgggggccgggaaggacgcggacatcttcgctgttgtcatgattggttcaagacagtacatagtgatgccgggcaggtatatatacacacagagactgataggtgccaatgtcaatgatcagatcatattaaacaaggtgctactggtgtcaactagagaaaaagcttacattgggatgccaggggtgaccaatgctggctgttcacccagtggttgaagaacagggacgggatgataaagttatagggttcaagtccaggaagaagaagaagtcccggaggaaacttggtcacagacagccaaaccacggggtaagaatcccgggcataagtggataccaaa

SEQ ID NO: 72820 - DNA, 672 bp, Zea mays
  misc_feature: Ceres CLONE 1556733
  misc_feature: Encodes the peptide sequence at SEQ ID NO. 72821
  misc_feature (520)..(520): n is a, c, t, g, unknown, or other
  misc_feature (534)..(534): n is a, c, t, g, unknown, or other
tggagctccccgcggtggcggccgctctagaactagtggatcccccgggctgcaggaattcgtctcacccctagaaaaatcatcgacaaagaggaccacagtcctgttacaattgcagatagagaagcagaagaagcaatggtgtcagttatactgaagagcttccctactcatgccatttttggcgaggagaatggttggagatgtgcagagaattctgctgattttgtttgggttttggatccaatagatggaacgaaaagtttcataactggtagtggatctctggtcacattacgggtttatgactgagaaaattaagttgtacttgtttataatgactgctaaattcattgtttgtaggcaagcctctttttgggacgcttatagcacttttgcacaatgggaagccggttattggtgtcattgaccagccaatcttgcgagaagatggattggggtgggatggaaaacaaacaacttttgaacggacaagaaatatctggtcgctcttatatancacaagcccacatnctctttgaagcagatgctgaagatgcatttattcgtgtaagggaataaggggaaaagtcccacttttatggctgggattgttatgcttaatgctcttctgggcttctggttttgggggaaaattggttgttgaaaccg

SEQ ID NO: 72821 - protein, 57 aa, Zea mays
  misc_feature: Ceres CLONE 1556733
  misc_feature (1)..(46): SWISSPROT Homolog: EC 3.1.3.25 Inositol-phosphate phosphatase
  misc_feature (31)..(57): SWISSPROT Homolog: EC 3.1.3.7 3'(2'),5'-bisphosphate nucleotidase
MVSVILKSFPTHAIFGEENGWRCAENSADFVWVLDPIDGTKSFITGSGSLVTLRVYD

SEQ ID NO: 72822 - DNA, 1219 bp, Zea mays
  misc_feature: Ceres CLONE 1556743
  misc_feature: Encodes the peptide sequence at SEQ ID NO. 72823
gttgccgcctccttccttccttctcacgaaaaggcaggcaagggaaaggcaaaggacaacccatcccctgcctcctccgttgctctgctgctccccctccttatctaatcctctggttcctggacaccggcctgcaagctccagcagcagcggcgccggcgacgaaaggaggaggattgctaccatcctatatcatatcatacatatacacaaggaggaggagaaggtgtgtagcgaggttgaggtccggaggatgccttccagtgccatgagttccgggctggagccggtgctctgcgcgcctcggccgcgcagggtccagcagctgcacccctgcagcgccgacctcatccttggcgcaccgcccttcccgcgcaacgccaacagcaaggccagcggcagcagcagcagggaaggaggcaggaagacgaccaggccggcggcggaggacgaggactgccgctgggcggcgttcggcgggtcgccgccggcgcgcgcggacaacccgctggtgcacgacccccggttcctgcggaaccagcgccacccggcgccgctggagctcgggtcgccgaaccaccggcggccgacctacagcagcggtggcgacggcagcgggtttgcctcgtcgtcgttcgcgccggccgtgaggatccagggcttcgacgtcgccgcgtgccgcgcgtgagagcgagctccggccgggcggggctttggcttttcgatctattaaattaaattaacagcaggtgaggtcaggtcagatcagatcatagtagggaggaaggcgaggagggcgggagggatgggatgagatctcctcttcctcctcctcgcgagggaggcgatccagtcgtatgagtgaagtaaagaagagtactccagtcgtactataggttgatgttcgccgataccacaccacacagcagccggtcaaagggagtgaaaactgattttttgtttacggggttttgtcagcaaggttattaggttttgtgtttgtgctgtagcctgtaagatgtaagctactactagcacgggtctcttgttcgttgctgctgctctgctctgggtgcccctgtattgtagatataaatcagcacccagttcgggcggtcggccagcgttcgtttttcttctagttgacgaggaggaagaagatgtccgctcctcgccatgtaatgtaaccatggctgtactcctacatacatgcaatcat

SEQ ID NO: 72823 - protein, 144 aa, Zea mays
  misc_feature: Ceres CLONE 1556743
MPSSAMSSGLEPVLCAPRPRRVQQLHPCSADLILGAPPFPRNANSKASGSSSREGGRKTTRPAAEDEDCRWAAFGGSPPARADNPLVHDPRFLRNQRHPAPLELGSPNHRRPTYSSGGDGSGFASSSFAPAVRIQGFDVAACRA

SEQ ID NO: 72824 - DNA, 688 bp, Zea mays
  misc_feature: Ceres CLONE 1556752
  misc_feature: Encodes the peptide sequence at SEQ ID NO. 72825
  misc_feature (435)..(435): n is a, c, t, g, unknown, or other
  misc_feature (436)..(436): n is a, c, t, g, unknown, or other
  misc_feature (487)..(487): n is a, c, t, g, unknown, or other
  misc_feature (494)..(494): n is a, c, t, g, unknown, or other
  misc_feature (495)..(495): n is a, c, t, g, unknown, or other
  misc_feature (502)..(502): n is a, c, t, g, unknown, or other
ctggagctccccgcggtggcggccgctctagaactagtggatcccccgggctgcaggaattcgtctcacccctagaaaaactcgcccctcctaccgcacccggaagctaggtttagccgccgccttctcccttttcgccgcggcggccgcaagaaccgacttctccccggagaagccccaagcaagcgacccccgcttcctctccgcgccagatctttgtttatgagctcgaaggagaagcccactcttggaggcacgcggattaagacccgcaagcggaatattgcagctcctttggaccctgcatcattctctgatgcaattgttcagatctatttggataatggtggagacctggaacttgtcgccaaaagtatcgagtcttcagacctcaacttctcacgttacggtgacaccttttttgaggtggttttnntgtggagggcgcactcagccaggcactgtaaaacctgaagaaggagaccgnccacctnnatcggtngtagattgtgcgtcacagcgtggaagcaatttggcctttcgtactcctatatccaaaaaactttgcgcaggaggcctttttttaataaaaaaactttgaaaaaggttatggcgataaattcccggcaatcctttgggatttcttttgggggaaaaaggggggggaaaaaaacctgccccattttcc

SEQ ID NO: 72825 - protein, 83 aa, Zea mays
  misc_feature: Ceres CLONE 1556752
  misc_feature (71)..(71): Xaa is any aa, unknown, or other
  misc_feature (72)..(72): Xaa is any aa, unknown, or other
MSSKEKPTLGGTRIKTRKRNIAAPLDPASFSDAIVQIYLDNGGDLELVAKSIESSDLNFSRYGDTFFEVVXXWRAHSARHCKT

SEQ ID NO: 72826 - DNA, 586 bp, Zea mays
  misc_feature: Ceres CLONE 1556754
  misc_feature: Translation starting site: 165
  misc_feature: Pfam Name: Ribosomal_L19 Pfam Description: Ribosomal protein L19
  misc_feature (427)..(427): n is a, c, t, g, unknown, or other
  misc_feature (430)..(430): n is a, c, t, g, unknown, or other
  misc_feature (491)..(491): n is a, c, t, g, unknown, or other
ctggagctccccgcggtggcggccgctctagaactagtggatcccccgggctgcaggaattcgtctcacccctagaaaaactcccgccgcggcgacgccttcccctccctccttcctccgtcccatgctccgccgctgacacgttcgcccgacttaaccttacgatggccgccgccgcctccgccatcaccgccgtctccggcgttgtgcttccccaaaccttcctatcccaccgattgccgccgccgcaggtcctagccgtggcctcctcattccgccggctctccttgtgcgcttctcctcaccggatcactcacataatcccccgcgctgatgcaagtgccgaagctggagaaccggagcctgccactgcttcagctgaatcgaagaggaggtggccgaaggatctgtcgctgtggccgaagcngangaaccgaacgcgcccagcaagccgaagggtaagttcgggcgaattattgggattctgaatnagcagttcattggagaagctgaagaaggtgagactggtcccgatctgaagcctggcgatatcattgagcttaggatgcaacggcccaccaaagga

SEQ ID NO: 72827 - DNA, 662 bp, Zea mays
  misc_feature: Ceres CLONE 1556755
  misc_feature: Encodes the peptide sequence at SEQ ID NO. 72828
tggagctccccgcggtggcggccgctctagaactagtggatcccccgggctgcaggaattcgtctcacccctagaaaaagccaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttcccggcgacttcggctttgatccctggggcctcggatctgacccggagagcctgcggtggaacgtgcaggcggagctggtgcactgcccgtgggcgatgctccggcgcgcgggtatcttcatccccggagttcctgaccaagattcgcgtcctcaacagcccttctggtaaaccgccggcaagccagaatactttaacgaaccccccacccttttaaaaaataaagttattcctatttggtggggccaagggccccctttgggcttaaattaataggcccggaaagg

SEQ ID NO: 72828 - protein, 138 aa, Zea mays
  misc_feature: Ceres CLONE 1556755
  misc_feature (73)..(135): Pfam Name: Chloroa_b-bind Pfam Description: Chlorophyll A-B binding protein
MALVSASSSSTTAVAALPRNGQQRASSSLFSSSSSSSFLVGKTLLRQAEAARPSFAVRAAADSDRPIWFPGSTPPPWLDGSLPGDFGFDPWGLGSDPESLRWNVQAELVHCPWAMLRRAGIFIPGVPDQDSRPQQPFW

SEQ ID NO: 72829 - DNA, 751 bp, Zea mays
  misc_feature: Ceres CLONE 1556760
  misc_feature (207)..(207): n is a, c, t, g, unknown, or other
  misc_feature (216)..(216): n is a, c, t, g, unknown, or other
  misc_feature (242)..(242): n is a, c, t, g, unknown, or other
  misc_feature (246)..(246): n is a, c, t, g, unknown, or other
  misc_feature (251)..(251): n is a, c, t, g, unknown, or other
  misc_feature (254)..(254): n is a, c, t, g, unknown, or other
  misc_feature (257)..(257): n is a, c, t, g, unknown, or other
  misc_feature (329)..(329): n is a, c, t, g, unknown, or other
  misc_feature (330)..(330): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (421)..(421): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (484)..(484): n is a, c, t, g, unknown, or other
  misc_feature (502)..(502): n is a, c, t, g, unknown, or other
  misc_feature (503)..(503): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (621)..(621): n is a, c, t, g, unknown, or other
  misc_feature (622)..(622): n is a, c, t, g, unknown, or other
  misc_feature (636)..(636): n is a, c, t, g, unknown, or other
  misc_feature (637)..(637): n is a, c, t, g, unknown, or other
  misc_feature (681)..(681): n is a, c, t, g, unknown, or other
  misc_feature (708)..(708): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
tggagctccccgcggtggcggccgctctagaactagtggatcccccgggctgcaggaattcgtctcacccctagaaaaacacacacacacacacacacacacacactcaacagcaacagctaagcctctcccacaagacagcaacatggctgaggaggaggccaagaaggtggaggtgggagtcaccaaggagccgagggcgcggcnaaggaggcntacccgatgacaggccgttatcccgnaacnaaccnccnccnccgccgccgcgggcaaaaaatcaagggccgggccttctcaaaaaatttcaaaaaacttccccaaaccccccnncctgggaaaaaggggcccccataaaggggtttcccttttggggggggggggaaaaaaaaaaaaannnntnnnnnnnnnnnncccggtcgancttttattcactnnnnnnnnnnnnnnnnnngnnnaaaaaaacccctttttttttttttagaanaaataaaaaaaaaaaaanncccccctccctcccaaaaaaagcgccgccaagnnnccgcacaacgagnnnggaggaggagagagaaaaaaaacaagagtgttttttttcccgcccggggggggggggggggggcgagnngggggggggggganncccccggcgggggtggcgggcgagacgaaaaaaggaaagggganagcgagggagcgggcgcgcgccccccnttttatatttgcttagggnnnnnnttcgctcatctcagaaaag

SEQ ID NO: 72830 - DNA, 698 bp, Zea mays
  misc_feature: Ceres CLONE 1556761
  misc_feature: Encodes the peptide sequence at SEQ ID NO. 72831
  misc_feature (40)..(40): n is a, c, t, g, unknown, or other
  misc_feature (289)..(289): n is a, c, t, g, unknown, or other
ccccgcggtggcggccgctctagaactagtggatcccccngggctgcaggaattcgtctcacccctagaaaaaagactccagagtccaaccgcacacggcacagacccgtttcgcctcttcgaccgcgactccctccgaccgagctgcagtgcgcgtgctgcctgccttccactgttcctgcttccagacatggcggcgaggccggtcgctctggctctgccgctgctggccctcgtctgcgccctggcagcgtcggccgacgcgacgcagttcagggtgggcgggcanagtggggtggagcgtgccggggcgccggctccgagccctacacacctgggcggggcgactcccggttccagatcggcggaccagctgctggtcgtgtaccccagggaaaacggactccgtgcctctgggtggagcccgcccccctaaaaggcctggacaccttgttcttaagttttcagggttcaacaacgggaccccggggtttccgtttcaacccttcggggggccttcttttttcttaatggggaaaaagggccagcttccctggcaaaaaaaaagattattgtttgtgtttcctccccaaaccgttccgggggccgccccccccgaacccctttttttcggcccgtttgcgaaacccccccttcccctcctgggttttgccccccgccccgggaaaaaagcccct

SEQ ID NO: 72831 - protein, 81 aa, Zea mays
  misc_feature: Ceres CLONE 1556761
  misc_feature (33)..(33): Xaa is any aa, unknown, or other
MAARPVALALPLLALVCALAASADATQFRVGGXSGVERAGAPAPSPTHLGGATPGSRSADQLLVVYPRENGLRASGWSPPP

SEQ ID NO: 72832 - DNA, 700 bp, Zea mays
  misc_feature: Ceres CLONE 1556762
ctggagctccccgcggtggcggccgctctagaactagtggatcccccgggctgcaggaattcgtctcacccctagaaaaagaattctacagcctcattgtttgaggggcaccaactgtgtcttgactaccttgttggaaatcttctaaagctttatgtggatattgaattcactggctcccatacacaattttttgacaagtttaacattcgacataatattgctgagcttctggagtatttatgggatgttcctagtcaccgaaacgcatggagacaaatagctaaagaggaggagaagggtgtatacttaaattttcttaactttctcataaatgatagcatctatcttcttgacaagagtttgaacaaaattctgaactgaaagaaaaagaggctgaatggctaacaaatttgagtgggaacgcagaacctgctcaaaaagaaaggaacgcctcccggttatttcatcaggggaaaaattttgttcctttttaacttaagctacccatataaagattttgggaaactttcctttaccccttgaaaaaatttcaaacccttttcttttcccctgaaaaagggggaaaaagggtttccaaaactcctaaaataattccccttttgaaaagttgtgggcccccaagaaaaaattttttctctgaaaaaggtcccgggaaaaaatattatttttcccccca

SEQ ID NO: 72833 - DNA, 691 bp, Zea mays
  misc_feature: Ceres CLONE 1556765
  misc_feature: Translation starting site: 127
ctccccgcggtggcggccgctctagaactagtggatcccccgggctgcaggaattcgtctcacccctagaaaaattaccacctccgcctccgcgatcgaagctcctcacaaaccgttatcgtcgccatggcagccgccgcgcctgcaagctccgtgaaggaagtgctgccatctcccctgacctccgcctccgagccccctcccctcttcgatggcaccaccaggctgtacgttgacctatcattgcccatacgcgcagcgcgcttggattgccagaaactacagggtttgcaggacaagattaagatagtcgccatcgatcttgctgacgggcaacatggtacaaggagaaggtttatccaaaaaaacagggggcttctcttgaccccaacaacaaggtgaaagggtgaattttggatctgggcaagtacttggcagcaacttttaaaggccatcgttgcccccgaaggaacctttcaaaaagcaattcccctaaggaccggcctgcctttcccgggggccttaacaagccttttaccttttggaaaacccccccagagaaatattttcttaaagaaacctccccccccctttgaaaaaaaaaaaaaaaaccccctcggggaaatcccacgaggggccctttcccccctgggcaatattcaaaaggggggggaaactttgggtttgcccc

SEQ ID NO: 72834 - DNA, 666 bp, Zea mays
  misc_feature: Ceres CLONE 1556770
  misc_feature: Encodes the peptide sequence at SEQ ID NO. 72835
aagctggagctccccgcggtggcggccgctctattactagtggatcccccgggctgcaggaattctctctcacccctagaaaaaatcatccagtgctctctcctcttgcgattcgctcgctcgatcctagcttcccttcccagaagcgcagcgcccatggctcatggccatggggcaccgccagtcgggcagctgcgcaaaggtgaggcccggcggcatcggcatgagcattggcatggggatggtgtccaagcggcacaaaagaacacggcgcgccgggggattactgtctacaccgccggcgcatccgcgagcggagacctgtcgccagcagccaccagttgacgtgacactccggcgacgacaccaaagacgataagccggtgggggcggtgccgccggcggctgcagagacagagagcacccaacagcaggaggacaaggacggcgggccagagttggacccgaggcggttccaggagaagtgcgtggggctgaacactggggagccacgagtgctaatacttgcgggtaccaatacgacaagacggcggggaagccctacaagcgggtgcgccggagaggagcgcggtcaggagaatccggagagaaaggagcgataaagggacatcgtcaagggcacatagcgaaggtagtaacccaagg

SEQ ID NO: 72835 - protein, 71 aa, Zea mays
  misc_feature: Ceres CLONE 1556770
MAMGHRQSGSCAKVRPGGIGMSIGMGMVSKRHKRTRRAGGLLSTPPAHPRAETCRQQPPVDVTLRRRHQRR

SEQ ID NO: 72836 - DNA, 654 bp, Zea mays
  misc_feature: Ceres CLONE 1556776
  misc_feature: Encodes the peptide sequence at SEQ ID NO. 72837
  misc_feature (489)..(489): n is a, c, t, g, unknown, or other
  misc_feature (521)..(521): n is a, c, t, g, unknown, or other
ctggagctccccgcggtggcggccgctctagaactagtggatcccccgggctgcaggaattcgtctcacccctagaaaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctggggctggggcactgggtgaaggcncaggagtgggccggcgtcccccggcggcaggncacgtacctgggccccccggtggccgtggggacgctgccaacccatctgggtgatcgaattcgtgggccatccctttcccaaagaccagcgaacctgggaaaagaccccccaaaaaaaaatcccccgggggcc

SEQ ID NO: 72837 - protein, 171 aa, Zea mays
  misc_feature: Ceres CLONE 1556776
  misc_feature (54)..(167): Pfam Name: Chloroa_b-bind Pfam Description: Chlorophyll A-B binding protein
  misc_feature (127)..(127): Xaa is any aa, unknown, or other
MVMASSSGLRSCSAVGVPSLLAPSSRSGRLAPFCANATTSGRVTMSAEWMPGQPRPAHLDGSSPGDFGFDPLGLATVPENFERFKESEVYHCRWAMLAVPGILVPEALGLGHWVKAQEWAGVPRRQXTYLGPPVAVGTLPTHLGDRIRGPSLSQRPANLGKDPPKKNPPGA

SEQ ID NO: 72838 - DNA, 633 bp, Zea mays
  misc_feature: Ceres CLONE 1556785
  misc_feature: Encodes the peptide sequence at SEQ ID NO. 72839
  misc_feature (1)..(1): n is a, c, t, g, unknown, or other
natagctggagctccccgcggtggcggccgctctagactagtggatcccccgggctgcaggaattcgtctcacccctagaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttccatccgctgggcctcccaccccggcggaggggggggggggggtcagggatccaaagtgtaccactgccgctggggcatgcttgccctcccccggatcccgggggccgaaacccttgggcctgggcaacggggtgaaagggccagaaatggggcggccccccccgggggggagggccctttacttgggccccccgtggcctgggggggacccttcccaaccccccggggtgttcaaagtttgggggcctaccccttcccccaaaaccacgggcccccgtggaga

SEQ ID NO: 72839 - protein, 113 aa, Zea mays
  misc_feature: Ceres CLONE 1556785
MVMASSSGLRSCSAVGVPSLLAPSSRSGRLAPFCANATTSGRVTMSAEWMPGQPRPAHLDGSSPGDFGFHPLGLPPRRRGGGGSGIQSVPLPLGHACPPPDPGGRNPWAWATG

SEQ ID NO: 72840 - DNA, 644 bp, Zea mays
  misc_feature: Ceres CLONE 1556788
  misc_feature: Translation starting site: 146
caaagctggagctccccgcggtggcggccgctctagaactagtggatcccccgggctgcaggaattcgtctcacccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgcccaccccgagactttcgcaagaaccgcgagctggaggtgatccactcccgctggggcatgctcggcgcgctcggctgcgtcttccccgagctgctcctccgcaacggcgtcaagttcggcgaagccctctggttcaaaggcgggctcccagatcttcagcgaaggcggggctggactaccttggcaacccccgccctgatccaccccgcaaagcattcctcgccatctggggcttgccaaggtcgtgctca

SEQ ID NO: 72841 - DNA, 684 bp, Zea mays
  misc_feature: Ceres CLONE 1556804
gcggtggcggccgctctagaactagtggatcccccgggctgcaggaattcgtctcacccctagaaaaaatgggcgcaataatctgtactgcgcggatgaagggctgggtaaaagctgttcatcttcatctctctcgacatggtcaagtcgagggccggggaatcggatgacaatggagatggtccgatttccaccacgacgggtgtccccagcgaaggccgcggaggtggatgtgaatacactgattggatccgccgttctattcgtgggccggtgagcggtcttcctccacgtaatcagctcaagcgccccgattatgtaccagctcgcggggtcctccggccgcgattgggagggagaagtgcccttatcccatacttacctaactttccggggaccaccccattcgattcgggctgatcagacgacaactctgctctcttgtttggggacctttggtaagatgatatacatcttttaatggcaaatggcaccagaagtgggaaattcccctttttaggcaaatctttttcggtgcacaattgtgtggtcattgcgggatcctctcatcgaccataaagatagcccccgacaatgaacatcggtgcaaggaaatgggcgggccaaacggagccgggaagaatggtccgcgtaaaataccatgccatgtggggaccatatacg

SEQ ID NO: 72842 - DNA, 659 bp, Zea mays
  misc_feature: Ceres CLONE 1556808
  misc_feature: Encodes the peptide sequence at SEQ ID NO. 72843
aagctggagctccccgcggtggcggccgctctagaactagtggatcccccgggctgcaggaattcgtctcacccctagaaaaaaaggagcgtggggaggaagacttgcctagccactagcactaggtgtgagagtttcagtcgtggtggtgtataaagcagtcgtcaagcacaagctcctcctcgccctcgtctcgcctgagcagagccaagcccatccatcgttccacacctccgcgatacgatgtccgtccctcctgcccgcctcgccgcgtcctcactcccgctgctcctcgtctggctgcagctccagctcctcctcgcgtccgcctgcgaccgctgcgtgcgccactccaaggccgcgtactacacctccgcgctcaccctcgccggcggctcctgtgggtacggcaccgatgccgcctccttcagcgccgggttcctcgccgccgccagccccgcgctgtaccgcgccggcgtcggctgcggcgcctgcttccaggtgcggtgcaaggacaagaagctgtgcgccgcggcgggcgccagggtggtggtcacggaccgcgccaggaccaaccgcaccgacctcgtgctcagcagcaccgccttcgcggccatggcgcgccccggcatggacccacgcctcgcagcacgccgcgc

SEQ ID NO: 72843 - protein, 138 aa, Zea mays
  misc_feature: Ceres CLONE 1556808
  misc_feature (67)..(137): Pfam Name: DPBB_1 Pfam Description: Rare lipoprotein A (RlpA)-like double-psi beta-barrel
MSVPPARLAASSLPLLLVWLQLQLLLASACDRCVRHSKAAYYTSALTLAGGSCGYGTDAASFSAGFLAAASPALYRAGVGCGACFQVRCKDKKLCAAAGARVVVTDRARTNRTDLVLSSTAFAAMARPGMDPRLAARR

SEQ ID NO: 72844 - DNA, 639 bp, Zea mays
  misc_feature: Ceres CLONE 1556809
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (296)..(296): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (305)..(305): n is a, c, t, g, unknown, or other
  misc_feature (306)..(306): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (318)..(318): n is a, c, t, g, unknown, or other
  misc_feature (320)..(320): n is a, c, t, g, unknown, or other
  misc_feature (321)..(321): n is a, c, t, g, unknown, or other
  misc_feature (324)..(324): n is a, c, t, g, unknown, or other
  misc_feature (326)..(326): n is a, c, t, g, unknown, or other
  misc_feature (327)..(327): n is a, c, t, g, unknown, or other
  misc_feature (333)..(333): n is a, c, t, g, unknown, or other
  misc_feature (336)..(336): n is a, c, t, g, unknown, or other
  misc_feature (339)..(339): n is a, c, t, g, unknown, or other
  misc_feature (359)..(359): n is a, c, t, g, unknown, or other
  misc_feature (371)..(371): n is a, c, t, g, unknown, or other
  misc_feature (401)..(401): n is a, c, t, g, unknown, or other
  misc_feature (402)..(402): n is a, c, t, g, unknown, or other
  misc_feature (408)..(408): n is a, c, t, g, unknown, or other
  misc_feature (451)..(451): n is a, c, t, g, unknown, or other
  misc_feature (510)..(510): n is a, c, t, g, unknown, or other
  misc_feature (524)..(524): n is a, c, t, g, unknown, or other
  misc_feature (525)..(525): n is a, c, t, g, unknown, or other
  misc_feature (555)..(555): n is a, c, t, g, unknown, or other
  misc_feature (564)..(564): n is a, c, t, g, unknown, or other
  misc_feature (585)..(585): n is a, c, t, g, unknown, or other
tcaccgcggtggcggccgctctagaactagtggatcccccgggctgcaggaattcgtctcacccctagaaaaaacgccccaccccgctcgggctctccagtccacctccaccgctttcacacgctccgctccgctccgtttccgtcgctcccgtcccaaggagccgcgccacgcgagaggggggcacggtcgcacggacggtagcagttttctgtttcggtgggcggggacgtcgtcgacgaccgaccggagcggaaggacggaagagggagggaagggggcnnnnnatnnnnnanagnnnnngnnactgnnnaatgnannaangnnatgatnatntanagggtggagagagaagaagnagaggtgttatnttagattatttggaagaattatattgtgtnnaattangtggaagtggtgggttttgtgggggaatgtgtagttggttttntggatattggatggaaaggaaatgattgaagggaattgggaagaagaataagggggggnaagttgggatgtannggaagtaagggtggataaggggggtggtgnataggggtngaggatgttgaggggattgtngtggtggggaaatgagggggttgaaaaagtaggttgcatggaggattatgattc

SEQ ID NO: 72845 - DNA, 695 bp, Zea mays
  misc_feature: Ceres CLONE 1556811
  misc_feature: Encodes the peptide sequence at SEQ ID NO. 72846
  misc_feature (415)..(415): n is a, c, t, g, unknown, or other
aaagctggagctccccgcggtggcggccgctctagaactagtggatcccccgggctgcaggaattcgtctcacccctagaaaaagcgtcagggcctcttgatcatcagtcgccagaggagctgttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacggggtgcgggcgggcgctgccgccgcagccgaccgtgaaggtgtactgccgcgccacccccaactacgccatgagcgtcgcgacggggaaggtggtgctggcgccngcaaaccccaaagaacgagtaccagccctggatcaaggacatgccggtggaccccgagcttcaggaccaagggagggttaccgggggtttcccccctggtaaaaaagggacaccgggaaggcccttcaagcccttcttggggggaaaccccccccggggtgcccggggggccctcaaacccgaaattttctgaaaaaaattgggttgttggaaggagaaaaccccccatcttgaaaaatttttccctgcgggcccccggggggaaaaacctctttccccc

SEQ ID NO: 72846 - protein, 172 aa, Zea mays
  misc_feature: Ceres CLONE 1556811
  misc_feature (80)..(80): Xaa is any aa, unknown, or other
MDGGYYGGRDQRYSGGYYGGGGIATPGYAPAVPYGMSQVNIEGNGVRAGAAAAADREGVLPRHPQLRHERRDGEGGAGAXKPQRTSTSPGSRTCRWTPSFRTKGGLPGVSPLVKKGHREGPSSPSWGETPPGVPGGPSNPKFSEKNWVVGRRKPPILKNFSLRAPGGKNLFP

SEQ ID NO: 72847 - DNA, 661 bp, Zea mays
  misc_feature: Ceres CLONE 1556815
  misc_feature: Encodes the peptide sequence at SEQ ID NO. 72848
ctggagctccccgcggtggcggccgctctagaactagtggatcccccgggctgcaggaattcgtctcacccctagaaaaaacctcaggctgcttgaagtagtatgcatcagcggccctggtcctctctcccgctcccgctcaagggcagcagagaaagcagctgagcgctgactgtggatctcatccgtatcgcgtatatacgtcgtcctgtttggatccaccgcgttttgctaattcccttcgaaccggccggtggccttcgttctcccaccaggcctgtctgtctgctgtatccgccagagcttccatggattccaccctcttcatcatcggcgtcataggcaacatcatctcagttctcgtcttcatatcgcctatcaagacgttctggaggatcgtgcggggcgggacgacggaggagttcgagccggcgccgtacgtgttgacgctgctcaacccgctgctgtggctctactacgggctcaccaagcccgacggcttcctcgtcgccacggtcaatgggtttgggggctgtcatggaggccatctacgtcgtcttcttcatcgtctacgccggccaacatgccacaaggggttagaccgcaaaactggccaccagcggttggaaatccggtggcttccggaagtcctgttttgcgg

SEQ ID NO: 72848 - protein, 117 aa, Zea mays
  misc_feature: Ceres CLONE 1556815
  misc_feature (6)..(94): Pfam Name: MtN3_slv Pfam Description: MtN3/saliva family
MDSTLFIIGVIGNIISVLVFISPIKTFWRIVRGGTTEEFEPAPYVLTLLNPLLWLYYGLTKPDGFLVATVNGFGGCHGGHLRRLLHRLRRPTCHKGLDRKTGHQRLEIRWLPEVLFC

SEQ ID NO: 72849 - DNA, 493 bp, Zea mays
  misc_feature: Ceres CLONE 1556821
  misc_feature (191)..(191): n is a, c, t, g, unknown, or other
  misc_feature (197)..(197): n is a, c, t, g, unknown, or other
  misc_feature (206)..(206): n is a, c, t, g, unknown, or other
  misc_feature (259)..(259): n is a, c, t, g, unknown, or other
  misc_feature (341)..(341): n is a, c, t, g, unknown, or other
  misc_feature (355)..(355): n is a, c, t, g, unknown, or other
ggagctccccgcggtggcggccgctctagaactagtggatcccccgggctgcaggaattcgtctcacccctagaaaaatccccttgcccacttctacagcccctctgctgcagcaagaaggaaagaagctagcgcttatagcttgtcagccatggccaccgccgccgcgtctagcctcctcaagtcctccnttcgcngggctcccnggctcccggccgccacgcggaccacaccggcgtccctcggtgggtggccaccnggcccgcgcggcgccgggcgcggggcccccatctgcgcgtccatgtcccatgttcctcctccaaacccgcccctacgacccntgacgtccctttcngggtttcaggcccccattcaaagggaagtcccattcggtggtccccccccaaagaaatggaaccccggttccccctttccctttggaaccggggacatttggaattcccaccctttaacccccccgaaaaaccccccg

SEQ ID NO: 72850 - DNA, 667 bp, Zea mays
  misc_feature: Ceres CLONE 1556834
  misc_feature (211)..(211): n is a, c, t, g, unknown, or other
  misc_feature (238)..(238): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (386)..(386): n is a, c, t, g, unknown, or other
  misc_feature (411)..(411): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (454)..(454): n is a, c, t, g, unknown, or other
  misc_feature (466)..(466): n is a, c, t, g, unknown, or other
  misc_feature (491)..(491): n is a, c, t, g, unknown, or other
  misc_feature (531)..(531): n is a, c, t, g, unknown, or other
  misc_feature (534)..(534): n is a, c, t, g, unknown, or other
  misc_feature (536)..(536): n is a, c, t, g, unknown, or other
aaagctggagctccccgcggtggcggccgctctagaactagtggatcccccgggctgcaggaattcgtctcacccctagaaaaattgcagagcctcgctcgctctcggaacagagctaggcagctaacagacgaagaagaagcaagccaagcagcaagcgaagcgagagagaggcgaggacgtggcgacgacggcagccgcgatggcgacnacgacggacccctgggtcgaggcgacngagctccgcctggggctgccgggggcagcgggccgggggannnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnngnggggggggggggggggggggggggnggggggggnnnnnnnnnnggggggggggggggggggggggggngggggggggggnggggggggggggggggggggggggngggggggggggggggggggggggggggggggggggggggnggngngggggccccccccgggggggggcccccgggggggggggccgcccccccgcggggggcgcgggcgggggcggccccccggcggcccggcggcgggcccgcgccgcgggggggcccccgcgccccccccgcgg

SEQ ID NO: 72851 - DNA, 633 bp, Zea mays
  misc_feature: Ceres CLONE 1556836
  misc_feature (282)..(282): n is a, c, t, g, unknown, or other
  misc_feature (325)..(325): n is a, c, t, g, unknown, or other
aagctggagctccccgcggtggcggccgctctagaactagtggatcccccgggctgcaggaattcgtctcacccctagaaaaaccagtgcaacgcgtgcggggccgcggaggcgcgggtgctgtgctgcgcggacgaggacgcgctatgcgtcgcctgcgacgaggaggtgcacgccgccaacaagctcgccgggaagcaccagcgggtgcagctcctgacggactccgccaccgccgccgcctcccccgcgccggccgtggccaagtgcgacatctgtcanggaggctctggatacttcttctgcctagaggaccgtgcactancttgtagagactgtgatggtgctatacacacagtgaattccttttgttcagtacatcagagattcctgcctactggagttcaagtgggtcctgatcctgctgatccaggtccacccattggtgaaaagcatggtaatgcttccgggggatcaggtaaagcatccgcgagacatctgcctaagagaaagcccgggagtccattttcaggtgaaggcagggcttccggtccgagccaaaaagggatccaagggaaaattatcaagggccgaattccggtcccaccagccaggggaaaaggggtttgattg

SEQ ID NO: 72852 - DNA, 619 bp, Zea mays
  misc_feature: Ceres CLONE 1556839
  misc_feature: Translation starting site: 134
  misc_feature (288)..(288): n is a, c, t, g, unknown, or other
  misc_feature (318)..(318): n is a, c, t, g, unknown, or other
aaagctggagctccccgcggtggcggccgctctagaactagtggatcccccgggctgcaggaattcgtctcacccctagaaaaatatattagacaaattgcgtgaactatcttggagcggtgtgcctccatatatgcgacctaatgtatggcggcttcttttgggatatgcaccgcctaataaagatagacgtgaaggtgttctaacaaggaaaaggctggagtacgtgggatgtgtttctcaatactatgatattccagatagtgaacgctcagatgaagaattacnatgcttcgccagattgcagttgattgcccnagaaccgtaactgatagtacattttttcagaatcatcagattcagaaatctcctgaacgcattttgtatacatgggctattcgtcccccagcaagtgggctacctccaaagaataaatgaacttggtacgcctttcttggttggcctcctatcagaacacctaaaatggcacctggacctctggtctgtggaacatcctccaccgcaggacttttccacatagaaacagacggtttttggtgtcccctccaagtccctgattggatggaagatcctttccacttttgccaaacaaggaatt

SEQ ID NO: 72853 - DNA, 745 bp, Zea mays
  misc_feature: Ceres CLONE 1556844
  misc_feature: Encodes the peptide sequence at SEQ ID NO. 72854
  misc_feature (305)..(305): n is a, c, t, g, unknown, or other
  misc_feature (311)..(311): n is a, c, t, g, unknown, or other
  misc_feature (401)..(401): n is a, c, t, g, unknown, or other
ggagctccccgcggtggcggccgctctagaactagtggatcccccgggctgcaggaattcgtctcacccctagaaaagacgtccgcctgatgaccgattatcttccttctccgtccgagtaaaggaaaacaacgactccgcgtcccgcttccctttccccgcacggcggagttcacaatccccaccggccggcgtagcggatattgcgagttacgacggggaaggagaggaagatccgtcgatccgcgcagattcgtttcgatcgtggtttggtgacttggtaagaggggagggggagaaccccnatgtcngggccttttccgccgggtgtttcggaaatccaaggagcaaaattttgcccccccccccggggggggggggggggggggtaaaaaaaaccntttaaaatttttcaaaaaaaaaaagaaaactttcgcttttgaaaaagggggctttcttggggggcccaaaaaggctcaaaaatttttttcccccaccccgaaaatataaaaagggccccccattaccaggtctttgaaaaggaaaaaaaactcttcccgggcccccggttttgggcccctctggggaaatttcccccctttaaggaacactcggatcgaggggatttttgcgggaggaccttcaaaacggcttccgcaggggacccgggggtggtcgtttggggaaccgggggccccccgcctatgagaaagccttctctcttattacgccaccatatttgttg

SEQ ID NO: 72854 - protein, 29 aa, Zea mays
  misc_feature: Ceres CLONE 1556844
GAPRGGGRSRTSGSPGLQEFVSPLEKTSA

SEQ ID NO: 72855 - DNA, 650 bp, Zea mays
  misc_feature: Ceres CLONE 1556845
  misc_feature: Encodes the peptide sequence at SEQ ID NO. 72856
ctggagctccccgcggtggcggccgctctagaactagtggatcccccgggctgcaggaattcgtctcacccctagaaaaagccccgaattatattcattcattcatcccagccgaagagcaccaagcttcgctagcagcatatacgcatccatcccactggaaacagaccaaccctaccctaccctgcagcgcgcgcagagggggaaaggagctccagcaaaaagtttgtccagctcctcctcctactacagcgctacaaggatctgatcatcgagcagcatggcgcggcggccgcagcccatgcccaacctggtgcccacgctcctcctgctcgtcgtcgtggccgccgccgcggcggtcgtgagagccgacgacgacgagaagtgcagcaacccgtgcgggaacccctgcggcgagccgtgcgtgtacgccagcccgccgccgccgccgacgcccgtgtactcgcccccgcccccgccgccgacgcccgagtactacccgccggcgaccccgaccccgaccacgccctactgcccgccgccgccgtcgggcggcggcggctacgagccgtcgcccgggtacacgccgtcgacgccctacacgcccggctacaaccccacgccctccgggtccggctggtacgcgccgc

SEQ ID NO: 72856 - protein, 123 aa, Zea mays
  misc_feature: Ceres CLONE 1556845
MARRPQPMPNLVPTLLLLVVVAAAAAVVRADDDEKCSNPCGNPCGEPCVYASPPPPPTPVYSPPPPPPTPEYYPPATPTPTTPYCPPPPSGGGGYEPSPGYTPSTPYTPGYNPTPSGSGWYAP

SEQ ID NO: 72857 - DNA, 630 bp, Zea mays
  misc_feature: Ceres CLONE 1556846
  misc_feature: Encodes the peptide sequence at SEQ ID NO. 72858
aagctggagctccccgcggtggcggccgctctagaactagtggatcccccgggctgcaggaattcgtctcacccctagaaaaacgcggggcctggctacgaccgggcagcgtccccgcggccgctcctggtggtcgtcacgacgacggagtcgacgcccgtggcgtccggcgagcgggccgccgcgctgacgcggacggcgcacgcgctgcggctggtggcgccgccgctgctgtgggtggtcgtggaggccgccccggacgcgccggccacggcgcggcagctgcgcgccacggggctcatgtaccgccacctgacgtacagggacaacttcaccgccgcgggcgcgggcaaggagcgccaccaccagcgcaacgtggcgctcgggcacgtcgagcaccaccgcctcgccggcgtcgtcctcttcgcgggcctcgacgacgtgctggacctccgcctcttcgaccagatcagggagatcagcgcgttcggcgcgtggccggtggcgacgatgtggcgggacgagagggaggtcgtcgtgcggggccccgcgtgcagctcgtccgcggtcaccggctggttctcccaggacctgagcgacggcaccgcggctgctgcctctaccgcctcc

SEQ ID NO: 72858 - protein, 110 aa, Zea mays
  misc_feature: Ceres CLONE 1556846
  misc_feature: SWISSPROT Homolog: EC 2.4.1.135 Galactosylgalactosylxylosylprotein 3-beta-glucuronosyltransferase
MYRHLTYRDNFTAAGAGKERHHQRNVALGHVEHHRLAGVVLFAGLDDVLDLRLFDQIREISAFGAWPVATMWRDEREVVVRGPACSSSAVTGWFSQDLSDGTAAAASTAS

SEQ ID NO: 72859 - DNA, 650 bp, Zea mays
  misc_feature: Ceres CLONE 1556849
  misc_feature: Encodes the peptide sequence at SEQ ID NO. 72860
  misc_feature (205)..(205): n is a, c, t, g, unknown, or other
  misc_feature (216)..(216): n is a, c, t, g, unknown, or other
  misc_feature (217)..(217): n is a, c, t, g, unknown, or other
  misc_feature (396)..(396): n is a, c, t, g, unknown, or other
agctccccgcggtggcggccgctctagaactagtggatcccccgggctgcaggaattcgtctcacccctagaaaaaaagaaacccacagcagccgctagccgtacgatggcggacaccggtgacgtcgccgccgccgccgaggcctcggcgcgaccggcgggcagcagcagcacccagccgctggcggggcgcgtggcgatcgtngacgggcgcgnntcgcggggcatcggccgcgccatcgccacgcacctgtcctccctcggcgcgagcctggtgctgggctacgcggcgcgcgccgacgaggcgggcgcgctggcggcgtcgctcccgcgcgcgggtggccctgtgcgggcggacgtctcggacgaggccggcgcgcggtcgctcttcgacgncgcggacgaaggccttcggcggcgcgcacatcctggtggcagcgccgggtgctggacaaccctaaccccgccgtgccgggacggcaccgaagcctttaaaccggggctcccttggacctggcgggggggttcctgggcctcggggaggggggcaaacccccccccccgggggggggggggggcccttttcccccgggaaaactcccccgggggggggggagagctcccccccgcggggttggggggccacaccg

SEQ ID NO: 72860 - protein, 181 aa, Zea mays
  misc_feature: Ceres CLONE 1556849
  misc_feature: SWISSPROT Homolog: EC 1.1.1.47 Glucose 1-dehydrogenase
  misc_feature (37)..(37): Xaa is any aa, unknown, or other
  misc_feature (97)..(97): Xaa is any aa, unknown, or other
MADTGDVAAAAEASARPAGSSSTQPLAGRVAIVDGRXSRGIGRAIATHLSSLGASLVLGYAARADEAGALAASLPRAGGPVRADVSDEAGARSLFDXADEGLRRRAHPGGSAGCWTTLTPPCRDGTEAFKPGLPWTWRGGSWASGRGANPPPRGGGGALFPRENSPGGGGELPPAGLGGHT

SEQ ID NO: 72861 - DNA, 723 bp, Zea mays
  misc_feature: Ceres CLONE 1556852
  misc_feature: Encodes the peptide sequence at SEQ ID NO. 72862
  misc_feature (51)..(51): n is a, c, t, g, unknown, or other
ctggagctccccgcggtggcggccgctctagaactagtggatcccccgggnctgcaggaattcgtctcacccctagaaaaaaacgctctcttccttcggctcctcccctctcgctcctatcctctcccctccaatggcgaccgccatttcctctctagtaactcctccgaccctccaccgccgctgcctgggccctgcctgcgtctccgtctccgtgtgcacccctatccgcatctccttccggcccgcccgcgcgcctcatgtgtcgcgccgggccttcgcgcctgcggtgtccgcctcctcggcggtgctcaagggcgccagaggcggtggcgccccgaaactctacttggggaatttcccccgggacccttaaacaaaggagaagttcccgaaatgtttccctgcggcacgggacccctttaaggggggctaaggtttttttccaaacaatttaccaaattccccccccgggggtttggggtttttcccccaaaaaagccccggggaaaaggcccaaggccccccttttgaggtccccaagggggacgggaggggggggtattaaaaaaataaaagggaacccccccaaaagatctcctttccccaaatttggcccggtttgggccccaaaaccagggggccttttttttaaaaaaccccccaccaaggttttttttggggggaattctggggaaaaacgtggacaccccccggtttttt

SEQ ID NO: 72862 - protein, 80 aa, Zea mays
  misc_feature: Ceres CLONE 1556852
MATAISSLVTPPTLHRRCLGPACVSVSVCTPIRISFRPARAPHVSRRAFAPAVSASSAVLKGARGGGAPKLYLGNFPRDP

SEQ ID NO: 72863 - DNA, 605 bp, Zea mays
  misc_feature: Ceres CLONE 1556853
  misc_feature: Encodes the peptide sequence at SEQ ID NO. 72864
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
ctccccgcggtggcggccgctctagaactagtggatcccccgggctgcaggaattcgtctcacccctagaaaaaaggaggccaggaggggagaaaggcgaactcgaattgggggaagagagcgagagacgaatcgcatcgagccggagaggatcgtcagagacagggaggagggcggcggaatcggcgccggcgggaggcaggcatggaggacttgagcgtggaggagctcgcctccaacctctccacctacaaagagcagctacgcgaggtcaagaagcttatcaaggagaagaaaggatgatgctggatttttctgaatatattggaatatggaaaaaggaactttcnnnnnnnnnnnnnnnnnnnnnnnnnnnagnnnnnnnnnnnnnnnnnggnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 72864 - protein, 32 aa, Zea mays
  misc_feature: Ceres CLONE 1556853
MEDLSVEELASNLSTYKEQLREVKKLIKEKKG

SEQ ID NO: 72865 - DNA, 702 bp, Zea mays
  misc_feature: Ceres CLONE 1556866
  misc_feature: Encodes the peptide sequence at SEQ ID NO. 72866
  misc_feature (390)..(390): n is a, c, t, g, unknown, or other
ggagctccccgcggtggcggccgctctagaactagtggatcccccgggctgcaggaattcgtctcacccctagaaaaaacgcctccacctccctcgattcgttccgagcccatcgcctccgcctcttcgtcaccgtcgaggtcgcaccacatggcggcgctcctagcccggcaggcagcgcaggcgctccgcgcgagacagtcggcgcagctcgggccgacaacgtcggcgatgcaggggcacctccgtacctacatgaacgcggggattcccaagcggttcaaagaggaagaggagaaagaacagcttgcaaaagatatcgcaaaagattggaatgctgtgtttgaaagggagcatcatacattgtttttgactgaaatggtccgtggnctgatgctaactctcaagtacttcttcgagagaaacgttacattaaactatccgtttgagaaagggtcctctgagtccccggctcccgtggtgaggcacgctctcagagtttacgaatctggggaaaaacgttgcattgcttggaaaactatgcgaagctttttggccccgctcaggcaattccaattgagggctaaaaaacgtgaaaaagggattccccaaaacccagggggttgatttgacatggccaaaaggcttttccgggggggttccccaaaaagggttgcccaatctaatcctttgtgggggggg

SEQ ID NO: 72866 - protein, 158 aa, Zea mays
  misc_feature: Ceres CLONE 1556866
  misc_feature: SWISSPROT Homolog: EC 1.6.5.3 NADH dehydrogenase (ubiquinone)
MAALLARQAAQALRARQSAQLGPTTSAMQGHLRTYMNAGIPKRFKEEEEKEQLAKDIAKDWNAVFEREHHTLFLTEMVRGLMLTLKYFFERNVTLNYPFEKGSSESPAPVVRHALRVYESGEKRCIAWKTMRSFLAPLRQFQLRAKKREKGIPQNPGG

SEQ ID NO: 72867 - DNA, 715 bp, Zea mays
  misc_feature: Ceres CLONE 1556876
  misc_feature: Encodes the peptide sequence at SEQ ID NO. 72868
  misc_feature (19)..(19): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (49)..(49): n is a, c, t, g, unknown, or other
  misc_feature (608)..(608): n is a, c, t, g, unknown, or other
aaaaatacaaatataaaanaaaaacacatggttnnnnnnnnnnaaaaanaaaaagctgggactccccgcggtggcggccgctctagaactagtggatcccccgggctgcaggaattcgtctcacccctagaaaaaaccattcactcatccaccaccaccaacggcgccgcaacccccacgcaatctcaccggaaaaacgcctcctccagttgagctgagcctgagctgcagctgagccgccatgtgcccgcggacccactgagccaaaacccctcgaccccgcccccactgcaggccgttccctttccaagatccgcgctttgatccgtccgccgccgcccgagaccatgccggccacggacctccagggctcctccccgttctcctccttcggccgcaccctcctctccctccgccgcgacgccccggcgtccgcgtccgcggcggctgcgatgccgccgcccggcgtcgacccggagctcgaggagttccacgcccacgtcgccgcgcacctcgcggacctgagcggccccggcgctgctggggaggaggagttcatgtccatcgcgtggatccggcgcctgctggaggcgttcctgctctgccangaggagttccgggtggcggtggccgaggcgcgccgccgccgccgcgggggccactccccccgccgcccaagagcttggtggtcgaagttcggcgaaccgcgccgttt

SEQ ID NO: 72868 - protein, 122 aa, Zea mays
  misc_feature: Ceres CLONE 1556876
  misc_feature (87)..(87): Xaa is any aa, unknown, or other
MPATDLQGSSPFSSFGRTLLSLRRDAPASASAAAAMPPPGVDPELEEFHAHVAAHLADLSGPGAAGEEEFMSIAWIRRLLEAFLLCXEEFRVAVAEARRRRRGGHSPRRPRAWWSKFGEPRR

SEQ ID NO: 72869 - DNA, 617 bp, Zea mays
  misc_feature: Ceres CLONE 1556899
  misc_feature: Encodes the peptide sequence at SEQ ID NO. 72870
acccgcggtggcggccgctctagaactagtggatcccccgggctgcaggaattcgtctcacccctagaaaaagttccgccgttcgtcccctctggccctctctccatccccagcccacgaccctccgccaccagccatcgtctgcatcagatctcccgcccgtccgttacatcccagggcgacgcggccgcggccatgacgccatcctcagctctcgccctcgcgcaccacgccgcggtatccccgctcccgtcctccacgccgcggccctcccccaggtccagctctctgagcctgggcccgggctccgccgggctcgggccgcgccggctcgtcgcggcggcgcccccacgggcgttcttctcctcgtccccctaccagccgccccagccggaggggttctcgcagcaccgcgagtacggtctggtccccatggtcatcgagaccacctcccgcggggagcgcgcctacgacatcttctcgcgcctgctcaaggagcgcatcgtctgcatccacgggcccatcgccgacgacacggcctcgcttgtcgtcgcgcagctgctcttcctcgagtccgagaacccgctcaagcccgtccacctctacatcaactcccc

SEQ ID NO: 72870 - protein, 140 aa, Zea mays
  misc_feature: Ceres CLONE 1556899
  misc_feature: SWISSPROT Homolog: EC 3.4.21.92 Endopeptidase Clp
MTPSSALALAHHAAVSPLPSSTPRPSPRSSSLSLGPGSAGLGPRRLVAAAPPRAFFSSSPYQPPQPEGFSQHREYGLVPMVIETTSRGERAYDIFSRLLKERIVCIHGPIADDTASLVVAQLLFLESENPLKPVHLYINS

SEQ ID NO: 72871 - DNA, 545 bp, Zea mays
  misc_feature: Ceres CLONE 1556904
  misc_feature: Encodes the peptide sequence at SEQ ID NO. 72872
  misc_feature (99)..(99): n is a, c, t, g, unknown, or other
  misc_feature (236)..(236): n is a, c, t, g, unknown, or other
  misc_feature (285)..(285): n is a, c, t, g, unknown, or other
  misc_feature (291)..(291): n is a, c, t, g, unknown, or other
  misc_feature (295)..(295): n is a, c, t, g, unknown, or other
tggagctcacgcggtggcggccgctctagaactagtggatcccccgggctgcaggaattcgtctcacccctagaaaaaatccgaaagcccaagacactngagctggtctgtttagttggaaagccatctgtacgtttttcgccgatcatggaggatgagaggaacacccagcagcaccagggcggtgagcatgcccaggacccagagaaacgagtgaaggacaggggactcctggnacagctttctcgcagggaacagcccgacgaccaggaagaagaaaacccngcaccncccncaggcgggagaagaagacctggcaacccgcatggaaaaaagggcccggtggccaaacccccaccccaggggggagggcccccgggccccccaaaaaaaaggaaactttttccccaagggtgcccccccccccccctttttccttttttttgaaggcaaaaaaaaaaaagggggggtttttttataaaccccccctttttttttaaaaaaagaaaaaaaaaaacgccccttaaaaaaagcgggccaaaccc

SEQ ID NO: 72872 - protein, 99 aa, Zea mays
  misc_feature: Ceres CLONE 1556904
  misc_feature (30)..(30): Xaa is any aa, unknown, or other
  misc_feature (50)..(50): Xaa is any aa, unknown, or other
MEDERNTQQHQGGEHAQDPEKRVKDRGLLXQLSRREQPDDQEEENPAPPXGGRRRPGNPHGKKGPVAKPPPQGGGPPGPPKKRKLFPQGCPPPPLFPFF

SEQ ID NO: 72873 - DNA, 683 bp, Zea mays
  misc_feature: Ceres CLONE 1556907
  misc_feature: Encodes the peptide sequence at SEQ ID NO. 72874
  misc_feature (405)..(405): n is a, c, t, g, unknown, or other
  misc_feature (425)..(425): n is a, c, t, g, unknown, or other
  misc_feature (438)..(438): n is a, c, t, g, unknown, or other
agctccccgcggtggcggccgctctagaactagtggatcccccgggctgcaggaattcgtctcacccctagaaaaagagtccttgtcgaccactggactggatcagttagtttcagccttcaggcttccagcgatgtgttcctgcgcctgcgcgcgcctcctccccccgctcttcagccccgctccaagccccaatctcagacccgccttcccgcacagcccgacgccagcccgcagccgcgccgtcgtcgcgctcgcgggcgcagcctcccgggacgacgcgcctgcgccgttgtccagcttcgacttcctcgcactgaagcgggagcttgatgaggaagaggaggcagtggtggctgtggatgccaaggaaagtgctggagctgtcaatgaggacgatggganagttgggggcggaaatgaantgcgggtggtacnaagaaaccgcggccgaagcaaattgggaggcaatcggctctgcttgcgaaacagtgattatggggacctcgccccgaaccccgggttcgggtcccaactctggatcaaccccccctctgggcctgttgcatgggttcaaattaaaccacctttactttaggggaaagcgaaaaaattcctttttgaggacaaaatccgggtgggaaacttgggttcctgtttcaaaaaaaactgggatcaaaaat

SEQ ID NO: 72874 - protein, 154 aa, Zea mays
  misc_feature: Ceres CLONE 1556907
  misc_feature (91)..(91): Xaa is any aa, unknown, or other
  misc_feature (98)..(98): Xaa is any aa, unknown, or other
  misc_feature (102)..(102): Xaa is any aa, unknown, or other
MCSCACARLLPPLFSPAPSPNLRPAFPHSPTPARSRAVVALAGAASRDDAPAPLSSFDFLALKRELDEEEEAVVAVDAKESAGAVNEDDGXVGGGNEXRVVXRNRGRSKLGGNRLCLRNSDYGDLAPNPGFGSQLWINPPSGPVAWVQIKPPLL

SEQ ID NO: 72875 - DNA, 644 bp, Zea mays
  misc_feature: Ceres CLONE 1556916
  misc_feature: Encodes the peptide sequence at SEQ ID NO. 72876
ctccccgcggtggcggccgctctagaactagtggatcccccgggctgcaggaattcgtctcacccctagaaaaaacgctgtcgtcaaggcgggtaggcttctcctgtccctcacgtaccgggctagagctatgacgatctccgggtctcgtgcccataggtgagagcatccacatggacaccgcagatgtgcatgactacttcttcgtcggcagctctggtgggcctcgtactagcactggctccagaacgccgtgagctcctacggggaggtcctccagtccaagatcatcctcgatcgagagacgctgaagtcccccgactctctgcttcgatcagcatcgtccatgaacgaggcgatgcggaactccatcaagggcatgcactgcaaggagctggacggccgcatcgacacagtctacgaggcccactcccacggcagttgttcaggcgcgcccagtacgcacggtggcccccctggaggttcgcagtaccgaagtcgttggggccgtgacggccactccctctacagatgcgggggctgctaaagggcggtctgcgctactgtgatggtgcggccgccacgcgctgtgaaccatgacactagctctgctactcgacggatacgatggactgacgtggtgg

SEQ ID NO: 72876 - protein, 66 aa, Zea mays
  misc_feature: Ceres CLONE 1556916
MNEAMRNSIKGMHCKELDGRIDTVYEAHSHGSCSGAPSTHGGPPGGSQYRSRWGRDGHSLYRCGGC

SEQ ID NO: 72877 - DNA, 701 bp, Zea mays
  misc_feature: Ceres CLONE 1556917
  misc_feature: Encodes the peptide sequence at SEQ ID NO. 72878
ctccccgcggtggcggccgctctagaactagtggatcccccgggctgcaggaattcgtctcacccctagaaaaagactcgagcccgtccgccgccttcgctgcgccgcctccgcctcctccatcgcacgccggctccgctgcctccatccgcgcacgtccgcctccactgtctccatccgctcgggagccgccgccctccgcgctaggcctcgcctccgtctggtctggattcttcgacacctgggcgctccgcgtcgccgacttctcgcaggcggagagtgagcatccttgatagacctgatggctatcgcagagagctgtgttgatgcggtggtcatggagatggtagcagtctactgcgggtgggctctacaccggcaaaccagaacttgctgcccgccgcattcgaggccaacgggtttccagtcggggacccgcctccctaaaaaaataccatgggagggcccccgatttagggatcatcctggaaccatcaagtttttctgcaaaaaatttttggtccaaagcgttccaaaaaccaaattggccaatctgaaaacaatcccggggggacccttttgcccctaaaaaaaaccgtttttggggggggtaaccccgggtttcctaaaacccccgtttagagaaacccagttttccccgggaaaatatttttggccccatgtgggggtaaccgcgcccc

SEQ ID NO: 72878 - protein, 95 aa, Zea mays
  misc_feature: Ceres CLONE 1556917
MAIAESCVDAVVMEMVAVYCGWALHRQTRTCCPPHSRPTGFQSGTRLPKKIPWEGPRFRDHPGTIKFFCKKFLVQSVPKTKLANLKTIPGGPFCP

SEQ ID NO: 72879 - DNA, 710 bp, Zea mays
  misc_feature: Ceres CLONE 1556923
  misc_feature: Translation starting site: 121
  misc_feature (303)..(303): n is a, c, t, g, unknown, or other
  misc_feature (305)..(305): n is a, c, t, g, unknown, or other
  misc_feature (306)..(306): n is a, c, t, g, unknown, or other
  misc_feature (312)..(312): n is a, c, t, g, unknown, or other
  misc_feature (315)..(315): n is a, c, t, g, unknown, or other
agctccccgcggtggcggccgctctagaactagtggatcccccgggctgcaggaattcgtctcacccctagtaaaaaagccggacgacgcagcgtagcagcagagagccagagaccagagatggccgccctcgccgccgcctccacggccgccttcgccgcgaagccgcgcgcgcgcctctccgtggcctgctccgccgccaccggcgacagcagcagcgtggtcgctcgcgtcctccgtgaagacgttctccgccgcgctggcgctgtcgtcggtgctgctgtcctcggccgccacctcccntnncgccgnggncggcgacatcgcggggctgaccccgtgcaaggagtccaaggcgttccccaaagcgccgaaaagaactcgatcaaaagcctcaccgccttcgctgaaaaaagtaacggccccgaaggggcccccgggtctggcctttaaaggccccccttcgaaaaaaccaaggccccggttcaaaaactacgggaaaattcggggtggtgggggggggcccaaaggccttgcccccccttatttttaggggggaaaaagggggcatgggggcgaattttttaccccccggggcggggcttttcctttaaatatcccggttgtgatctggggggggcccaacaaaaatcttcccccttcccccccttgggggggaaaaaaaaaccccccctttggggggataatcc

SEQ ID NO: 72880 - DNA, 684 bp, Zea mays
  misc_feature: Ceres CLONE 1556926
  misc_feature: Translation starting site: 429
  misc_feature: SWISSPROT Homolog: EC 3.2.1.39 Glucan endo-1,3-beta-D-glucosidase
  misc_feature (597)..(597): n is a, c, t, g, unknown, or other
ctccccgcggtggcggccgctctagaactagtggatcccccgggctgcaggaattcgtctcaccctggagaccacaggatacaatatctgagtcacgacagaaacaatgaaccggatactgctatggtctagttatacatttgagccatgtttcgacctcgtctcgacacattctgctcctcatgttgcacaatatagatggaaaccttctcctatgccctcgagagaatatccagacgcatactgcataccacattgctccatcgctcgggtgcctaaggttgtacagcttctaggagcttctcatacacttgccgcgcagacaaatcctcaacaattagaagcttagatttgttattccatcctctttgaagggtcatctgagtcagtcttaggccaagaacctgaccgggcagctcgtcccggccatgtccaacgtgcacgacgcgctggtgaagcttggcctggacggggccgtgaaggtctcgacgccgatcgcgttcaccgcgctccaggagtcgtggccgccgtccgcgggcaggttccgggacgacatcgcgcggtcggtgatgaagcccatgatcgatttcctggagncgaccgggtcgtacctcaccgtgaacgcctacctgttcttcgcgtacgccgaggagccagaacagatctcctcgactacgccctggg

SEQ ID NO: 72881 - DNA, 660 bp, Zea mays
  misc_feature: Ceres CLONE 1556927
  misc_feature: Encodes the peptide sequence at SEQ ID NO. 72882
  misc_feature (490)..(490): n is a, c, t, g, unknown, or other
  misc_feature (660)..(660): n is a, c, t, g, unknown, or other
agctccccgcggtggcggccgctctagaactagtggatcccccgggctgcaggaattcgtctcacccctagaaaaaaaactctctcgagtcgattcctaagcagctagccagtgactcgatcttagcgtgctacaatggcggcagctgctagtgccctgctcctcctgctctgctcagccttctgctcccttgcccaccgggcggccggcgtcgactacggctcgtggcagagcgcccacgccacgttctacggcggcggcgacgcgtctggcacgatgggcggcgcgtgcggctacgggaacatgtacagcacggggtacggcaccaacacggcggcgctgagcacggcgctgttcaacgacggcgccgcgtgcgggtcctgctacgagctgcgctgcgacaacaacgggcagtcgtgcctgccgggcaccatcaccgtcacggccaccaacttctgcccgcccaactacggcctcctcagcgacgacngcggctggtgcaacccgccgcgcccgcacttcgacatggcccagccggccttcctccagatcgcgcagtaccgcgccggcatcgtgcccgtcgcctacaggaggggtgccgtgcgtgagaaagggcgggatcaggttcaccatcaacggccactcctacttcaaccctgn

SEQ ID NO: 72882 - protein, 174 aa, Zea mays
  misc_feature: Ceres CLONE 1556927
  misc_feature (66)..(151): Pfam Name: DPBB_1 Pfam Description: Rare lipoprotein A (RlpA)-like double-psi beta-barrel
  misc_feature (119)..(119): Xaa is any aa, unknown, or other
MAAAASALLLLLCSAFCSLAHRAAGVDYGSWQSAHATFYGGGDASGTMGGACGYGNMYSTGYGTNTAALSTALFNDGAACGSCYELRCDNNGQSCLPGTITVTATNFCPPNYGLLSDDXGWCNPPRPHFDMAQPAFLQIAQYRAGIVPVAYRRGAVREKGRDQVHHQRPLLLQP

SEQ ID NO: 72883 - DNA, 653 bp, Zea mays
  misc_feature: Ceres CLONE 1556930
  misc_feature: Encodes the peptide sequence at SEQ ID NO. 72884
cgcggtggcggccgctctagtactagtggatcccccgggctgcaggaattcctctcacccctagaaaaactgcaaacatctttttccatgaagcttggaaaattcagcttgaactagccaatggcacagaacatggaagtccctttttcagctgtattgccaaggatatgcatgagagatttgacaaatactggaaagattgcagcctggtgttagccattgctgttgttatggatccacgtttcaagatgaagcttgtcgagttcagttactctaaaatttatggtgctgaggctgcaaaatatgttaaggttgtcaatgactctctgcatgagctgtataaggagtatgtggcacacacactccctgtgggtcctgcctatgttgaagctaataacgtggctgccaacacgaatgttaaccagggaaatcctcctccaactagtgatggtcttcttgactttgatatgtacctttctgagattcacagtagccagcctgcaaaatgtgaactggagcattatctgggaggaatctcttcctccacgccatccggaagttgggtaattcttaaccgggggaaagcttaaaacccctcagatttccaaccctggtgcaaaaaatggcccgggaaaatcttgggcaatcccccg

SEQ ID NO: 72884 - protein, 140 aa, Zea mays
  misc_feature: Ceres CLONE 1556930
MHERFDKYWKDCSLVLAIAVVMDPRFKMKLVEFSYSKIYGAEAAKYVKVVNDSLHELYKEYVAHTLPVGPAYVEANNVAANTNVNQGNPPPTSDGLLDFDMYLSEIHSSQPAKCELEHYLGGISSSTPSGSWVILNRGKA

SEQ ID NO: 72885 - DNA, 656 bp, Zea mays
  misc_feature: Ceres CLONE 1556934
  misc_feature: Encodes the peptide sequence at SEQ ID NO. 72886
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
ggagctcaccgcggtggcggccgctctagaatagtggatcccccgggctgcaggaattcgtctcacccctagaaaaaagataagatcgagcagcgagagacgggcaggggaggaaaaaaatctaaccctagcatccgcagcgctagggttcgggggttgcgatggcggcggcggcgaggcagcgggggacggtgaagtggttcaacgacaccaagggcttcgggttcatctcccccgaggacggcagcgaggatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaagcggaagaggcggcggcggcggcggctacggctcccgcggcggtggcggatctggcggcggcggtcgcagctacggtggtagctggggcggcggccggagatccggcggcgggggcggtcctggcgcgtgctacaagtgcggcgagcccggccacatggccagggactgccctagcgccgacggcggaggctacggcggaagcgtacgagnnnnnncnnnccccccacggannnannnaaaccccccc

SEQ ID NO: 72886 - protein, 165 aa, Zea mays
  misc_feature: Ceres CLONE 1556934
  misc_feature (6)..(73): Pfam Name: CSD Pfam Description: 'Cold-shock' DNA-binding domain
  misc_feature (124)..(141): Pfam Name: zf-CCHC Pfam Description: Zinc knuckle
  misc_feature (153)..(153): Xaa is any aa, unknown, or other
  misc_feature (154)..(154): Xaa is any aa, unknown, or other
  misc_feature (155)..(155): Xaa is any aa, unknown, or other
  misc_feature (156)..(156): Xaa is any aa, unknown, or other
  misc_feature (160)..(160): Xaa is any aa, unknown, or other
  misc_feature (161)..(161): Xaa is any aa, unknown, or other
  misc_feature (162)..(162): Xaa is any aa, unknown, or other
MAAAARQRGTVKWFNDTKGFGFISPEDGSEDLFVHQSSIKSEGFRSLAEGEEVEFSVSEGDDGRTKAVDVTGPDGSFVRGGGSGRGGGGGGYGSRGGGGSGGGGRSYGGSWGGGRRSGGGGGPGACYKCGEPGHMARDCPSADGGGYGGSVRXXXXPPRXXXNPP

SEQ ID NO: 72887 - DNA, 675 bp, Zea mays
  misc_feature: Ceres CLONE 1556943
  misc_feature: Encodes the peptide sequence at SEQ ID NO. 72888
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
ctggagctccccgcggtggcggccgctctagaactagtggatcccccgggctgcaggaattcgtctcacccctagaaaaaaagatccaggccgtcttcagatcctacctggcgaggaaggcgctgtgcgcgctgcgcggactcgtcaagctgcaggcgctggtgcgcggccacctggtgcggcgccaggccagccacaccctgcgctgcatgcaggcgctcgtcacggcgcagaacagggcgcgcgccgagcgcctccggatgctcgaggacgagaagcccgtccggacaccgcggacgacgccgggccggcgcagttcgccgcactatccccggttccgccactaccacccagacacggcgtaggacaacgtcaagatcgtggaagtggacaacggcgccggcgaaccccaagcgcacgggaccgcgcgcacgtcccgggggaacaactgctaccgaacccccttggcccaacgcccttccaaaaaaacttgaacaaaaaatttcccaaaacccttccggcttaacaaaaaccggggggggaaattaaaaggggcgggaaaaaaaatttttctttcccccgggggggggaacccataacttttccccccttagggggggnnnnnnnnaaaaaaacaccaaaaaaacccttcggggaaaaaacccccctcccccc

SEQ ID NO: 72888 - protein, 120 aa, Zea mays
  misc_feature: Ceres CLONE 1556943
GAPRGGGRSRTSGSPGLQEFVSPLEKKIQAVFRSYLARKALCALRGLVKLQALVRGHLVRRQASHTLRCMQALVTAQNRARAERLRMLEDEKPVRTPRTTPGRRSSPHYPRFRHYHPDTA

SEQ ID NO: 72889 - DNA, 644 bp, Zea mays
  misc_feature: Ceres CLONE 1556946
  misc_feature: Encodes the peptide sequence at SEQ ID NO. 72890
ctggagctccccgcggtggcggccgctctagaactagtggatcccccgggctgcaggaattcgtctcacccctagaaaaaacttcgctgcttctttgttggtcttctttcctttgggcaccctttcgaaagctgtaggtgcaggaattagtaagaagagaaggaagcaagcatgtcgaagcctgttgcagcagcaatggtccccgtggtggcgctgatgatggtgctgtgcgcgtgcacgatgcccgcgcgcggcggggacgactacacggcgttcgtgtacgccgggtgctcgcaggggcggtacgaccccgggtcgcagtacgccgcggacgtggacacggcgctgtcgtccctggcgaacagcgccggcttcaccgcctacgccaactacacctcgccgtcgccgtcgggcctggagggcgtgtaccagtgccggtccgacctgcccgccgcggtgtgcggcgtctgcgtgaagtcggccgtgtcgaagctggcctcgctctgcagcgcggcggcgggcgccgcagtgcagctgcgcgcctgcttcgcgcggtacgggaacgactcgttcctggggaagcaggacacgacggtgctgttcaagaagtgcggcggcggcggcggcggcggcgacgatgcggg

SEQ ID NO: 72890 - protein, 157 aa, Zea mays
  misc_feature: Ceres CLONE 1556946
  misc_feature (82)..(136): Pfam Name: DUF26 Pfam Description: Domain of unknown function DUF26
MSKPVAAAMVPVVALMMVLCACTMPARGGDDYTAFVYAGCSQGRYDPGSQYAADVDTALSSLANSAGFTAYANYTSPSPSGLEGVYQCRSDLPAAVCGVCVKSAVSKLASLCSAAAGAAVQLRACFARYGNDSFLGKQDTTVLFKKCGGGGGGGDDA

SEQ ID NO: 72891 - DNA, 675 bp, Zea mays
  misc_feature: Ceres CLONE 1556947
  misc_feature (396)..(396): n is a, c, t, g, unknown, or other
gagctccccgcggtggcggccgctctagaactagtggatcccccgggctgcaggaattcgtctcacccctagaaaaaaagaaccaacgtgctcgatctccatctcgaccgtcgctcaccgggaagctacgctacgacgaagcatggcgtccgtcaccgcccgcgccccggtcgcggccctgcgcccgtcggcgtctctcaagtcgtcgtcgtcggtcggcggcggccttccttggccactctagccgcctcggccgcactgctaccgcgtcgccgacgaggcgcagcctaaaggcggaggccaagggcgagtggctcccgggccttccctcccccgcctacctcgacggcagcctgcctggtgacaatcccttcgacggggtgggcctgggcggangaccccggagaacctgaggtggtacgtgcaggcggagctggtgaacgggccgtgggcgatgcttggccgtgcccgaatgctcatccccgaggtgctgacaaaggccgggctgatcaacgcgccccagtggtacaaccgcggcaaagtcgaaatactttcgcgtcgtccttcaaccttgtttgggattccgaggtcttcccggtttccctacgtgggaaatccggcgggtggcgggacattcaaaacccccgggggcgttcaaccgggaaccctttcttt

SEQ ID NO: 72892 - DNA, 618 bp, Zea mays
  misc_feature: Ceres CLONE 1556964
  misc_feature: Encodes the peptide sequence at SEQ ID NO. 72893
  misc_feature (490)..(490): n is a, c, t, g, unknown, or other
  misc_feature (491)..(491): n is a, c, t, g, unknown, or other
aaagctggagctccccgcggtggcggccgctctagaactagtggatcccccgggctgcaggaattcgtctcacccctagaaaaaagctccgcctccctttcctaccttcttccctccgtctcccagctcgcgcaggcaggcgacacagcgacgctaaaaaccctagagcgaggaggcgtgccaggccagcggtttgcgatgacggcaccggcggacaaggggaagaaggccaagaccgatgccgacggcggcgaggagaacgagcaaatcgacggcgcccttgtcttctccatcgagaagctccaggagattcaggacgagctcgagaaggttaatgaggaagcaagtgacaaggttatggaggtggagcagaaatacagtgagattcgcagacctgtctatctcaagaggggtgacattatcaagaccatcccggacttttggctcacagcgtttttgagccatcctctactaagtgagcttctgactnngagagatcagaagatatttcagtacttggactcccatgatgtcgatgattctgatgttaaggcagatattccatttaccttacttctccgaaaacccgtactttgaagacccaaagctttccaagac

SEQ ID NO: 72893 - protein, 132 aa, Zea mays
  misc_feature: Ceres CLONE 1556964
  misc_feature (98)..(98): Xaa is any aa, unknown, or other
MTAPADKGKKAKTDADGGEENEQIDGALVFSIEKLQEIQDELEKVNEEASDKVMEVEQKYSEIRRPVYLKRGDIIKTIPDFWLTAFLSHPLLSELLTXRDQKIFQYLDSHDVDDSDVKADIPFTLLLRKPVL

SEQ ID NO: 72894 - DNA, 702 bp, Zea mays
  misc_feature: Ceres CLONE 1556967
  misc_feature: Encodes the peptide sequence at SEQ ID NO. 72895
  misc_feature (454)..(454): n is a, c, t, g, unknown, or other
  misc_feature (481)..(481): n is a, c, t, g, unknown, or other
  misc_feature (620)..(620): n is a, c, t, g, unknown, or other
  misc_feature (662)..(662): n is a, c, t, g, unknown, or other
  misc_feature (666)..(666): n is a, c, t, g, unknown, or other
ctggagctccccgcggtggcggccgctctagaactagtggatcccccgggctgcaggaattcgtctcacccctagaaaaaaccgccttcttctcaccagcccctctcgcctcacgaaaaggcgcaggccaaggccaaggccaagccgccccctccctcctctcgtctccactctctctctctctctggcagccaaaggcgaggccgagatccggcgcgcggaggatgccttccaggtccatgagccggctgtccgtcgagtccgcctcgggcagcgggggcggctgccgggaggccgagccggtgctctgcgcgcctcggccgcgcagggcccagcagcagctggtccacgtccacccccgcggcgccgacctcatcctcggcccgccgcccttcctgctcaacgagagcagcgaggagggtcgctgcactgcgcggtttttgggggggggggngttctcccccccggccccccccggccncccccgctgggtgcccggccccccgcttccctgctggagcccggcgccccccccgcggcgggccccccccgcttggggcctcggcttctttcgtcccgcctgtttcccgccccggcggcttccgtgcccccgggccggnccgccgtccgacgttcctttttcccgtgcctccgggcccccngccngcccgccggcgggcctgtttgcctgccttggtgcct

SEQ ID NO: 72895 - protein, 159 aa, Zea mays
  misc_feature: Ceres CLONE 1556967
  misc_feature (77)..(77): Xaa is any aa, unknown, or other
  misc_feature (86)..(86): Xaa is any aa, unknown, or other
  misc_feature (148)..(148): Xaa is any aa, unknown, or other
MPSRSMSRLSVESASGSGGGCREAEPVLCAPRPRRAQQQLVHVHPRGADLILGPPPFLLNESSEEGRCTARFLGGGXFSPPAPPGXPRWVPGPPLPCWSPAPPPRRAPPAWGLGFFRPACFPPRRLPCPRAGPPSDVPFSRASGPPAXPPAGLFACLGA

SEQ ID NO: 72896 - DNA, 674 bp, Zea mays
  misc_feature: Ceres CLONE 1556971
  misc_feature: Translation starting site: 117
  misc_feature (350)..(350): n is a, c, t, g, unknown, or other
  misc_feature (353)..(353): n is a, c, t, g, unknown, or other
  misc_feature (358)..(358): n is a, c, t, g, unknown, or other
  misc_feature (359)..(359): n is a, c, t, g, unknown, or other
ggcggccgctctagaactagtggatcccccgggctgcaggaattcgtctcacccctagaaaaaatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctngtngaccnngttcgaggtgccggagtacctcaccggagaggtccctggagactatggctacgacccttttggctgggcaagaagcaagaggacttcgcaagtacaaggctacgagctgatccatgcagaagggccatgctcggtgcggctggccctgtcatcccaaaggcctgaaacaagttcgggccaaacgggggccctaaggctgtcgggtttcaagaacgggggccctgttccgggaggggaaacaccctaaaatatttggggaaaaaggattcccattaaacctggtggggggccctgaaatcccgaaggttacccctc

SEQ ID NO: 72897 - DNA, 666 bp, Zea mays
  misc_feature: Ceres CLONE 1556973
  misc_feature: Encodes the peptide sequence at SEQ ID NO. 72898
  misc_feature (330)..(330): n is a, c, t, g, unknown, or other
  misc_feature (360)..(360): n is a, c, t, g, unknown, or other
ggcggccgctctagaactagtggatcccccgggctgcaggaattcgtctcacccctagaaaaaatctctctctgcgccgtcccgtgctccctccgctagttctcccaattccttccccacctcctcggtcgtcgcctcccccagagagcaggagccgcctcgtccctgccggtcccgacccccatcccgtccgcgtccaacgccatgaatcccgagtacgactacctcttcaagctgctcctcatcggcgactccggtgttgggaagtcttgcctgctgctgaggtttgcggatgattcatatctgggagagctatatcagtactatggnagctgattttaaatccgcaccgttgagcangatggggaaacaataaagctacagatttgggatactggctggccaggaacgcttttagacattcccagcagcttctacgggggactccaggcattattgtgggggaggaggtacggaccaggggagcttttacatggcaagcaggggttgaagaatttgataggattcccttgaaaatggtaacaccctttgggggggaaaaaagtgggaccgggttaaaaaaaaaaatttttttacaaaggtgggaaggcccttgcggagaaatccgaaaacctttccttggaacaggggccagggatcccaaaa

SEQ ID NO: 72898 - protein, 43 aa, Zea mays
  misc_feature: Ceres CLONE 1556973
MNPEYDYLFKLLLIGDSGVGKSCLLLRFADDSYLGELYQYYGS

SEQ ID NO: 72899 - DNA, 634 bp, Zea mays
  misc_feature: Ceres CLONE 1556974
  misc_feature: Encodes the peptide sequence at SEQ ID NO. 72900
acccgcggtggcggccgctctagaactagtggatcccccgggctgcaggaattcgtctcacccctagaaaaaccgcagcgtctcgactggtcccctccttcctcttctcttcctcttcctctcacatcccggacaaatccaatccgaaatcatctccccctcgcctcgcctagaagaggaaggaagaacagagataagcgacaacgcgtccctcctcgccttcctcccgcctcgagctcttcccgggagcaccggagccacagacgtcaggacagcctagcgcgttccacgccggtatgcagaaccagatcatgtgccatgcttgccggacccttctgctctacccgcgtggcgcgtctagcgtctgctgcgccgtttggcaggcccatcaccacgtgccgccaaccagaatggagatgggtccacctttatgggggtggctgggaaacttggctgaaggataccccccatggcaacacccgtaagggggttctgtttgcacaccagggaaacctggttagacccggggaaaatataaccccaggggaaactgggcccctggcccgagaaaatttttagggttccctttccggggaaccctttcgaaaaaagtggccgcaagccaaaatttgtc

SEQ ID NO: 72900 - protein, 62 aa, Zea mays
  misc_feature: Ceres CLONE 1556974
  misc_feature (7)..(31): Pfam Name: zf-LSD1 Pfam Description: LSD1 zinc finger
MQNQIMCHACRTLLLYPRGASSVCCAVWQAHHHVPPTRMEMGPPLWGWLGNLAEGYPPWQHP

SEQ ID NO: 72901 - DNA, 713 bp, Zea mays
  misc_feature: Ceres CLONE 1556979
  misc_feature: Encodes the peptide sequence at SEQ ID NO. 72902
  misc_feature (366)..(366): n is a, c, t, g, unknown, or other
  misc_feature (367)..(367): n is a, c, t, g, unknown, or other
ctccccgcggtggcggccgctctagaactagtggatcccccgggctgcaggaattcgtctcacccctagaaaaaagaccggagacttgggggcttcacctgctgtatctcattaccatctgcatctggttgcccgttgattgagaaggaggagctgagggccatggcgaccgagaagcccatcctgtacaacgcctggatcagctcctgctcccaccgtgttcgcatcgcactcaacctcaaaggtgtggattacgagtacaagtcggtaaaccctaggacagatccagattatggaaaaaatcaaatccaatcaaatatattccagcattagtagatggggacatagtcggtttctgattcctcnntgccatctcattggatttgggaagatagttatcccggagcatccccctccctgccctaaagatctcaaaaaggaaagctccttaatcttccaaattgcaaaccttgttttgttcaaggctttcaacctcttcagggctttgcttgttattggcctgccccaagggttaggattgacccccaatgaggggccttccttttggttcaaagttttttttggaaggggtttctcaaagcctttccaaaaactttttgggagggtgtggggaaaaaaaatttgcccccgggggaaaggagtcccaattggggcaaaattgtttccctttaacacaaaaattaattgccccg

SEQ ID NO: 72902 - protein, 56 aa, Zea mays
  misc_feature: Ceres CLONE 1556979
  misc_feature: SWISSPROT Homolog: EC 2.5.1.18 Glutathione transferase
MATEKPILYNAWISSCSHRVRIALNLKGVDYEYKSVNPRTDPDYGKNQIQSNIFQH

SEQ ID NO: 72903 - DNA, 649 bp, Zea mays
  misc_feature: Ceres CLONE 1556982
  misc_feature: Encodes the peptide sequence at SEQ ID NO. 72904
ggagctccccgcggtggcggccgctctagaactagtggatcccccgggctgcaggaattcgtctcacccctagaaaaagtacctccggcgcctccgactccggtcctccggcctgcgcaggctagctagctctatttaggtccaccgtgcccccgccgcgcaggcaggggagatccaagggtccgagcagaaggccgccggcggcgagccagccagccagctaaagcgatccatatatacatatatactatcgagcaacacgtaaggaaggaaggaagaaagaagccaagcccaccagggccagggaagagagcatagctaaggaaggaaggaaggaagatgatgagcaaggaggcagtggtgaacgcgttcctgggctgcttcatgcacgtggggctggcgctggtgctcgccgtctacctccccgtggcctttgtgtgccgcctcctccaccgcctcctcgtccgccccttcgccaggggcgaggacctccgcggcaaggtcatcctcgtcaccggcgcgtcctccggcatcggcgagcacctggtgtacgagtacgcgaggcaccgcgcgtgcgtggcgctggtggcgcgcaccgaggtggcgctgcgcgccgtgggccaagcggcgcgcgactgggcgcccccga

SEQ ID NO: 72904 - protein, 103 aa, Zea mays
  misc_feature: Ceres CLONE 1556982
  misc_feature: SWISSPROT Homolog: EC 1.1.1.146 11-beta-hydroxysteroid dehydrogenase
MMSKEAVVNAFLGCFMHVGLALVLAVYLPVAFVCRLLHRLLVRPFARGEDLRGKVILVTGASSGIGEHLVYEYARHRACVALVARTEVALRAVGQAARDWAPP

SEQ ID NO: 72905 - DNA, 586 bp, Zea mays
  misc_feature: Ceres CLONE 1556990
  misc_feature: Encodes the peptide sequence at SEQ ID NO. 72906
  misc_feature (223)..(223): n is a, c, t, g, unknown, or other
  misc_feature (241)..(241): n is a, c, t, g, unknown, or other
  misc_feature (258)..(258): n is a, c, t, g, unknown, or other
  misc_feature (288)..(288): n is a, c, t, g, unknown, or other
  misc_feature (289)..(289): n is a, c, t, g, unknown, or other
  misc_feature (445)..(445): n is a, c, t, g, unknown, or other
  misc_feature (446)..(446): n is a, c, t, g, unknown, or other
tggagctccccgcggtggcggccgctctagaactagtggatcccccgggctgcaggaattcgtctcacccctagaaaaaacctcaggctgcttgaagtagtatgcatcagcggccctggtcctctctcccgctcccgctcaagggcagcagagaaagcagctgagcgctgactgtggatctcatccgtatcgcgtatatacgtcgtcctgtttggatccaccngcgttttgctaattcccnttcgaacccggccgggntggggccttttcgttttttccccccccaanngccccccttttttttttttccccccttttttccccccccccaaaaaaaactccccaagggggggacccccccccccttttttttaaatagggggggggttttttaaaaaaaaaaaaacaccccccccccggttttctcgccccccttttttttttnnccccccccccccaaaaaaaaaaaaaaatttttttttaaaaaaaaaaaaaaaaaaatgggggggggggggggcaacaaaccaaaaaaaaaaaaaaatacccccgcccccccccctcttttgtgttttcgcgcccccccccc

SEQ ID NO: 72906 - protein, 32 aa, Zea mays
  misc_feature: Ceres CLONE 1556990
GAPRGGGRSRTSGSPGLQEFVSPLEKTSGCLK

SEQ ID NO: 72907 - DNA, 649 bp, Zea mays
  misc_feature: Ceres CLONE 1556992
  misc_feature: Encodes the peptide sequence at SEQ ID NO. 72908
  misc_feature (599)..(599): n is a, c, t, g, unknown, or other
  misc_feature (602)..(602): n is a, c, t, g, unknown, or other
ctccccgcggtggcggccgctctagaactagtggatcccccgggctgcaggaattcgtctcacccctagaaaaacttcctcatccagtgttctgtcctagcgccgccgccgccccagctcgccttgcgtgactgagagctcgtcggcttccgtccacgcgtgaagcgagagcatggacacccaggtgaagcttgctgttgtggtgaaggtgatgggcaggaccggctccaggggtcaggtgacccaggtcagagtgaagtttttggatgaccagaaccggctcatcatgaggaatgtcaaggggcccgttcgcgagggtgacatcctcaccctgctcgagtccgagagggaggccaggaggctgcgctgaagccctagcgttcttggtgggctcttgtatggtctttggtgtcttggaatttgtgctatgtttgaacttctgtgaccctgttttaagagtagtaagcctggttataagattgcagttttgtttatcttggttgaaagtgcaattggtgttgagacatggttatccttgctatattatctataaaacgacgcatgcattgaataaaaaaaaaaaaaacttcaacttgaanaanaagtgtggcgagcagggcccgagcgtgtgctccaaccctgtcgtcgg

SEQ ID NO: 72908 - protein, 65 aa, Zea mays; identical to SEQ ID NO: 5504
  misc_feature: Ceres CLONE 1556992
  misc_feature (1)..(65): Pfam Name: Ribosomal_S28e Pfam Description: Ribosomal protein S28e

SEQ ID NO: 72909 - DNA, 656 bp, Zea mays
  misc_feature: Ceres CLONE 1556994
  misc_feature: Encodes the peptide sequence at SEQ ID NO. 72910
ggagctccccgcggtggcggccgctctagaactagtggatcccccgggctgcaggaattcgtctcacccctagaaaaacagctcctctctgggctgtggtggctgtggctcccaagcacacggcccgcacgagcagttggaacagattcctcgaccgcgtcgccccggaacccagttcttggcatccggtgcctagcttcgtcgcccctccggcaaagaccacctccagccctccacctcccgcggtagcgcttgctgctagtgagctagtatatttctgaaaccggaaacccgcgacacgggaccgagttcttgggagcggattcggctcgctgcaggctgaggctaccggcgcgctcttctccacggcggcggagagccagccagtagttgcgaccggaggcgggcatgggcgcgggcgtgtcgggcctggcgggcgcggagcccggcggcaaggtggcgcgcggcgccgggctgggcgacctcccggagctgtgcaccgcggaggtgctgctccgcctcggcgcgccggacatatgccggctcgcgcggctcaacctagcgttccgcggcgccgcggggcgcggacttcgtgtgggagggccagctgccgggggaactacgccggctcctgcctcgaaaaaaaaaggggccag

SEQ ID NO: 72910 - protein, 82 aa, Zea mays
  misc_feature: Ceres CLONE 1556994
MGAGVSGLAGAEPGGKVARGAGLGDLPELCTAEVLLRLGAPDICRLARLNLAFRGAAGRGLRVGGPAAGGTTPAPASKKKGA

SEQ ID NO: 72911 - DNA, 685 bp, Zea mays
  misc_feature: Ceres CLONE 1556995
  misc_feature: Encodes the peptide sequence at SEQ ID NO. 72912
  misc_feature (685)..(685): n is a, c, t, g, unknown, or other
ctccccgcggtggcggccgctctagaactagtggatcccccgggctgcaggaattcgtctcacccctagaaaaatactagaaaaacccctagaaaaagcattctggggttagccgttcttgagtacttcctacatgctttcccagatcaacttctcaccttcgttaatatatgtcatacttattccaaaccacagcatcatttgacaagctttctaaccattgagcagttactcgtttgtttagggcattgctgcagattccaacggcctattcttcaatttctcgcgtgcgtgtagctccggctgcattcttgccagcaagatacaactttgaaggctatatcccccgtagctgctccagttcatcgcttcagatctatagccggtcatcgatgttaaatctaccaccatcttcagctctcacggtgtcctcccagctcacctcctctgacgtagcccagcgttcagaggaatggttcactcttcgcaaggacaagctcaccacaagcaccttcagtaccgccttgggtttctgggctggcaacagaagggcagagctgtggaacgagaaagtttttggcgcgacagagaccaagctggcggacaccgcgaggtctgccatggactggggcacgcatcatgagagcgtagccatagagcagtacacgagcatcacaggaaagcn

SEQ ID NO: 72912 - protein, 97 aa, Zea mays
  misc_feature: Ceres CLONE 1556995
MLNLPPSSALTVSSQLTSSDVAQRSEEWFTLRKDKLTTSTFSTALGFWAGNRRAELWNEKVFGATETKLADTARSAMDWGTHHESVAIEQYTSITGK

SEQ ID NO: 72913 - DNA, 685 bp, Zea mays
  misc_feature: Ceres CLONE 1557003
  misc_feature: Translation starting site: 109
acagctggagctccccgcggtggcggccgctctagaactagtggatcccccgggctgcaggaattcgtctcacccctagaaaaaaaaaaaaaaaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtccgcggacccggagagggggggcagaaccgggagctggaggttatccactcccgctgggccatgctgggcgcgctcggctgcgtcttcccggaactgctccccccaaccgggttcagtttcgggaagcccgggtggttcaagggcgggtccccaaatcttcagcggggggggacgggactacctcggggaacccgacccttttcccccgcgcagaacatcctcccccatctgggcgctgcccgggtctggcttatggggcgcccttcaaaggggttaccgcttcgcggggggggcccgcttggggaaaggtcgtccgaccg

SEQ ID NO: 72914 - DNA, 536 bp, Zea mays
  misc_feature: Ceres CLONE 1557007
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (124)..(124): n is a, c, t, g, unknown, or other
  misc_feature (128)..(128): n is a, c, t, g, unknown, or other
  misc_feature (134)..(134): n is a, c, t, g, unknown, or other
  misc_feature (135)..(135): n is a, c, t, g, unknown, or other
  misc_feature (160)..(160): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccaaaactggggactccacgncggntggcgnngccgctctagaatagtggatccccncgggctgcaggaaattcgtctcacccctagaaaaaccgctgtggcctggtccctttatataacgcctcccccttccggtccgcgcccctcctccgctgccctcctcgcctccctcgattcagggttcagtgaattcggaaagaaccccggcgtgtccgtgtcgaccgacccctcccccctgcgaaccctgcgaaagaaatctcctgccgctcttccccggccgggccaaaatggaacgtggtcttttgtaaagaaagggtaaatcccctttccaaaaaaaaaatttggccctctttaaaaggctgagggggcctaacgttgaaaggaaaaaaaaaacccaaaaaaaaaaaggctttctgaaaactaaaaaaaaaag

SEQ ID NO: 72915 - DNA, 670 bp, Zea mays
  misc_feature: Ceres CLONE 1557014
  misc_feature: Encodes the peptide sequence at SEQ ID NO. 72916
aaagctggagctccccgcggtggcggccgctctagaactagtggatcccccgggctgcaggaattcgtctcacccctagaaaaaaaccgagacaccgcgtgcgaaccaagcagaccccagcagaagaagcgaagtcgtcgccggagcaggaggaagagcgaggagcaacatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggacttcgatgaacctggaactcttgcaccaactggtctttttgttggaggtacgaagtacatggtgatccaaggtgaacctggagttgtcatccgaggaaagaagggcactggaggcattactatcaagaaaactggcatgtccttgattatcggtatctatgatgagccaatgactccagggcatgcaatatggtgggtggagaggctcggcgattacctgatcgaacaggcttctaagggggtgtttgtggttgaagcatcactccatccaaaaatgtggtgggccatcatggatccattcctcagattttggtgggatgaccccattcctcatattagtact

SEQ ID NO: 72916 - protein, 167 aa, Zea mays
  misc_feature: Ceres CLONE 1557014
  misc_feature (2)..(126): Pfam Name: Profilin Pfam Description: Profilin
MSWQAYVDDHLLCDIEGQHLSAAAIVGHDGSVWAQSENFPELKPEEVAGMIKDFDEPGTLAPTGLFVGGTKYMVIQGEPGVVIRGKKGTGGITIKKTGMSLIIGIYDEPMTPGHAIWWVERLGDYLIEQASKGVFVVEASLHPKMWWAIMDPFLRFWWDDPIPHIST

SEQ ID NO: 72917 - DNA, 671 bp, Zea mays
  misc_feature: Ceres CLONE 1557016
  misc_feature: Encodes the peptide sequence at SEQ ID NO. 72918
  misc_feature (387)..(387): n is a, c, t, g, unknown, or other
  misc_feature (471)..(471): n is a, c, t, g, unknown, or other
ctggagctccccgcggtggcggccgctctagaactagtggatcccccgggctgcaggaattcgtctcacccctagaaaaatcacacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatccggaggagcttnccgcggccgagcagcaggcagccgccgaagcggaggggcgcgctcctgctggtgcgaagagcccgtcgcggccgacccggcgcnaagggcggagctgctgctcctgctggtcccaagggaaatcctgccgtcaaacagggaggaccccccaaggagaagggtgctgctggtcctccggttggggcaaaaaacccccccgggccaaaacttgtcccaaaagaaaaggctgcgccccccaaaagaatccccccggaaaaaaccgaaggttttgttttttgtttttt

SEQ ID NO: 72918 - protein, 147 aa, Zea mays
  misc_feature: Ceres CLONE 1557016
  misc_feature (53)..(53): Xaa is any aa, unknown, or other
  misc_feature (81)..(81): Xaa is any aa, unknown, or other
MATAEVQTPTVVAAEEAPVVETPPPAVVPEESAPAEAEAEAEAAAPADPEELXAAEQQAAAEAEGRAPAGAKSPSRPTRRXGRSCCSCWSQGKSCRQTGRTPQGEGCCWSSGWGKKPPRAKTCPKRKGCAPQKNPPGKNRRFCFLFF

SEQ ID NO: 72919 - DNA, 647 bp, Zea mays
  misc_feature: Ceres CLONE 1557017
  misc_feature: Encodes the peptide sequence at SEQ ID NO. 72920
  misc_feature (428)..(428): n is a, c, t, g, unknown, or other
  misc_feature (470)..(470): n is a, c, t, g, unknown, or other
  misc_feature (482)..(482): n is a, c, t, g, unknown, or other
  misc_feature (554)..(554): n is a, c, t, g, unknown, or other
  misc_feature (560)..(560): n is a, c, t, g, unknown, or other
  misc_feature (647)..(647): n is a, c, t, g, unknown, or other
ctggagctccccgcggtggcggccgctctagaactagtggatcccccgggctgcaggaattcgtctcacccctagaaaaatgggatcaggagtgtgttcttactggtggacatggactgatggtaaatgggtactatcctgttattgaagctcttgctcaaggtcttgacatcaggcttaaccaaagggtcaccgaaattacccgccagcacaatggagtcaaggtcactactgaagatggcacaagctacttggccgacgcctgcataatctcagtgccactcggcgtgctcaaggcgaacgtaataaagttcgagcctgagctgccccagtggaagagctccgccatcgccgacctcggcgtgggcaccgagaacaagatcgccatgcacttcgacagggtcttttggcccaacgtcgaggtgctngggaatggtcgggccgacgcccaaagcctgtgggtacttccntgaacctgcacnaagccacgggcaatccgggtcctcgtgtacatggccgccggaagggtcgcccaggaagttgagaagctgtcngacaangaaagcgtcgggccctgtcgtttctcacctgaagaagatgctcccggatggcactgaaccgacgcattacctggtgtcccgatgggn

SEQ ID NO: 72920 - protein, 156 aa, Zea mays
  misc_feature: Ceres CLONE 1557017
  misc_feature: SWISSPROT Homolog: EC 1.5.3.11 Polyamine oxidase
GAPRGGGRSRTSGSPGLQEFVSPLEKWDQECVLTGGHGLMVNGYYPVIEALAQGLDIRLNQRVTEITRQHNGVKVTTEDGTSYLADACIISVPLGVLKANVIKFEPELPQWKSSAIADLGVGTENKIAMHFDRVFWPNVEVLGNGRADAQSLWVLP

SEQ ID NO: 72921 - DNA, 686 bp, Zea mays
  misc_feature: Ceres CLONE 1557018
  misc_feature: Encodes the peptide sequence at SEQ ID NO. 72922
  misc_feature (562)..(562): n is a, c, t, g, unknown, or other
  misc_feature (593)..(593): n is a, c, t, g, unknown, or other
  misc_feature (647)..(647): n is a, c, t, g, unknown, or other
aaagctggagctccccgcggtggcggccgctctagaactagtggatcccccgggctgcaggaattcgtctcacccctagaaaaagttcttccagcgaagcaagcagcctaaaaaaaccgtatcgtctcgcctgttcagtttccttctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtgaagggcgtcgttagccccgtctacgaccgcttcggcggcctgcctctcgacgtcctcgccttcgtcgaccgcaaggtggacgacacggtgcacgaggtggacaagcacctccccgggcgncgctgaaggcggcgtcggcgcatgtctacgncggtggttcgggggcgtgccggaggtggcgcgcgagctggcggccgaagcgcanccggtcggccgtgaggggcgcagcccgtgcggcgctcgc

SEQ ID NO: 72922 - protein, 114 aa, Zea mays
  misc_feature: Ceres CLONE 1557018
  misc_feature (19)..(115): Pfam Name: REF Pfam Description: Rubber elongation factor protein (REF)
MAEEQSNPQHQQAEEREVMVEQQQPRRAPKLRYLDFVQVAAAQAAVCLAGLYGLAKDHAGPLRPSVDAVESAVKGVVSPVYDRFGGLPLDVLAFVDRKVDDTVHEVDKHLPGRR

SEQ ID NO: 72923 - DNA, 626 bp, Zea mays
  misc_feature: Ceres CLONE 1557020
  misc_feature: Encodes the peptide sequence at SEQ ID NO. 72924
  misc_feature (319)..(319): n is a, c, t, g, unknown, or other
  misc_feature (466)..(466): n is a, c, t, g, unknown, or other
ctggagctccccgcggtggcggccgctctagaactagtggatcccccgggctgcaggaattcgtctcacccctagaaaaaagagaaccagattccgttcccctgaacccgatcgagatggagtcggaagctgacagagccgcggcaccggcgccggcgccggcagttgccgcggagaccagcgacgacgccatccaggaggagtctccagccacggccccttcctcagacggaaagcccggatcaggggcggcggcggccccggcgccgggaggtggaggtgcagctgttccggcgcgggcgtccggtggcagtgtccnggtcgcagctgggcgggtatacgcaggaccagctgggagttgggcgacgtccctggagcagcacgggcctcaagtccgtcttcgcctttcgacccttgcgcccgcaaacgggggcgtcggcattcggctgaacccctgggaaggggncggtccctcctcccctaaggcccctggtttccacgatctttcctagacggcgaggcccaaggattcttttgctgaagcccaatcccaaaaatgggaattgggggtccccccctttaacggggggtacctgcccccccttttgaaaggagggcaaaatgcc

SEQ ID NO: 72924 - protein, 131 aa, Zea mays
  misc_feature: Ceres CLONE 1557020
  misc_feature (68)..(68): Xaa is any aa, unknown, or other
  misc_feature (117)..(117): Xaa is any aa, unknown, or other
MESEADRAAAPAPAPAVAAETSDDAIQEESPATAPSSDGKPGSGAAAAPAPGGGGAAVPARASGGSVXVAAGRVYAGPAGSWATSLEQHGPQVRLRLSTLAPANGGVGIRLNPWEGXGPSSPKAPGFHDLS

SEQ ID NO: 72925 - DNA, 651 bp, Zea mays
  misc_feature: Ceres CLONE 1557021
  misc_feature: Encodes the peptide sequence at SEQ ID NO. 72926
ctccccgcggtggcggccgctctagaactagtggatcccccgggctgcaggaattcgtctcacccctagaaaaagctcgctccctccctccctccctcccgcgcggatcacagaagggctcacggtcacggccggcctcccaattcgcaacctcgcctccgcctctcctcctaccccctccgaaaagcaagctccggccgggccgccaccaccaccaccgcgcgcgcgtgcacgcgctcccacacacagacagacagacagacagacagagtgagagacgcacggtggttcggggtctcccttctgccaggcgcacgaggagccatggcgcagcgcgacaagaaggaggagcccacggagctccgggcgccggagatcacgctgtgcgccaacaactgcgggttcccgggtaacccggccacgcagaacctgtgccagagctgcttctcggcgtcgaggtcgccgtcgtcccctacctcctcctcctcttccctggcgtccgcggcgtcgcagccgaggccagcagcgctcgtcgtagacgcggcagcggtggaggcgctggccgctccggcggccgcggccgcgggccagggccaggctacggaagccgcggcgaaggcgtccgcgagccggtgctccagctgccggaag

SEQ ID NO: 72926 - protein, 109 aa, Zea mays
  misc_feature: Ceres CLONE 1557021
MAQRDKKEEPTELRAPEITLCANNCGFPGNPATQNLCQSCFSASRSPSSPTSSSSSLASAASQPRPAALVVDAAAVEALAAPAAAAAGQGQATEAAAKASASRCSSCRK

SEQ ID NO: 72927 - DNA, 676 bp, Zea mays
  misc_feature: Ceres CLONE 1557022
  misc_feature: Encodes the peptide sequence at SEQ ID NO. 72928
  misc_feature (355)..(355): n is a, c, t, g, unknown, or other
gcggtggcggccgctctagaactagtggatcccccgggctgcaggaattcgtctcacccctagaaaaagcaacagatacacacacactcgggtaaagctatctcgagctagctagctgctgtaagccgttgccatggccaaaatggtgttgctctgcgtgctcgtctccttcctcctgatgcccttggcctccctagccctgacgcaggacttctgcgtcgccgacctgacctgcagcgacacgccggcggggtacccgtgcaagtccagcgtcaccgcaacgacttctacttccacggcctggccggccagggcaaaataacccactcatcaaggcgccgtcaccccggccttncgtggggcagttccccgggcgtcaacgggcttggcaatctctgcggccaggctcgaaatccaggtggggcggctcgtggcccttcccaccaacccgggggctcaaaacctcctcttcggaccaagggaccgttcccccccggtttattaagttcgggtccaaaaccgtttaaccaaaaactgtttccccgggaaatttgtggggtccccaaggggctggtccctaccaattaaaaccccggccccgggcttcccggtgggcctcttcccctttaaaaacccaaaacccgggcgggaaaaaccccaattttggccctttttc

SEQ ID NO: 72928 - protein, 62 aa, Zea mays
  misc_feature: Ceres CLONE 1557022
MAKMVLLCVLVSFLLMPLASLALTQDFCVADLTCSDTPAGYPCKSSVTATTSTSTAWPARAK

SEQ ID NO: 72929 - DNA, 657 bp, Zea mays
  misc_feature: Ceres CLONE 1557029
  misc_feature: Translation starting site: 155
  misc_feature: SWISSPROT Homolog: EC 3.1.27.1 Ribonuclease T(2)
  misc_feature (657)..(657): n is a, c, t, g, unknown, or other
tggagctccccgcggtggcggccgctctagaactagtggatcccccgggctgcaggaattcgtctcacccctagaaaaaaaaatgagggcgctcgctcgcctgcctataagtactacccacgcgtatgctaggcattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgcccccagcaacaacgggcagagcagctggaagaacgcctggaagaaggcccgcgcctgctccggcctcagcgagaaagactacttcgagactgccctctccttccgtagccggatcaacccactcgttcgcctcaaagccaaaggtatcgagccggacttcgggctctaccgcctcaaggcan

SEQ ID NO: 72930 - DNA, 673 bp, Zea mays
  misc_feature: Ceres CLONE 1557031
  misc_feature: Encodes the peptide sequence at SEQ ID NO. 72931
  misc_feature (42)..(42): n is a, c, t, g, unknown, or other
  misc_feature (369)..(369): n is a, c, t, g, unknown, or other
  misc_feature (397)..(397): n is a, c, t, g, unknown, or other
  misc_feature (401)..(401): n is a, c, t, g, unknown, or other
  misc_feature (402)..(402): n is a, c, t, g, unknown, or other
ctccccgcggtggcggccgctctagaactagtggatcccccngggctgcaggaattcgtctcacccctagaaaaaagccggcgtcgcgtttccaacaggccagtcccctcccactcccagtcccatctcgacgacatggccgcagccgcagggccatcaagctctgtgaaggagacgctcccgccggccctcggctccacctcccagccacctcccgtcttcgatggcaccaccaggctgtacatctgctacttctgcccgttcgctcagcgcgcctgggtcacccagaactgaaggggttgcagggacagatggagctggtggcatcgatctgcaggacaaccggcttggtacaaggacaaggtttanccacaggcacggtgcctccctggagcanaacnncaaggtcaggggcaaaaactggacctgatcgggtactcgacgcaaccttgacggcccggcccgctcccaaaggagccgcaaaaaagcatttttctaacaatttgtcccgtttgccaacccgttcaccaaacccctttactcccgtttgtttcccaacggggcgtttaaaaaaaatttttgtggggcccgggaaaaacccaaagggaaaccttccaggtttggaaagggggccctttttccaaaggcaaatttcacttgggggagaatacca

SEQ ID NO: 72931 - protein, 52 aa, Zea mays
  misc_feature: Ceres CLONE 1557031
MAAAAGPSSSVKETLPPALGSTSQPPPVFDGTTRLYICYFCPFAQRAWVTQN

SEQ ID NO: 72932 - DNA, 615 bp, Zea mays
  misc_feature: Ceres CLONE 1557038
  misc_feature: Encodes the peptide sequence at SEQ ID NO. 72933
acccgcggtggcggccgctctagaactagtggatcccccgggctgcaggaattcgtctcacccctagaaaaacattttatattaggacgatgtcgctgcatgctttgagtactatgctgatctggcagaagctttagatgggaagcaacagtcaccgatctctctgcctatggaaaactttaagtcgtatgtacttaaagaacccattggggttgttggactgatcactccttggaattatcctctgttgatggcaacttggaaggtcgcacctgccttggctgctgggtgtacaactatattaaaaccttcagagttggcttctgtgagctgcttagagcttggtgcaatatgtatggaaataggcctaccaccaggtgtcttgaacataattactggtctgggccctgaagctggtgctccattatcctcacattcccatgtggataaggttgcttttactggaagtacagagactggtaagaggataatgatttcagctgcccaaatggttaagcctgtttcattagagcttggtgggaaaagtcctcttattgtctttgatgacattggtgacattgacaaagctgttgaatggactatgtttgggatctt

SEQ ID NO: 72933 - protein, 148 aa, Zea mays
  misc_feature: Ceres CLONE 1557038
  misc_feature (1)..(148): Pfam Name: Aldedh Pfam Description: Aldehyde dehydrogenase family
  misc_feature: SWISSPROT Homolog: EC 1.2.1.8 Betaine-aldehyde dehydrogenase
MENFKSYVLKEPIGVVGLITPWNYPLLMATWKVAPALAAGCTTILKPSELASVSCLELGAICMEIGLPPGVLNIITGLGPEAGAPLSSHSHVDKVAFTGSTETGKRIMISAAQMVKPVSLELGGKSPLIVFDDIGDIDKAVEWTMFGI

SEQ ID NO: 72934 - DNA, 1339 bp, Zea mays
  misc_feature: Ceres CLONE 1557039
  misc_feature: Encodes the peptide sequence at SEQ ID NO. 72935
agtccaaaactgtctctcccacgtccttccgggtcctatcgctcctctccgtcgccggtggagctcatggcatcctccatggccgccgccgccaccgccaccgccctcccgctgccgtccgggacgacgcagaggccgtctgcccagggccgcctcctcttcaccgccgcgcccgcccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgccggagatttgttgcgggcagagatcgctgctggctctgagaacgggaagcgggccaaggaattcatggagaagggtcagctcgtgcctgatgagattgtcgttaatatggtgaaggaacgccttcggcaaccagacgctcaagaaaatggttggcttttggacgggtacccaagaagctattcacaggccatggccttggaaactcttgaaatccggcctgatactttcattctgttagatgttccagatgaactccttgttgaaagggtggttggaaggcggcttgatcctgtaacagggaaaatatatcatttgaagtattctccgccagagaatgaagaaatcgcttcaaggcttacacaaagatttgacgatacagaagaaaaggttaagttgaggctggagacttattaccaaaatatcgagtccttgctatcaacatatgagaacattattgtcaaagtgcaaggagatgccacagtggatgctgtctttgctaagatcgacgagctgctgggttctatcctggagaagaaaaatgaaatggtttccagcacatgagcaaggggaatatatctgaagcacaggacgacacgtacaagtaatgtaagccagtctcacgtaatggaaatttctccatgtggatgtggtcaaagcataggaatttttttcctccaattattaactgtacgcgaatggaagcgacagatcattcgtaggttgtgagggcttcagagatcatctgctgctgtacatgttttgttgctgtcttgtgaacatacatgtcttgttgtttctcaactggaggaatgctgttaacctgctgtatcatttccttgaatggcttatgtgagagggaggaggacctgagcagcagctcttgcaatctttgtctaaattccttcggatggtgaagcccatttcgtctgttctccgaaaagtatattgattgcattttctgaaaaaaaaaaaaaaaaaa

SEQ ID NO: 72935 - protein, 284 aa, Zea mays
  misc_feature: Ceres CLONE 1557039
  misc_feature (72)..(251): Pfam Name: ADK Pfam Description: Adenylate kinase
  misc_feature: SWISSPROT Homolog: EC 2.7.4.3 Adenylate kinase
MASSMAAAATATALPLPSGTTQRPSAQGRLLFTAAPARSLRLRPAGRRSARSSPRATKAVVAALADPLKVMISGAPASGKGTQCELIKTKYQLAHISAGDLLRAEIAAGSENGKRAKEFMEKGQLVPDEIVVNMVKERLRQPDAQENGWLLDGYPRSYSQAMALETLEIRPDTFILLDVPDELLVERVVGRRLDPVTGKIYHLKYSPPENEEIASRLTQRFDDTEEKVKLRLETYYQNIESLLSTYENIIVKVQGDATVDAVFAKIDELLGSILEKKNEMVSST

SEQ ID NO: 72936 - DNA, 1049 bp, Zea mays
  misc_feature: Ceres CLONE 1557044
  misc_feature: Encodes the peptide sequence at SEQ ID NO. 72937
aacgcagccaagaacaagagacaccgccgagcgagcgaggcggggagaagcaggtccaggaccaggagaaaggaaaggaagcccagctctctctagcctggagccgagaagccgagggggcgaaggagcagcaaggcatggaggagcccgttccggctgatccccccaggattttctggaagtcaaggagatcaggttcagccaatggccggagcctgcaacaagagcctgacaaagacgctaccgaggaaactaacgaacccatgaagaccgacgacgcaacggatacagcagcagcagcagcagcagcagctgagccgtacccgaaagctaacctatccgagaagcggaaggctctcttcgagcctctcgagccgatcaacggcaagcgcggcgctgctgagacgctgctcccaccgccggactttgagcccgcgtcgtaccccaaggggtggctggtgggcaagaaacgcaagctcgtcaacgtagacgtcgtggagagcatgcggaggattgcgatccaggaaatgaacagaaaggaccgtgagatcaatgggctgaacgagcagctagaggaagactcccgcgtgctggagcttctgcagaagcagctggctgacgagcgcaggaagcggacagagatcgagaaggagaactccatgctccatgagcaggtcaccatgctgatgaacatgctcgacgagaacgagggtttcgacgaggacggagaggccccgccacccgattccttcgattaaacgttgttacagtactatccttttttttccgtcagtgtgaaatcatacgtctctaggtgctggtttcagagtatccgagagatatgggctagctgtgtagtaggatttcattggtggtcgtattccattacatggctttggcttctgtagataaagggtgcattgcatgtctgttgtactgtactgtacctactccttttctaggcttcaaaagtgtatgtgagaaactagcaacatggttatgtttgaatcgaagtgtatgtacatgttacttaaaaaaaaaaaaaaaaa

SEQ ID NO: 72937 - protein, 206 aa, Zea mays
  misc_feature: Ceres CLONE 1557044
MEEPVPADPPRIFWKSRRSGSANGRSLQQEPDKDATEETNEPMKTDDATDTAAAAAAAAEPYPKANLSEKRKALFEPLEPINGKRGAAETLLPPPDFEPASYPKGWLVGKKRKLVNVDVVESMRRIAIQEMNRKDREINGLNEQLEEDSRVLELLQKQLADERRKRTEIEKENSMLHEQVTMLMNMLDENEGFDEDGEAPPPDSFD

SEQ ID NO: 72938 - DNA, 683 bp, Zea mays
  misc_feature: Ceres CLONE 1557045
  misc_feature: Encodes the peptide sequence at SEQ ID NO. 72939
  misc_feature (623)..(623): n is a, c, t, g, unknown, or other
  misc_feature (683)..(683): n is a, c, t, g, unknown, or other
ctggagctccccgcggtggcggccgctctagaactagtggatcccccgggctgcaggaattcgtctcacccctagaaaaaagaagcgagcgagcgagcagcagtaggcagcggcgcgggcgaggagcagaccagcacccagcagccctcgtcggggggcggcagctgcagcttcaccagccgccgcctttccccgtctcctctgcctctgcctctccccctaacccccttccatttctccaccccaccccgctcccgcttccgcttcctcgccacttagttcgttccgcacccgcagccgcggctgcgttcgcattgagggcacgcaatggagcagtacgagaaggtggagaagatcggggagggcacgtacggggtggtgtacaaggcgctggacaaggccaccaacgagacgatcgcgctcatgaagatccgcctcgagcaggaggacgagggcgtcccgtccaccgccatccgcgagatctctctcctcaaggagatgaaccacggcaacatcgtcagattacatgatgttgtccacagcgagaagcgcatataccttgtcttcgagtacttggatctggacctaagaagttcatggactcctgcccggagtttgctaanaatcccacttttatccagtcatacttctaccagatacttcccggtggtttctttattccn

SEQ ID NO: 72939 - protein, 118 aa, Zea mays
  misc_feature: Ceres CLONE 1557045
  misc_feature: SWISSPROT Homolog: EC 2.7.11.22 Cyclin-dependent kinase
  misc_feature (99)..(99): Xaa is any aa, unknown, or other
MEQYEKVEKIGEGTYGVVYKALDKATNETIALMKIRLEQEDEGVPSTAIREISLLKEMNHGNIVRLHDVVHSEKRIYLVFEYLDLDLRSSWTPARSLLXIPLLSSHTSTRYFPVVSLF

SEQ ID NO: 72940 - DNA, 956 bp, Zea mays
  misc_feature: Ceres CLONE 1557049
  misc_feature: Encodes the peptide sequence at SEQ ID NO. 72941
aagggttggggaatctccttccttttccttcctcctccactgcctcgctcgctcgctcgctagatagatagatagatataacaggccatgccggccggctagcctcccatcagagaccagagcttcttcttcttggccttctctgcttcgctgttcttgttcttgagatcgcgctttctgatccacgtacggccggggagtgccgtgccggagatcctgaaaagagacacacaccacaccaccacggttgcgcgcgaggagtccgagacatggacagggagcagatgaggatggccatcctgaaccaagaacggatcttcagacaacaggtacacgagctgcaccggctgtaccacgcccagaagcagctgatgacgcagcagttgcagacggttcctgctccggcggtcgtcgacgccgagcccagaccgagaccgcagctggatatctggtgcggcgagagggcgacagcaagtcctcagcagcacatcatcagcttccacgaggccgcagcacctgcgctggccaaggaatgcaaccttgagctgacactggcgaccggccgggcaagcagcagcagcagcagcgacgcggaaaggcgacagggaataataaagcggctcaaggcggcgccgtccaactcggactccggcgcgaccgcggtgtcgtccacgtcgaccgactccgagctggcgccgttccgggaggtggtggaggacgtggcgacgccggtgaggtttcgcggcgaggttagcgggaggaggaggatggacgaggtggggcagggtccgtggttgtaccagcctcagcctgagtacggcgtgatgacgatgctgtactctacgtcgtaggatctggggatttggggttagagttgggagggagacagcactgtttgtgttttaaaaaaaaaaaaaaaaaaaaaaaaaaaaaaaaaacaaaaaaaaaaaaaaaaa

SEQ ID NO: 72941 - protein, 193 aa, Zea mays
  misc_feature: Ceres CLONE 1557049
MDREQMRMAILNQERIFRQQVHELHRLYHAQKQLMTQQLQTVPAPAVVDAEPRPRPQLDIWCGERATASPQQHIISFHEAAAPALAKECNLELTLATGRASSSSSSDAERRQGIIKRLKAAPSNSDSGATAVSSTSTDSELAPFREVVEDVATPVRFRGEVSGRRRMDEVGQGPWLYQPQPEYGVMTMLYSTS

SEQ ID NO: 72942 - DNA, 536 bp, Zea mays
  misc_feature: Ceres CLONE 1557056
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (84)..(84): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (125)..(125): n is a, c, t, g, unknown, or other
  misc_feature (129)..(129): n is a, c, t, g, unknown, or other
  misc_feature (161)..(161): n is a, c, t, g, unknown, or other
  misc_feature (303)..(303): n is a, c, t, g, unknown, or other
nnnnnnnnnnnnnnnnnnnnnnnnnnnnnnnnnnnnnnnnnnnnnnnnnnnnngggggggnnnnnnnnngggggnnnnnnnngnggnnnnnnnnnnnnnnnnnnnttcaaaactggaactccccncggntggcggccgctctagaactagtggaatccccncgggctgcaggaattcgtctcacccctagaaaaaagggcgacggggcggacgacgtcgagcagcacttcgggctgttctacccgaaccggacgaaggtgtcgagttcgacttccggggcggcgcgctggtggccagctggtngcgtggcgaaacgcgtccgcccgggggaacgcgccggctgccaggcgggcgcttgggaagtacgcgttgcgggccacccggcggcccgacttgccggcgcccatccaagccccgggcgccgccccgttggctttccgaagccccgaacacccaagggttcggcggcaaggcccctcgttacgccgttttcaacaagcttacttaccaaagcgcaaaaccggcccgggcccaaa

SEQ ID NO: 72943 - DNA, 516 bp, Zea mays
  misc_feature: Ceres CLONE 1557058
  misc_feature: Encodes the peptide sequence at SEQ ID NO. 72944
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (159)..(159): n is a, c, t, g, unknown, or other
  misc_feature (170)..(170): n is a, c, t, g, unknown, or other
  misc_feature (176)..(176): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggggnnnnnnnnnnnnnnnnnnnnnnnnnnnnnnnnnnntccaaagctggggactccaccgcggntggcgggccgnctctanaactagtggaatcccccgggctgcaggattcgtctcacccctagaaaataagatgtctcagttgctgcacctgccggacctcgcggcgccgcggaccaggatgggctcggcgctgccggcgggggcccgcgtcaagcagggggagccggggacggcaaggggggaagccgggtgcctcagggttcgccgaaccctttccggcgggaatttcccgggtgcccggtcccccttttgccgcgcccgcggttcctttggaaagggggggaaaggcccccccgggaaaccaaagaacccaacaacccaacggggggtttccaaaaaaaaagataataggccccaa

SEQ ID NO: 72944 - protein, 96 aa, Zea mays
  misc_feature: Ceres CLONE 1557058
MSQLLHLPDLAAPRTRMGSALPAGARVKQGEPGTARGEAGCLRVRRTLSGGNFPGARSPFCRARGSFGKGGKGPPGKPKNPTTQRGVSKKKDNRPQ

SEQ ID NO: 72945 - DNA, 676 bp, Zea mays
  misc_feature: Ceres CLONE 1557072
  misc_feature: Encodes the peptide sequence at SEQ ID NO. 72946
caccgcggtggcggccgctctagaactagtggatcccccgggctgcaggaattcgtctcacccctagaaaaaccaccacaccacaccacaccggccggctcacacgcgccgcaaagcagagcacggggggctgagaccagagcagagcggagcgccaccagccaatcctttgcctgcccaagcagcagcagcagctggcccgatggctctgtctctctccggtacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgccgccgagggctcgtgggtgcccgacctcgtcacgggccactacccgcccgccaactgggccccgcgcgtcgaccccgccgacctccgcgccgcgcacctcgcccgcacctaacgccggggcctgagcggccccggctcccttcaccctgctccgccttcgtctcgtatgacatacgcgcaacgtaaccagggtgaaaccaaggtgggggctggggggttcctgtgtggcaacgggcttgttgaaccccccggggggtgggggccgccttttggaaaccccggaaattttcttgggaaagggcgggccggg

SEQ ID NO: 72946 - protein, 91 aa, Zea mays
  misc_feature: Ceres CLONE 1557072
  misc_feature (1)..(89): Pfam Name: LEA_3 Pfam Description: Late embryogenesis abundant protein
MALSLSGTSARFALASLVPRARAYAASAASGAMRRAAEGAAAGEAKEAGRAAAAAAEGSWVPDLVTGHYPPANWAPRVDPADLRAAHLART

SEQ ID NO: 72947 - DNA, 678 bp, Zea mays
  misc_feature: Ceres CLONE 1557073
  misc_feature: Translation starting site: 128
  misc_feature: SWISSPROT Homolog: EC 2.7.1.20 Adenosine kinase
  misc_feature (292)..(292): n is a, c, t, g, unknown, or other
ggcggccgctctagactagtggatcccccgggctgcaggaattcgtctcacccctagaaaaaacaaagcctcagatctcagtcacctgcgccgccgcttcgttcgtgtggaggggagaagacaggaaatggcggcgactgagggcgtgctcttggggatgggcaaccccctcctcgacatctccgccgtcgtcgatgacgccttcctgacaaagtatgacatcaagctgaacaatgccattctcgctgaggagaagcacttgcctatgtatgacgagttggctagcaagagncatgttgaatatattgccggaggagccacccagaactctatcagggttgcccaatggatgcttcaaacctcctggtggaacaggttacatgggatgcatttggaaaggaccagtttggggaaggaatgaaaaaaaaaccccaagctgccagagttactgctccataccacgaggatgaaactgctcctactggcacaaggcctgaaaggggtgttgggggggaaagggcctttttttgcaaatctgtcgcgggcaaacggttaccaattctgacccctaaagaaacccgaaaaccgggcccctggtgaaaagggcaaaaccctcccccttgggggggtttttccccttagggggcccccggattttttccccccaagccccgaaaa

SEQ ID NO: 72948 - DNA, 676 bp, Zea mays
  misc_feature: Ceres CLONE 1557075
  misc_feature (335)..(335): n is a, c, t, g, unknown, or other
ctccccgcggtggcggccgctctagaactagtggatcccccgggctgcaggaattcgtctcacccctagaaaaaatgcaagacagaggcttctagtttcttcacccgtgctctctccctcatcccctgcgcataggaagccagctccttcacgtcgcctcctccctaggcggcgatcctacagagcctcgccggtcatccctgctccctcggcgtctctcccatggcgccctccctgctccttcacatggtgtggacgccagccccctctcttgttgccatggatagcccctctcccatctccttccccaagcacaagtcccatggtcgcccaancctagctcgccctgcccccagcatggacgctgtcgagccgcccggttcctatctccctcgaccttcagcttctgggctgccccccctccctggatttcgccatctctactcgtcaatcttctctgttggggccccccctggttggcttccacctccatgggacaacgccgagttccttccttgccccaactttcccaggggccgccctcccctttcccggattaaacagggccaaccgccaaagggccaattcttgtggcccggaattttaatgaaaaaaaagctttttcggggggcctttccacagggtgtggaaaatgcccaaacccggattgggtggg

SEQ ID NO: 72949 - DNA, 659 bp, Zea mays
  misc_feature: Ceres CLONE 1557077
  misc_feature: Encodes the peptide sequence at SEQ ID NO. 72950
  misc_feature (599)..(599): n is a, c, t, g, unknown, or other
tggagctcaccgcggtggcggccgctctagaactagtggatcccccgggctgcaggaattcgtctcacccctagaaaaagtcagaagtcagaacagctcgttcgtccgtcaccaactcgccatagatgatagaacgctatcccatcttcacacacaaaaatatccgcgcgaccccgacctcccccctcccactccgggcagcagccagcagccagcaggcatggggatacccgtggtggttcccgtcgcggcggcctactcgtgctcctcctccctcgccgcgccaccgagggccgccgccgccgcggcgagggcgccgagccgcgcgcacgtcgcggcggccgggatgtcctccagggcgtcctccttcgtcgggggcagcggaggcgacctctcggcggtggccgcgtcggtagccgcgcggcccaggagggcgggctccgggggaagcggcgcgctcgggtgcaagtgcctcttcgggctcggcgtgccggagctcgccgtcatcgccggcgtcgccgccctcgtgttccggcccaagcagctccccgagatcggccgcagcatcgggcaagaacgtcaaaagcttccagcaagcnggctaaggggtttgaaactgacctgaaaaaaaaacctggggaaaaggggccaatcagccc

SEQ ID NO: 72950 - protein, 134 aa, Zea mays
  misc_feature: Ceres CLONE 1557077
  misc_feature (88)..(134): Pfam Name: MttA_Hcf106 Pfam Description: mttA/Hcf106 family
  misc_feature (127)..(127): Xaa is any aa, unknown, or other
MGIPVVVPVAAAYSCSSSLAAPPRAAAAAARAPSRAHVAAAGMSSRASSFVGGSGGDLSAVAASVAARPRRAGSGGSGALGCKCLFGLGVPELAVIAGVAALVFRPKQLPEIGRSIGQERQKLPASXLRGLKLT

SEQ ID NO: 72951 - DNA, 742 bp, Zea mays
  misc_feature: Ceres CLONE 1557078
  misc_feature: Encodes the peptide sequence at SEQ ID NO. 72952
  misc_feature (285)..(285): n is a, c, t, g, unknown, or other
ggcggccgctctagactagtgggatccccgggctgcaggaattcgtctcacccctagaaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccancccctgcccacctcgacgggtccctctcccggggactccggcttcgatccgttgggtctccccccccccgccggggggggggggggggggttcaaggggttcaaaatttttcccccctgcccccgggggggcatggtttggccctctccccggggtgctgggggggggggaaaaccctggggccctggggaaacctgggggtaaggcgcccgcagatgggggccccccctcgccccgggggggggggggtcacgtttcctggtgggcccccccgggggccttgggggtctcgtttgccggcaccttccctggggggggcgatctcggtgtgcgacccccttttcggcgggggacatccctggacccccgggagaagggaggtcgcgaaagagaaagtgggggtccggggtgggggtgttttcgctcccgcctgggtcttgcgggtgtgcaccctcgg

SEQ ID NO: 72952 - protein, 206 aa, Zea mays
  misc_feature: Ceres CLONE 1557078
  misc_feature (55)..(55): Xaa is any aa, unknown, or other
MVMASSSGLRSCSAVGVPSLLAPSSRSGRLAPFCANATTSGRVTMSAEWMPGQPXPAHLDGSLSRGLRLRSVGSPPPRRGGGGGVQGVQNFSPLPPGGHGLALSPGCWGGGKTLGPWGNLGVRRPQMGAPPRPGGGGVTFPGGPPRGPWGSRLPAPSLGGAISVCDPLFGGGHPWTPGRREVAKEKVGVRGGGVFAPAWVLRVCTL

SEQ ID NO: 72953 - DNA, 712 bp, Zea mays
  misc_feature: Ceres CLONE 1557082
  misc_feature: Encodes the peptide sequence at SEQ ID NO. 72954
  misc_feature (42)..(42): n is a, c, t, g, unknown, or other
ctccccgcggtggcggccgctctagaactagtggatcccccngggctgcaggaattcgtctcacccctagaaaaaacaccacccaaactaaacaacaccagcttctctaaagatcacaatgatgagagccctggcggtggtggccatgctggccaccgccttcttcgctgtgcccgctcgcgccgagcagtgcgggtcgcaggccggcggcgcgctgtgccccaactgcctgtgctgcagccagttcgggtggtgcggcagcacctccgactactgcggcagcgggtgccagagccagtgcagcggcagctgcggcagcaccccgaacccgccgagcagcggcgggtgggcgtccatcatcccccgagtcggttcttcaaccagatgctgctgcaccgcaaccgaacgccgcgttgccccggcaacgggtttttaaccctaaccggggctttattggggggggcaaaccggtttcccgggctttgggaccccggggggccccccaaacttcaaaaaccccgagcttggggggtttctggggccaaaaattcccacaaaaaaaaaagggggggtgggggaaaagggcccccaaggggcccctaccccgggggggtatactgccttcaagaaagaaaaaggggggggcccctttgggggcccggaatatttgagaacccccccgcccccttgggccggttgccccccggggaaa

SEQ ID NO: 72954 - protein, 105 aa, Zea mays
  misc_feature: Ceres CLONE 1557082
  misc_feature (22)..(61): Pfam Name: Chitin_bind_1 Pfam Description: Chitin recognition protein
  misc_feature: SWISSPROT Homolog: EC 3.2.1.14 Chitinase
MMRALAVVAMLATAFFAVPARAEQCGSQAGGALCPNCLCCSQFGWCGSTSDYCGSGCQSQCSGSCGSTPNPPSSGGWASIIPRVGSSTRCCCTATERRVAPATGF

SEQ ID NO: 72955 - DNA, 701 bp, Zea mays
  misc_feature: Ceres CLONE 1557091
  misc_feature: Encodes the peptide sequence at SEQ ID NO. 72956
  misc_feature (359)..(359): n is a, c, t, g, unknown, or other
  misc_feature (425)..(425): n is a, c, t, g, unknown, or other
agctccccgcggtggcggccgctctagaactagtggatcccccgggctgcaggaattcgtctcacccctagaaaaaagtcaaattgtagttttctggcacggtcgcacggagggagtatcagtctaccacgctaaacaggaagccggagaaagcgtgtacagtaccggaatccagcaccatggcgggatcagcgttgctcaacgctctcgtcctccgcgcgccatccccgtcgctctcgtcctcgtctaaggtccgcagcgccggcgcctttgtgttctcgaacccaccgcgcttcccatccctgcgttctgagcgccgcgtcgcccttccgcgggcggcggcgggcggtgaccccgangacgagtgggtgccggagcctgagggtgggtccgctgtcactgggaccgcggtggctgaagccccngaaagcggaaaagtcccaaagctcaagggcagctaaggatgccctgtacggcaaggacggggccctgcggccgtcagcaagtcggggccaaggggttggacctattccgcagttggggaacggaaacccagccggggccttacaaagcctgagcctccctaaggggaaggggatcctcggtacacatttttttcccaaattttccacctttggaatttgaaaaacccccccccccctgaaggggggaaaaaatccaaaccttttgttccaaaaatc

SEQ ID NO: 72956 - protein, 93 aa, Zea mays
  misc_feature: Ceres CLONE 1557091
  misc_feature (60)..(60): Xaa is any aa, unknown, or other
MAGSALLNALVLRAPSPSLSSSSKVRSAGAFVFSNPPRFPSLRSERRVALPRAAAGGDPXDEWVPEPEGGSAVTGTAVAEAPESGKVPKLKGS

SEQ ID NO: 72957 - DNA, 653 bp, Zea mays
  misc_feature: Ceres CLONE 1557097
  misc_feature: Encodes the peptide sequence at SEQ ID NO. 72958
aaagctggagctccccgcggtggcggccgctctagaactagtggatcccccgggctgcaggaattcgtctcacccctagataaaggatactgcatccgcaatgtcggctctcgggacgctctccggcggcgctgccggtgtctccggcctcctccgcctccgccgccgggtcgccccagcccccgcgattgcggcgccgtcgcacctccccgctgggaccgtcaagtgcgaggccgccgtgcctgatgcctccccgatcgtctggggccgtcatgtccaccgggcgctgctcctacccgcagcgctgctcccttcgttgcagcccgccgggaggcacactctgtttccgcccgccacggccacctagtccacatgggatgccaagtctgtgagtttactgaaaaagtgcccagtgctggtcaccggcttcatcttcgtcctgtggtacttcctctgcgacttattcgacatcctcaacaagaacatctacaacgactacggatacccatactttgtgtccctgatccatctattattgggtgtcatatgctgcctcatcatctggagtgaccgtctccgcaagcgagcacctataaatggcacgctcctcaagcttctctttccaatcaccctgtgccatggtattggtcacc

SEQ ID NO: 72958 - protein, 88 aa, Zea mays
  misc_feature: Ceres CLONE 1557097
MSALGTLSGGAAGVSGLLRLRRRVAPAPAIAAPSHLPAGTVKCEAAVPDASPIVWGRHVHRALLLPAALLPSLQPAGRHTLFPPATAT

SEQ ID NO: 72959 - DNA, 649 bp, Zea mays
  misc_feature: Ceres CLONE 1557099
  misc_feature: Encodes the peptide sequence at SEQ ID NO. 72960
tggagctcaccgcggtggcggccgctctagaactagtggatcccccgggctgcaggaattcgtctcacccctagaaaaacgatcgcctcgctgtgttgcactgctaggtagccagctcgtttcctcccccaacccaaatgggcgactccaccgccaccaacccctcctcgccgaccgcagccatggatcccgactccgaggtcgtcttcgacttcccgccctacctctgccaatacaagagcggccgcatccaccgtcccggcggcgcccccaccgtcccagctggcacggacccagccaccggcgtcgtgtccaaggacatccgcgacggtcccgcctccgcgcgcgtctacctccctcccggcgccgccggcaagatcccggtggtcgtctacttccacggcggcgggttcgtggtcggctcgccagcgcggccgggcacgcacaactacctcaacgacctggtcgcccgctcgggcgccatcggcgtgtccgtctactaccgcctcgcgccggagcacaagctgcccgcggcgtacgacgacgcgtgggcggcgctgcggtgggcggcgacgctcggcggcggcgaagacccgtggctgctggagcacgccgacctgtcccgcgtgttcctggcgggctgcagcgc

SEQ ID NO: 72960 - protein, 170 aa, Zea mays
  misc_feature: Ceres CLONE 1557099
MGDSTATNPSSPTAAMDPDSEVVFDFPPYLCQYKSGRIHRPGGAPTVPAGTDPATGVVSKDIRDGPASARVYLPPGAAGKIPVVVYFHGGGFVVGSPARPGTHNYLNDLVARSGAIGVSVYYRLAPEHKLPAAYDDAWAALRWAATLGGGEDPWLLEHADLSRVFLAGCS

SEQ ID NO: 72961 - DNA, 446 bp, Zea mays
  misc_feature: Ceres CLONE 1557103
  misc_feature: Encodes the peptide sequence at SEQ ID NO. 72962
  misc_feature (204)..(204): n is a, c, t, g, unknown, or other
aaagctggagctccccgcggtggcggccgctctaaactagtggatccccgggctgcagaatcgtctcacccctagaaaaatctcaagccaccatcgaccttcaagtctcgctacgtagcagtgcaataaaaaaagcagccgcaatggcgagcagcaccatggccctctcctccacggccttcgccggcaaggccgtgaacgtgnccgtcgtcgtccgccttcggcgaggcccgcgtgacgatgcgcaagaacggcggggaaagccaagccggcggcggcgtccgggagcccgtggtacggccccgaccgcgtgctgtacctggggcccactgtccgggcgagccgcccaaactacctgaacgggcgaagtttccccggggcaactaacggggttggggaacacccccgggggggctttttcggggggaaaaccccgggaaaaaaaa

SEQ ID NO: 72962 - protein, 48 aa, Zea mays
  misc_feature: Ceres CLONE 1557103
MRKNGGESQAGGGVREPVVRPRPRAVPGAHCPGEPPKLPERAKFPRGN

SEQ ID NO: 72963 - DNA, 603 bp, Zea mays
  misc_feature: Ceres CLONE 1557113
  misc_feature: Encodes the peptide sequence at SEQ ID NO. 72964
ctggagctccccgcggtggcggccgctctagaactagtggatcccccgggctgcaggaattcgtctcacccctagaaaaactagcccgacaggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttacccaacaggacatcacagcacaaatcatctctgctagtatagcaggtgatatggttcttgcttctgcttactcgcatgagttgcacgatatggtcttgaagttgtctgaccactatgcagctgcctactgcactgcccttctgttggctcgcctgtgctcaaaaaccgtggtttaaataagaatttgaaggccatgttgaaggcccggggtaagattttctctttaaaccaccttaataaaagaggcctttcccggccttctttggaagttgggcctttttaagcctacaacgg

SEQ ID NO: 72964 - protein, 114 aa, Zea mays
  misc_feature: Ceres CLONE 1557113
  misc_feature (27)..(114): Pfam Name: Ribosomal_L18p Pfam Description: Ribosomal L18p/L5e family
MGGFVKTHKSNAYFKRFQVKFKRRRAGKTDYRARIRLINQDKNKYNTPKYRFVVRFTQQDITAQIISASIAGDMVLASAYSHELHDMVLKLSDHYAAAYCTALLLARLCSKTVV

SEQ ID NO: 72965 - DNA, 504 bp, Zea mays
  misc_feature: Ceres CLONE 1557125
  misc_feature: Encodes the peptide sequence at SEQ ID NO. 72966
  misc_feature (53)..(53): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (312)..(312): n is a, c, t, g, unknown, or other
ggagctacgcggtggcggcgctctagaatagtggaccccgggctgaggaatcntnnnnnnnnnnnntnnnnnnnnnaaaactgggactcaccgcggtggcggccgctctagactagtggatccccgggctgcaggtattcgtctcacccctagaaaagtgccagcgcccagcaggccattctgctcgccttactccctcacagaacccagtaaaatatgccagtccccgcgtcaagatggccccacgccgcctggttgtcttcgcgtcctgccccttggggccaccgccccccgggcaattccggtttttgnggaaatcaaaccatttccccccttttccaaaaacggggggccccccgccttaaatcccgggttttttccccccttttgggccccccccaaaaaagttttttttttaaaaatttttcccccctgggggggggggaaaaacccaaaaagagggggggggaagagaacaaaaaaggggggaagaaaatttttccc

SEQ ID NO: 72966 - protein, 42 aa, Zea mays
  misc_feature: Ceres CLONE 1557125
  misc_feature (26)..(26): Xaa is any aa, unknown, or other
MAPRRLVVFASCPLGPPPPGQFRFLXKSNHFPPFPKTGGPPP

SEQ ID NO: 72967 - DNA, 589 bp, Zea mays
  misc_feature: Ceres CLONE 1557129
  misc_feature: Encodes the peptide sequence at SEQ ID NO. 72968
  misc_feature (346)..(346): n is a, c, t, g, unknown, or other
  misc_feature (373)..(373): n is a, c, t, g, unknown, or other
  misc_feature (589)..(589): n is a, c, t, g, unknown, or other
gctcttaactagtggatcccccgggctgcaggaattcgtctcacccctagaaaaaactcgcttgagcatcgtgtgctcttctcttcctcttccagttggtattctttatctgaaagactgaaacatagtacagaggaggagaggagagcgagagctaagaagatgaccggcaaggtcctgcttgtggccgtcctcttggtgggcgtggcctctcgatgctcgggcagtaggggcctgcagggcgatcacgttgctgaacagaagttcggtggcggtggctatggaggtggcggtgggtacggaggctacggtggcggtggaggaggaggtggctgtgggtatggcnggggggggggggggggatccatacctncccttttctgccccccccgtggtggccgggctcgttcttgggtgcgccccccccccggggtcccgtgttttttggcttgtgctatagggaatccgccgaaaccccccccagtgcagttcgtcgggactgtctacctgcaaacctggtggcctggtgacgtggtccttttctgtctctatagtgcaggtttttttcgctgcatattttttttccacn

SEQ ID NO: 72968 - protein, 142 aa, Zea mays
  misc_feature: Ceres CLONE 1557129
  misc_feature (62)..(62): Xaa is any aa, unknown, or other
  misc_feature (71)..(71): Xaa is any aa, unknown, or other
MTGKVLLVAVLLVGVASRCSGSRGLQGDHVAEQKFGGGGYGGGGGYGGYGGGGGGGGCGYGXGGGGGSIPXLFCPPRGGRARSWVRPPPGVPCFLACAIGNPPKPPPVQFVGTVYLQTWWPGDVVLFCLYSAGFFRCIFFFH

SEQ ID NO: 72969 - DNA, 699 bp, Zea mays
  misc_feature: Ceres CLONE 1557130
  misc_feature: Encodes the peptide sequence at SEQ ID NO. 72970
  misc_feature (324)..(324): n is a, c, t, g, unknown, or other
  misc_feature (369)..(369): n is a, c, t, g, unknown, or other
  misc_feature (379)..(379): n is a, c, t, g, unknown, or other
  misc_feature (505)..(505): n is a, c, t, g, unknown, or other
ctccccgcggtggcggccgctctagaactagtggatcccccgggctgcaggaattcgtctcacccctagaaaaaaactcgaagaagccgcgtgcgttatcctttgagcagtttgggcgctgagcaagtccagtgagagagggagagcggcgagaggatggctgggatggcatcgctgcagggcgccatggcgtcgctctccatctccgcgctaggcgcggcgacggcgagcagcagcagcttctggggcaaccggctcgccacctactccgcgccgcagcctggggtaaggtttatggtcaagatatgcccaattgaaatgagnacttagagatgggagcgaaagaagtgtaaaccaaacagtcttccntgtgctgcancagatgcatggttagggatcggggacacgggtacaagttattgcaggccgtgagaaaggaaagggttggagaagtcacacgccttttcaagcaccacaagcccggtgatcgtgaagggacctgaancttgaagtcgaagccccaagaaagggccagacgattgaacccgggggaaatcgtcttgatttgaagggcccatttcaaagcctcaaatggtgagggctcaacccaaaggggaaaaaatggtggttaaacaggggtttggcccacaaattcctgggggggacggggaccagggtccccaaaccctggtcaaaaaa

SEQ ID NO: 72970 - protein, 57 aa, Zea mays
  misc_feature: Ceres CLONE 1557130
  misc_feature (56)..(56): Xaa is any aa, unknown, or other
MAGMASLQGAMASLSISALGAATASSSSFWGNRLATYSAPQPGVRFMVKICPIEMXT

SEQ ID NO: 72971 - DNA, 662 bp, Zea mays
  misc_feature: Ceres CLONE 1557131
  misc_feature: Translation starting site: 150
  misc_feature (398)..(398): n is a, c, t, g, unknown, or other
  misc_feature (423)..(423): n is a, c, t, g, unknown, or other
  misc_feature (434)..(434): n is a, c, t, g, unknown, or other
  misc_feature (435)..(435): n is a, c, t, g, unknown, or other
ctggagctccccgcggtggcggccgctctagaactagtggatcccccgggctgcaggaattcgtctcacccctagaaaaacgccttccgttttgggaaggcgaggagaggggacccccggggagagttgggggatcggcggcggaggagatggaggagcgggagaagctcgtgtgcctggccaagcttgccgagcaggcggagcggtacgacgatatggtggaattcatgaagaatcttgctaggatggacgtggatatgagtgctgaagaaaggcatttgttctcagttggtttcaagaacactattggagcaaagagagcatcatggagaatcatttgttcacatgagcaaaaggtcgcagctgatcgtcagactggtgtgatgatagatgcctantagaagaaagtagaagaggaactangggaggtttgnncatgagtattgtcagtcattgctattcactgccttcccttggccagtacggggtgaaatatcgtattcttttatagatgaaaggtgactactaccgttacttggctgaatttagccctggaactgaaaagaaagctgcctctgatcagtaccttatgccctttcagcatgcctgggttgtcccctcccggggactttcccctggttcccaaatccgggttggtcttg

SEQ ID NO: 72972 - DNA, 688 bp, Zea mays
  misc_feature: Ceres CLONE 1557134
  misc_feature: Encodes the peptide sequence at SEQ ID NO. 72973
  misc_feature (402)..(402): n is a, c, t, g, unknown, or other
ctggagctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctggggacaccgccggggcttgtcgccgacccccagactttcgccnggacccgcgaggctgaaagtgatccactcccgctgggccatggttggggcgtttgggtggttcttccccgagttgctttccccaaaggggttaaagtcggggaagccctcctggttcaaggccggtccccaattttacagcgaggggggggtggaatacttgggaaaccccgccgtgatcccggcaaaaaaaccctccccatttgggccctccaaggtggtcctttgggggccccccaagggttacccatttggccgggggcccctcctcgggaaggtctctaacc

SEQ ID NO: 72973 - protein, 185 aa, Zea mays
  misc_feature: Ceres CLONE 1557134
MAASTMAISSTAMAGTPIKVGSFGEGRITMRKTVGKPKVAASGSPWYGPDRVKYLGPFSGEPPSYLTGEFPGDYGWGHRRGLSPTPRLSPGPARLKVIHSRWAMVGAFGWFFPELLSPKGLKSGKPSWFKAGPQFYSEGGVEYLGNPAVIPAKKPSPFGPSKVVLWGPPKGYPFGRGPLLGKVSN

SEQ ID NO: 72974 - DNA, 708 bp, Zea mays
  misc_feature: Ceres CLONE 1557141
  misc_feature: Translation starting site: 168
  misc_feature (367)..(367): n is a, c, t, g, unknown, or other
  misc_feature (411)..(411): n is a, c, t, g, unknown, or other
  misc_feature (412)..(412): n is a, c, t, g, unknown, or other
tggagctccccgcggtggcggccgctctagaactagtggatcccccgggctgcaggaattcgtctcacccctagaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgnctgcccctcagggagaggaaggggtcgagctcggtggccatcanncagtacgtcgagggggagcatgggcgcaagctccccaccaacttccgcagcagctcactgtgcagctgaagaagctcgctgcccgcggccaactgacaagggtgaaaaaactccttaaagttgcgggccccggaccccaagcccaagggcgccaagcccaagggccccaaaggccggcccccaaacccaaaccccccccaaaggggaagggccaaaccccttgcgaaaccccaagggggggtccccccaacccaagggcaaaggccagggccaaactttttcctctctcccccccc

SEQ ID NO: 72975 - DNA, 666 bp, Zea mays
  misc_feature: Ceres CLONE 1557145
  misc_feature: Encodes the peptide sequence at SEQ ID NO. 72976
ggagctccccgcggtggcggccgctctagaactagtggatcccccgggctgcaggaattcgtctcacccctagaaaaagactctcccctgccctgctgcctgcctttctctcttctcgcgtgtgtgcatttcactgtactgctttcatctcccgctctttcttcaccacctgctccgcgctagtgctggaactggaaccaagaaagcctcatgcggccgcggctggccgaggtgcggtagagcggcggagatgggctgggcacccaggtggttgcgcgggctgctcggcggcggcaggaaggccgccgacacaaggccggtgaaggagaagaagcgctgggggttcggcaagtccttccgggagaagccccccgcgccagtgccggcgcggcctccgtcgcatcccgcggcgacgcctcgccggggctatgcagcggcggatgaggcgggcgacgagcagagcaagcgcgctatcgcggtggccgcggcgacggcggcggtggcagaggccgccgtcgctgccgcccaggcccgcgccgccgtggtgcggctgacaagcagcggccggtgcgcgccgccggccgctgcgaagcgggagcagtgggcggcccgtccggatcaggccgctttccgtggctacctggcgaggcgggcgctaaaggcttt

SEQ ID NO: 72976 - protein, 138 aa, Zea mays
  misc_feature: Ceres CLONE 1557145
MGWAPRWLRGLLGGGRKAADTRPVKEKKRWGFGKSFREKPPAPVPARPPSHPAATPRRGYAAADEAGDEQSKRAIAVAAATAAVAEAAVAAAQARAAVVRLTSSGRCAPPAAAKREQWAARPDQAAFRGYLARRALKA

SEQ ID NO: 72977 - DNA, 711 bp, Zea mays
  misc_feature: Ceres CLONE 1557147
  misc_feature: Encodes the peptide sequence at SEQ ID NO. 72978
aaagctggaggtccgccgaggtggcggcatctctagaactagtggatcccccgggctgcaggaattcgtctcaccccctaaaaaaaatcgccgcctgctctctacctctgcactccaatcagatcatcacatagatcactggccccgtgctgattaccgagcttcccatctgagcagacagcctcccagggtacagggagagactcacaacagacagctgctgcctctctgagacgatggccggaggcggagaccactcccagacgaacggaggccacgtcgaccagagggccttggaggagggcaggaaggaggagttcgctgaccagggctgcgccgccatggtcgtctccgtcccatttatccagaagatcatcgcggagatcttcggcacctacttcctgatgttcgcggggtgcggcgcggtgacgatcaacgcgagcaagaacgggcagatcacgttcccgggcgtggcgatcgtgtgggggctagcggggatggtgatggggtacgccgaggggccaattctccggcgcggactttaacccggggggtggacccctgggcttccgccaccagcggggcggttccccgggggctggcaagcttgcccggcattacattgcctgggcgccaaaatggctgggggacgccaacccccttcggccctcccgggggacccctttgcgggccatcaatggttctccgggg

SEQ ID NO: 72978 - protein, 102 aa, Zea mays
  misc_feature: Ceres CLONE 1557147
MAGGGDHSQTNGGHVDQRALEEGRKEEFADQGCAAMVVSVPFIQKIIAEIFGTYFLMFAGCGAVTINASKNGQITFPGVAIVWGLAGMVMGYAEGPILRRGL

SEQ ID NO: 72979 - DNA, 647 bp, Zea mays
  misc_feature: Ceres CLONE 1557153
  misc_feature: Encodes the peptide sequence at SEQ ID NO. 72980
  misc_feature (509)..(509): n is a, c, t, g, unknown, or other
ctggagctccccgcggtggcggccgctctagaactagtggatcccccgggctgcaggaattcgtctcacccctagaaaaaaacggatccgctctcagactcagagcaagctctctcgtaagaggcatttggcggcaagtaacaagataagaatgagaatggcggcggcgagcaacggcgcccccctggtggtgttcgacttcgacaagaccatcgtcgactgcgacagcgacaactgggtcgtcgacgccctcggcgcgacccgccgcttcgacgagctcctgcgccacctcccatggaaccacgccatcgatgcaatgatgggcgagctgcactcggagggcaagacggccgaggacatcagaggcagcctcagaagggcgccgctgtccccgcacgtcgtcgcggcccatcataaccgcctacgccctcgggtgcgagctgcgcatcctgagcgacgccaacgcctttcttcgtcgacaccatcctcgcgcaccacgggcctcgccngactactttctcggcaccgacaccaacccgggcccacgtcgacgcccgcggccgccctcaggatccgcccccctaccacgagttcgacggccgcgccgggcgcccacgggccacgggatgcgcccctccccgacctgc

SEQ ID NO: 72980 - protein, 163 aa, Zea mays
  misc_feature: Ceres CLONE 1557153
  misc_feature (9)..(161): Pfam Name: Put_Phosphatase Pfam Description: Putative Phosphatase
  misc_feature (118)..(118): Xaa is any aa, unknown, or other
MAAASNGAPLVVFDFDKTIVDCDSDNWVVDALGATRRFDELLRHLPWNHAIDAMMGELHSEGKTAEDIRGSLRRAPLSPHVVAAHHNRLRPRVRAAHPERRQRLSSSTPSSRTTGLAXLLSRHRHQPGPTSTPAAALRIRPPTTSSTAAPGAHGPRDAPLPDL

SEQ ID NO: 72981 - DNA, 697 bp, Zea mays
  misc_feature: Ceres CLONE 1557157
  misc_feature: Encodes the peptide sequence at SEQ ID NO. 72982
  misc_feature (48)..(48): n is a, c, t, g, unknown, or other
  misc_feature (75)..(75): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
tggagctccaccgcggtggcggccgctctagaactagtggatcccccngggctgcaggaattcgtctcacccctnagaaaaaaaaaaaaaaaaaaaaaaaaaaaaaannnaaggatcccgaaccctgcaactgcaagctaaggagagtgtgatcaccaacagctagtgctagtcccccttccttccatccatccatggcatgcgtcagcaccttccagagctgccccattgccagaagagcaaagatcaacaccaggtccaggggcagcagcagtagcgtggcgaaggggtcaccaccaccagccttcccagtccagtgcagggcgtcgactttcgcggcggacaccagcctcggctcgagctggacgaggaccccaaggcgatcatctcgggggcttgcccgggaaatgctccctcctaagtaacaagaacttccggcctacttcaattcccaggaaacggcggcccagcaaaacaacaagggggggtgggccttcctgaacgaaaccatgtccacccccggggtgtgggccaaagaaaaccaaacctgggaggaatccaagtccctttcaaggcccgtttggggttttcgggtctttaaaaagggcccttaaaaggctgggggggtactcaaaaaaacaaccggggaaaaaccccctatgggtccccaaaaaaaaaatttccagaagtttagccc

SEQ ID NO: 72982 - protein, 76 aa, Zea mays
  misc_feature: Ceres CLONE 1557157
MACVSTFQSCPIARRAKINTRSRGSSSSVAKGSPPPAFPVQCRASTFAADTSLGSSWTRTPRRSSRGLAREMLPPK

SEQ ID NO: 72983 - DNA, 709 bp, Zea mays
  misc_feature: Ceres CLONE 1557158
  misc_feature: Encodes the peptide sequence at SEQ ID NO. 72984
  misc_feature (333)..(333): n is a, c, t, g, unknown, or other
ccccgcggtggcggccgctctagaactagtggatcccccgggctgcaggaattcgtctcacccctagaaaaaccagttccttgttcggtcggaacgcagcgcagcggcggcggcgatagggagagaggagagagtctgcaggatccagcaggccgagggaggagtcagcggcgggccggagaatatgagcggcaacggcgcgaagaaggtggtcgaatgcggcggtgaaggccggcaggacgatcatcgactgggacggcatgggccaagttgctcgtcaccgacgaggcgcgcagggagttcgccgccctcccgcgcgctttcgatgacgtncacaccagctccagaccaagttctcccagggaaccccagcccgattgatttgggagtactacggaaaagggatttggatcaaaaaggggttgaatttggacaaaggaggtttttggaagcatccggattcccgaagtacgttcaccccggtttccccccccagtaaagcccaaagtttgaggcctgggatttgcgaaaataaaaggaggcttggaaaaaagcttccaaaagggggtccaaaaggggataaggaagggaccttggctaaatggggggaattggggaaaaaaatttcgttccatggcccgcggaattttccctttggagaggtcccccgaactccgggaaaagttttggaaatgaaaacccggaaaca

SEQ ID NO: 72984 - protein, 104 aa, Zea mays
  misc_feature: Ceres CLONE 1557158
  misc_feature (50)..(50): Xaa is any aa, unknown, or other
MSGNGAKKVVECGGEGRQDDHRLGRHGPSCSSPTRRAGSSPPSRALSMTXTPAPDQVLPGNPSPIDLGVLRKRDLDQKGVEFGQRRFLEASGFPKYVHPGFPPQ

SEQ ID NO: 72985 - DNA, 681 bp, Zea mays
  misc_feature: Ceres CLONE 1557160
  misc_feature: Encodes the peptide sequence at SEQ ID NO. 72986
cgcggtggcggccgctctagaactagtggatcccccgggctgcaggaattcgtctcacccctagaaaaattctccagcaacgagacaacaaatctcctcctcttcctctccgtatccgcatcagtccatcaccttcaatggcggcggcggcggctgctgccacctccttcacaccctcgccgtcgcgcgttcggcggggcaacggtcccttcttgccctcaaggcccgcacttgggcgctcctctcccctcgtgggggccgcatcccctcgcagggcgtctcctttctccgggggcccttgcggggtcgccctttaaaagcgcgcgcgctttgctaattccgcaagagcccaaacccaaggaaagccaatcttccgcctaaaatcccccaaaaaggggggttttttaccataaccattggaaacccctggggggaaaaaatttgggaaaaatttccacccgctttttatggggaaaaagttcccccaaaaggcaaaaaaaaattttggggccttttcaccggaaaaaaaaaggttttgaaaaaaaagggatcccttttcccccccggtgcttccgcccatttttttacccccggggggaaaattttaaaaagggcaaagggcccccgggggaaaaaaaattatttggcccccccttttaaaaaaagaaacatcaaaattgg

SEQ ID NO: 72986 - protein, 59 aa, Zea mays
  misc_feature: Ceres CLONE 1557160
MAAAAAAATSFTPSPSRVRRGNGPFLPSRPALGRSSPLVGAASPRRASPFSGGPCGVAL

SEQ ID NO: 72987 - DNA, 714 bp, Zea mays
  misc_feature: Ceres CLONE 1557180
  misc_feature (290)..(290): n is a, c, t, g, unknown, or other
cgctcttaactagtggatcccccgggctgcaggaattcgtctcacccctagaaaaagtccgctgcttgcttcgtcccgttctggcgttcacacctctggctgccttcatttcctgttgacgactgagcgggcgagcgccggcgccctttgccaggtccgtcggcccgttagccggcgactagcgcctccctttgccaggtcttcgacgtccccttcgccgtcgactggcgcccagcagccagcagcagatccttttctatctgtcgtgttctgtctgcctggtacatttnggaagaatggggggtttaccttagcactccgaaaactgagaaggtatcccgaagattggggaaaatgataaaacttaaatttcggagtttcatcctatgcaagggtgggcctacaaactatgggaagatggccccctccggcttttgctagatctccaaaatggacccggcggttttttgggggtttttgaagggaccatgggggaaaaattattccccaaatttttggggaaaaatttttcccccagaaaaaatttctcagggagtggaaacccttttccccctgggggacccgggggtgctgcttgtcccccagaattttatttttcaaaaggggtgaaaatggggccggggggcaaaaaaaggatggggggggaatcttccaagcccctttgagaaaaaaaaaaaaatcctgtttatgggg

SEQ ID NO: 72988 - DNA, 703 bp, Zea mays
  misc_feature: Ceres CLONE 1557181
  misc_feature: Encodes the peptide sequence at SEQ ID NO. 72989
  misc_feature (354)..(354): n is a, c, t, g, unknown, or other
  misc_feature (455)..(455): n is a, c, t, g, unknown, or other
  misc_feature (479)..(479): n is a, c, t, g, unknown, or other
ctggagctccccgcggtggcggccgctctagaactagtggatcccccgggctgcaggaattcgtctcacccctagaaaaaaaaagccatcttccttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctcccaggctgtgaaacatgtgaattctgttatggnacctgctctgattggcaagggaccctacagcacagactgagattgataactccatggggtcaacaaccttgatggaacaaaaatgaattggggatggtgcnagcaaaagcttggtgcctatggcnattcgggctgtggcattagctgtttgcaaagctggggctagcatcaaaaggatttcttttataccagccacttgccaaccttagttggggaacaaggatttaggggttgccggtcccctggattcaggggctccaacggggggttcccttggggggaaaaagctttgcttggcaagggtttttagatcccttcccaccgggagcggccccatttaaggggggct

SEQ ID NO: 72989 - protein, 88 aa, Zea mays
  misc_feature: Ceres CLONE 1557181
  misc_feature (4)..(89): Pfam Name: Enolase_N Pfam Description: Enolase, N-terminal domain
  misc_feature: SWISSPROT Homolog: EC 4.2.1.11 Phosphopyruvate hydratase
  misc_feature (76)..(76): Xaa is any aa, unknown, or other
MAATIQSVKARQIFDSRGNPTVEVDVFCSDGTFARAAVPSGASTGVYEALELRDGGSDYLGKGVSQAVKHVNSVMXPALIGKGPYSTD

SEQ ID NO: 72990 - DNA, 735 bp, Zea mays
  misc_feature: Ceres CLONE 1557182
  misc_feature: Encodes the peptide sequence at SEQ ID NO. 72991
  misc_feature (40)..(40): n is a, c, t, g, unknown, or other
  misc_feature (67)..(67): n is a, c, t, g, unknown, or other
  misc_feature (288)..(288): n is a, c, t, g, unknown, or other
  misc_feature (319)..(319): n is a, c, t, g, unknown, or other
  misc_feature (349)..(349): n is a, c, t, g, unknown, or other
  misc_feature (351)..(351): n is a, c, t, g, unknown, or other
acccgcggtggcggccgctctagaactagtggatcccccngggctgcaggaattcgtctcacccctnagaaaaaaaaaaaaaaaaaaaaaatcccctcagtcctcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggnccacccgcgcgccgggcgggcggccccatcngcgcggtcattctcctctcccccaccccgncntaagaactggacgtccttcccggtttcagccccatcaaaggagtccatcggggcccgggaagattgaaccgggggcctccatgaagggacatgattcacccccgccgacccccaacttggtggatcgtggggccccggggtccccggggctggtccggggccgttcaaacttttccaagggaccccaccgggaagcgggggcctccgggggagaaaatcccggttcccccgggcggggggccccggggcttggggggggaaacttttttccgggccatgggggggtggccaaggcgcgggcccccctttttcccgggaaaaaaaggggggcgtgggggtctcaaagaagggcgaaagaaattttttggggggggacaacccccg

SEQ ID NO: 72991 - protein, 76 aa, Zea mays
  misc_feature: Ceres CLONE 1557182
  misc_feature (34)..(34): Xaa is any aa, unknown, or other
  misc_feature (55)..(55): Xaa is any aa, unknown, or other
MATTAASSLLKSSFAGSRLPSATRTTTPSSVAVXHPRAGRAAPSARSFSSPPPRXKNWTSFPVSAPSKESIGARED

SEQ ID NO: 72992 - DNA, 695 bp, Zea mays
  misc_feature: Ceres CLONE 1557183
  misc_feature: Translation starting site: 184
  misc_feature: SWISSPROT Homolog: EC 3.1.3.16 Phosphoprotein phosphatase
  misc_feature (286)..(286): n is a, c, t, g, unknown, or other
  misc_feature (287)..(287): n is a, c, t, g, unknown, or other
tggagctccccgcggtggcggccgctctagaactagtggatcccccgggctgcaggaattcgtctcacccctagaaaaaagatctcccggcctgaggattcgattattctgttcgctctcgcccaagtcatcgtctggtcgtcgcccgcagaggcgcagacgcccaaaaccggaaggggcgccatggccgcgtcggatctggagagcaaggccaaggaggccttcgtcgacgacgacttcgagctggccaccgagctctacagccaggccatcgacgccgggcccnngcatcgcgacctctatgccgaacgcgcccaggcgcacatcaagctcggcaactacactgaggctgtggcggatgctaaacaaagcattggagcttgatcctatgatgcataaagcttacctacggaaaaggggctgcatgcttaaggctgaagaatacaaaactgcaaaagctggccttgattggggtccttcttatgcatcagggaatcaagggtttgccctcttttgaaggaaatgggttgaaccctccccttaggaaatctaccccggcccccattaaaaaatgtttggggcctcgggggcctccccctttggggggaaaggggggttttccccaattttgggaaaaaccccccccggtggttggaaccccccaggaaaaacaaaaaaaaggggtggagtccccc

SEQ ID NO: 72993 - DNA, 689 bp, Zea mays
  misc_feature: Ceres CLONE 1557184
  misc_feature: Translation starting site: 141
  misc_feature (266)..(266): n is a, c, t, g, unknown, or other
ctccccgcggtggcggccgctctagaactagtggatcccccgggctgcaggaattcgtctcacccctagaaaaaagacgcaccccttcctcgtttcgccgcctccgccgacaccgactgcctacctcagctgccgtcgccatgggcagaaggcctgctagatgctatcgccagatcaagaacaagccataccctaagtccaggtactgccgtggtgtccctgaccccaagatcaggatctacgatgtcgggatgaaaaggagggtngtgatgagttccctactgtgtgcacctggtctcttgggagaagggagatggtctcagtgaggcgctcgaggctgcccgcatttgcctgcaacaagtacatgaaccagtctgcaggaaaagatgcccctccaccctaagggtccgggttcaccccgttccatgccctccgtatcaacaaaaagctttcctggggccggggggctaaaggccccaaactgaaaggagggggcgcctttggaaaaccccagggccccctgggctaggggggacattggtcaagggcccccttttccgggggatcaaagggaaaaaatgttccccttgcccccaaaacttttcgttcccctaattttaatatccccgggcccccaaaaaatcttttaaacccaaagggggggtttcaccaattcaccgccccttaaa

SEQ ID NO: 72994 - DNA, 678 bp, Zea mays
  misc_feature: Ceres CLONE 1557185
tccccgcggtggcggccgctctagaactagtggatcccccgggctgcaggaattcgtctcacccctagaaaaacttttccttcgccgcacaccaatagccattgcccaaatctgcgagggagagattgaagacgccgccgtgtgagagcaaggcgtctaagcgagtctcccgggttcaccgacaaattcatttcgttgaagcatcgcagtgtgccctgtggatccgtaaaagccagctcggggaccttctgaggccggtgtcaccccgctcgcggcatattgctcatcagagcaaatctacgctgtgaacctgccgcaccgagattcagctcggccttatcacaaccctcactctgacgagcaagtgaccgaggagcccggagcacagcaaggttgaagatactaaacaggagctcccctgaaggtgaaaaacaagtgccaccggaggaggacctactcgacaagttcgatgagggccaggggtccgcctcccaaccagcttgatggccccaaggaaagaaaaaatttttaagttggccttatttattaacggtttatttttaaaaactttttggttatggaaaaaaaggtggggaaaatttggccccattaacccggagccaatataggggggtggaaccaaaaccgggggtgtgcccctaaagattgggggggggg

SEQ ID NO: 72995 - DNA, 688 bp, Zea mays
  misc_feature: Ceres CLONE 1557189
  misc_feature: SWISSPROT Homolog: EC 3.2.1.18 Exo-alpha-sialidase
ggagctccccgcggtggcggccgctctagaactagtggatcccccgggctgcaggaattcgtctcacccctagaaaaaactgctcgagctcagctcaagtaaccacagaaaatggcgtcacttctccgccctctcgtcctcgtgctcctgatcgcctcctgcacagcgcagcagtcaccgccggcgcagcccccgccaacgccgaacgcgccaccggccaactcgccgccccaggcgcctccagccggcaacccgccgccggcaggcaacccgccacccgcgcccaccgccactccacctccggccccgaccactccgcccccggccccgaccactcctcccccggctcccacaacgccgcccccggcgccgacaactccacctccggcccccaccacgccgcctccgtccccaccagcgtcgccaccgcccgctcccaccactccgccaccgtctcccccggcaagcccgccgcccgctcccgccaccccgccaccgtctccgcccatggcgccacctcccgccacgccccctccacccgccaccccgccgccaccggccgcgcccacgccggccccgagcgtggccccgactcccccgcccgtggcgacaccggctgcgtcccccaagagccccaagacgccgagccccgccgccgcgacgtccccggggccctcgctctcgcccg

SEQ ID NO: 72996 - DNA, 691 bp, Zea mays
  misc_feature: Ceres CLONE 1557191
  misc_feature: Encodes the peptide sequence at SEQ ID NO. 72997
  misc_feature (691)..(691): n is a, c, t, g, unknown, or other
ggagctccccgcggtggcggccgctctagaactagtggatcccccgggctgcaggaattcgtctcacccctagaaaaaatcctccaccacaccacaccacaccggccggctcacacgcgccgcaaagcagagcacggggggctgagaccagagcagagcggagcgccaccagccaatcctttgcctgcccaagcagcagcagcagctggcccgatggctctgtctctctccggtacctccgcccgcttcgccctcgcgtcgctggtcccccgggccagggcctacgcggcgtcggcggcgtccggggccatgaggcccgcggcggagggcccggccgcgtgctaggccaaggaggtcgggcccccccccggcggggggggggggagggctcgttggtgccccaaccccttcacggggccctaccgcccccccaacttgggccgccgccggtggaccccgccaacttccggggcgcggaacttcggccggtacttaccacgggccctgaaggggccccgggccccttaaaccttggttcgcgcgggtgctgggtttgaacttacccccccccttcccaagggtaagaagaagggcgggggttgggggtttttgggggcaaaagggctggattggtcccggcggagcggggggggcggccccttcagagccccggaacttatgcgggggggan

SEQ ID NO: 72997 - protein, 43 aa, Zea mays
  misc_feature: Ceres CLONE 1557191
MALSLSGTSARFALASLVPRARAYAASAASGAMRPAAEGPAAC

SEQ ID NO: 72998 - DNA, 854 bp, Zea mays
  misc_feature: Ceres CLONE 1557193
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (60)..(60): n is a, c, t, g, unknown, or other
  misc_feature (68)..(68): n is a, c, t, g, unknown, or other
  misc_feature (69)..(69): n is a, c, t, g, unknown, or other
  misc_feature (73)..(73): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (103)..(103): n is a, c, t, g, unknown, or other
  misc_feature (105)..(105): n is a, c, t, g, unknown, or other
nnnnnnnnnnnnnnnnnnnnnnnnnnnnnnnnnnnnnnnnnaaggnnnnnaagaaggggnaggggagnnaagnagnnngaggagggnnnttaggggggnnntntnttgtttttttacaaactgggactcaccgcgtggcggccgctctagaatagtggatccccgggctgcaggattcgtctcacccctagaaaatagaaaaaacaccaccactttctcactgaccactgtgccgcggcatgctcaccggacggacacaaggtcgacgaccactaagcatagagaacgacgatggccgcgtcggcgctgcatcagaccatcagctttcttcgggcagggccctggtctcccgccccggccgggtttaaattcgggcgggccgcttttaccatttggggccgcaacccgtttaaaaaaaaggcgcctcccccctaaaaaaatttttggttacggggcccttttttaaacccgcccccccaaagttcccctttttgggggcccttttttttcccaaaaaaaaaaatatgccccctttttatacccctgtgaaaaggggggggaaaattttttttctccccccgggggagaaaaaaaatggggggggtgggggggggagaaacccccccggggggggggggggttttttttcccccccggggggggagcccccccccaaaaaaaaatttttttttttttggggggggggaaaaaaaaaccccgggaagaaaaacggggggggggggggggtggttttaccccccccccccccccccccccccgggggggggggggggggggagaaaaaattttaattttttttttgggtggccccccccccttcttgtgttttgttg

SEQ ID NO: 72999 - DNA, 733 bp, Zea mays
  misc_feature: Ceres CLONE 1557196
  misc_feature: Translation starting site: 130
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (700)..(700): n is a, c, t, g, unknown, or other
  misc_feature (701)..(701): n is a, c, t, g, unknown, or other
ggagctccccgcggtggcggccgctctagaactagtggatcccccgggctgcaggaattcgtctcacccctagaaaaaagaggaaaagggcaaaagccaaaaggcatcaccgccgcgacgacgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggggctttcgcggcctcgccaacctcggggggctccctctcttttcgggggcccaaaccccgggaaggggcaccccccccaaaaggggggggaccccccccccacaaagggttccccaagaaaaaaaaaacctccccttttgggggggggttaaaaaggggggcccggggggcccccccggagaaaaaaaaaaagggggcccccccaaaaaatatttaaaaagaaggggggggnnnggaaaaaaaaaaaatattctctcccccccccccctttaaaaagggggggggggggggggcgnnnttccccccccccccccgttttttaaaaaaaaaaaaaaatttttttttttttttttctcttttttatttttttnnaaaaaaaaaaaaaaacaaaacgaactttcttt

SEQ ID NO: 73000 - DNA, 806 bp, Zea mays
  misc_feature: Ceres CLONE 1557198
  misc_feature: Translation starting site: 210
  misc_feature (406)..(406): n is a, c, t, g, unknown, or other
agctccccgcggtggcggccgctctagaactagtggatcccccgggctgcaggaattcgtctcacccctagaaaaaccttgtgagctctgagctggttgctgccgccaggattggaggagtgcgcgcgcgcgcaagtgagccatcactgagctgtggacgtgaattgcgatcatccgttctcgctttctggggctcggctgctgtggccatggcgccgccgccgccgccgtacgcgcgggtgatggaggacatggtcaagggccgggagtacgccacgcagctgaaggcgctgctccgggagtcgcccgaggccagccgcctcgtggaccggatcctgcacgccatatccctcaccatccagacggccaaggccgcggccgccgcccgctgaagaggaggtaggangaggaggcgtccgaggtgcagagcgaggtcacctgcaccggcaagaggaaggccgctggcggagcgggcaagagggccgccgcgtgtcggaggagagcccagccatcgtcggttgtgacgaagagcgtgagggatctggaggacggacacgcgtggcgcaagtacgggcagaaggagatccagaactgcaagcacccaaaggcctacttccggtgcacgcacaagcacgaccagcagtgcgcggcgcagcggcaggtgcagcggcgcgacgacgaccccgacgcctacactgtcacctacatcggcgcgcacacctgcccgggacccggccaccgcagcccgacaacaaacttcacgcgggggtcccgcctccatcagcttcgcgggcggcccaagccca

SEQ ID NO: 73001 - DNA, 834 bp, Zea mays
  misc_feature: Ceres CLONE 1557201
  misc_feature: Encodes the peptide sequence at SEQ ID NO. 73002
  misc_feature (635)..(635): n is a, c, t, g, unknown, or other
ctggagctccccgcggtggcggccgctctagaactagtggatcccccgggctgcaggaattcgtctcacccctagaaaaataacccctccttcgtttgcccatcctcgtgacggctcctcgccagtcgcctcgtctctccctgccgcgtcgcctccagttccgcctccgccgcgcctcccgcctccgccgcgcctgacgaacgcagtataggactgtgcaggtagagaggaggagggtccggcgagatggggatgcgagataagaagcggaaccagaagcgagtgctcgcgcgccgtaccgcggcaccgcgcccaggcgagggcaaggatttcctgccgctggaaggaggccccggtaagaagcatctgaaggtgcagcagcctgaagagcccgaaaacacagccacaatcgtctacattgggcatatcccccatggtttctacgaggacgagatgaaagggttctttaagcagtttggggatattaagaggcttaggatcgctcgtaaccgcaagacaggaaagtccaagcactatggattcattgagtttgagaaccctgctgtggcaaaggtcgtagcagatgagatgaaatactatctcttggttgagcgcaccttgcaagttgcacttgntgagccagagaaagtcatcctaaaatatgaaaaggggtgcgaggggatttatacttgttgatccagtagcatttgacggaaaaaaccccaccgggataaaactgttgccgaacccaaaaaaggggtgaaagaaattgtaaaccggaatggaaaagggccccaaaaaacaagggcccggggttttaccttagaaggcccc

SEQ ID NO: 73002 - protein, 149 aa, Zea mays
  misc_feature: Ceres CLONE 1557201
  misc_feature (56)..(127): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (130)..(130): Xaa is any aa, unknown, or other
MGMRDKKRNQKRVLARRTAAPRPGEGKDFLPLEGGPGKKHLKVQQPEEPENTATIVYIGHIPHGFYEDEMKGFFKQFGDIKRLRIARNRKTGKSKHYGFIEFENPAVAKVVADEMKYYLLVERTLQVALXEPEKVILKYEKGCEGIYTC

SEQ ID NO: 73003 - DNA, 773 bp, Zea mays
  misc_feature: Ceres CLONE 1557202
  misc_feature: Translation starting site: 153
  misc_feature (286)..(286): n is a, c, t, g, unknown, or other
  misc_feature (287)..(287): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (305)..(305): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (343)..(343): n is a, c, t, g, unknown, or other
  misc_feature (344)..(344): n is a, c, t, g, unknown, or other
  misc_feature (348)..(348): n is a, c, t, g, unknown, or other
  misc_feature (363)..(363): n is a, c, t, g, unknown, or other
  misc_feature (366)..(366): n is a, c, t, g, unknown, or other
  misc_feature (425)..(425): n is a, c, t, g, unknown, or other
  misc_feature (428)..(428): n is a, c, t, g, unknown, or other
  misc_feature (429)..(429): n is a, c, t, g, unknown, or other
  misc_feature (432)..(432): n is a, c, t, g, unknown, or other
  misc_feature (471)..(471): n is a, c, t, g, unknown, or other
  misc_feature (618)..(618): n is a, c, t, g, unknown, or other
agctccaccgcggtggcggccgctctagaactagtggatcccccgggctgcaggaattcgtctcacccctagaaaaaaaagcctaatccccacgaaaaccctaaaccctcgctacccggcggcggctacaagctcttcgtcggctcagcaccatgaggccaccggctagaggaggacgtggtgggaggggaggcaggttcgatggcggcggccgtgggggcggcggcggcggccgtgggtttggcggtggtagaggcgggagaggggaaggggagggagaggtggnnggannnnnngaggcgggngtggnnnnnnnnnggnnngggtgggnnngggggggggnntganggggggaggaaaggnggnggggggggggggaaaagagagagagtgttttgggcccccccccccaaaagaaagaaaanaannccncccccacacaaagggcccccgggagaaatcccttcgccncggaaaaaaacccgctcccacgctcggatatggctaagaggtaaaacacgcgcgcaactccggggagtgggggacaacccccccccccccccccggggggggtgcccagagcgaaaaagggggcccccccaccgctcgcctgtttcncacgggggaaagcccccgaaaaacggtaaaaaagaaggggccacactccccgtgggcaaaaaaaaccctcttgtagtggttcctagaatccatcctcaccttcccgatggtttttttttgcgataaaaagccggggatttgtttcgacaccaaaa

SEQ ID NO: 73004 - DNA, 713 bp, Zea mays
  misc_feature: Ceres CLONE 1557203
  misc_feature (19)..(19): n is a, c, t, g, unknown, or other
  misc_feature (238)..(238): n is a, c, t, g, unknown, or other
tgggagctccaccgacggntgagcggggccgctctagaactagtggatcccccgggctgcaggaattcgtctcacccctagaaaaagcgcacacggcacacacaccacaccacacctcctcgcttgcactccgctcgtctgacatctcgtcccgtcctttcgtttcgaagcctcgcgagccccgacgatggccaccaccgcggtgtcggtcgacgaagaagctcgataagcttcgcgnccgaggtcgcccaagctcgaccagatcagcgagaaacgaagaagtccgggtcatcagctcgtgtccggtactcagtgggaggcgagcgatcgagtgagcagatcagaccctacgatgagggggtgtgccctagatacgtcccgtgcctcccaaaatcccaggaaacaaaaacccgcggaaaacccttgggccaactttacggagggtcggaaaaacctgggttgcctgggcccaatttgttttaaaaccccaaggggttcactttcctgcccctttggggataaaaatgggccccccaaacaaaaaaggggggggggggggcccctttttctttgtgaaaaccctttttcccccccccgtggagacccccaaaaaagttgggtagaaaaagttttccccccccccccccccaataatattttttttttttttaaaaaaaagaaagatcccccccccgtggttgggggggggggga

SEQ ID NO: 73005 - DNA, 816 bp, Zea mays
  misc_feature: Ceres CLONE 1557204
  misc_feature: Encodes the peptide sequence at SEQ ID NO. 73006
  misc_feature (396)..(396): n is a, c, t, g, unknown, or other
ctccccgcggtggcggccgctctagaactagtggatcccccgggctgcaggaattcgtctcacccctagaaaaacaatcgggattaatgacacagatgcctgttcaaggactaagtcaaacattccgtgatggtttttccattggtgggatgtctcaggacttcattgtagatgattttaagagccaaggatcacatgtgccatacaacattgcagaattttctacccaggtttctgtacagttcactacatgttattttttacttctttctggattcatatacgcttgtggttttgtgaaatttaacaaaccaaattatctggttactgtgaagtttagttctttctttggctcatagaaaaaagcttccatcaacaggcttctcaaggtggttnatggtgttgagtttactcaagcgccccaatctggatactctgggaattatatgaaccaaaacacacatcctggatactcccatattggtacaacaaatgacattgtatctcaggatcacatggcccatggatctcacggaatgtttacgcaagtggggtataatgatccgtcgcaagatgagtcatctcagattcattatggaatggctgctgctggtcccctacattcgcagagcatgatgaaccccttatactctcaatcctatgctcactacaacacccagccacattctcttcaacctcctccccagtgataattaaggcttgtgatatggtgaagccacattttgggagttttggtgggttgcatcttttggcccacatgttgtgcccttctctgctatttcagaatcgatggtg

SEQ ID NO: 73006 - protein, 118 aa, Zea mays
  misc_feature: Ceres CLONE 1557204
PRGGGRSRTSGSPGLQEFVSPLEKQSGLMTQMPVQGLSQTFRDGFSIGGMSQDFIVDDFKSQGSHVPYNIAEFSTQVSVQFTTCYFLLLSGFIYACGFVKFNKPNYLVTVKFSSFFGS

SEQ ID NO: 73007 - DNA, 873 bp, Zea mays
  misc_feature: Ceres CLONE 1557205
  misc_feature: Encodes the peptide sequence at SEQ ID NO. 73008
ctctccgcggtggcggccgctctagaactagtggatcccccgggctgcaggaattcgtctcacccctagaaaaaaacttgcgtagagagttgggcgcagagaatccccaagcaaacaaacagggtagagggagaggagaggagaggagaggagaggagaggttgggtctgggacaccatggctccgatgaagctgtactgggcggtgatgtcgtggaacgtgacgaggtgcgctacggcgctggaggaggctggctccgactactagatcgtgcccttcaacttctcctccgccgagctctagagccccgagctcctcgtccgcaacccgtttggtcaggttccatctctgcaggatggtgacttgtacctcttcgaatcacgatctttctgcatgtactctgctctctttttcaagccatatctgttgttggatggattcctcctggacgcacccttggtgcatgtttgcatctatgtggatgctttccagttcaccgcttcccttatccccatcctctttcctggtcctcttctttcccattctttgtgtgtgcctccccaccactaatgttgtttgttgatcccccttactttactgaaccctcctgcctcgttcttcttcttacgccctccctttcacttttgcctcgttccttttccttgtttcctttcctcctcccttctccttccctgtttcccttctcgcttgttcccctcttttttccttttctttctttcttcccttccccccttctcgttggcatccctccccctttccccccttttctccattatttcccctctgcctgcgcttcgttctctttttctttttaactgttctgtttcttgttgcctcctcattctgctcttg

SEQ ID NO: 73008 - protein, 29 aa, Zea mays
  misc_feature: Ceres CLONE 1557205
  misc_feature: SWISSPROT Homolog: EC 2.5.1.18 Glutathione transferase
MAPMKLYWAVMSWNVTRCATALEEAGSDY

SEQ ID NO: 73009 - DNA, 818 bp, Zea mays
  misc_feature: Ceres CLONE 1557206
  misc_feature: Encodes the peptide sequence at SEQ ID NO. 73010
  misc_feature (748)..(748): n is a, c, t, g, unknown, or other
  misc_feature (782)..(782): n is a, c, t, g, unknown, or other
ctggagctccccgcggtggcggccgctctagaactagtggatcccccgggctgcaggaattcgtctcacccctagaaaaaaaccaagaacaaaccattgttggacgcgttcccctcctgcacgcaacctcatctcgtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggtggtcgagcatcgcatgttctgcttctggatccagatctggagaaatcgcgaagtcgtcgtcgttcggttcggagcggatctgaggcgacgatagatggaggcggcgggatctctcggtctgcagtcctgctccacctcgatggatgatgtctctgcgctgataattattggatcaatttcgataattattagtagatctatgagatatgccgcctggaagaggcgaggtaagctgcagcatgtaaaaaagagaaaaaagatgtgacatcctagaggaggaggcctttgccatgatgggtgcgctcgcatggcaggccaggcaataataaaaagatgattattgcgtgccggggggaggagatcgcacggggggtttgatgttttttggcccccgggttctcctccctcantcttgttccgtgtttcctgtatgcgttgcttccngctcctgttgggtccgctacgcacgccgtgattttt

SEQ ID NO: 73010 - protein, 56 aa, Zea mays
  misc_feature: Ceres CLONE 1557206
MEAAGSLGLQSCSTSMDDVSALIIIGSISIIISRSMRYAAWKRRGKLQHVKKRKKM

SEQ ID NO: 73011 - DNA, 853 bp, Zea mays
  misc_feature: Ceres CLONE 1557207
  misc_feature: Encodes the peptide sequence at SEQ ID NO. 73012
  misc_feature (766)..(766): n is a, c, t, g, unknown, or other
ggagctccccgcggtggcggccgctctagaactagtggatcccccgggctgcaggaattcgtctcacccctagaaaaagagaaagctgctgcaacacaggctattggttttttcgcactacacacgaagagtgcctatgctccgtatcctttagggcgtctccagcagttcatccatatggtcatcgaaaacactgttttgcactgttcgtagagtaaagtttaaatatgaggatgagtaagctgctggagagtttaagaaatgctaagctgctctagtcacagtttcacctttccaaatttccttgactgacactaggtatctggaggagtcactgaagattttgatccggcacagtggttatttccatgaagatgtcaggctgcaggcagtcatatctttgaaacatattctaactgcagttagggcaatacctcctgcacatgctgatgtactagagaaacagaaggatgtccttgatactgttctgaacatctacatcaagactatgacagaggatgacgataaagaggtagttgcacaagcttgcatgagtgtagcagacattgtgaaggactgtggttttgctgcaattgagccttacatgctgaggcttgctgaggtaacactggtccttttacgccaagaatcaagctgtcagcaagtagagtcagatggtgaggatgatggcgacattgaccatgatgaagtcctcatggatgcagtttcagatcttttgcctgcttttgcaaaagtgatgggatcntattttgatcccatatttgcaaaattatttgatccgttgatgaaatttgctaaatctcccatccctcccaagatagactatgggtgt

SEQ ID NO: 73012 - protein, 70 aa, Zea mays
  misc_feature: Ceres CLONE 1557207
GAPRGGGRSRTSGSPGLQEFVSPLEKEKAAATQAIGFFALHTKSAYAPYPLGRLQQFIHMVIENTVLHCS

SEQ ID NO: 73013 - DNA, 864 bp, Zea mays
  misc_feature: Ceres CLONE 1557210
  misc_feature: Encodes the peptide sequence at SEQ ID NO. 73014
  misc_feature (442)..(442): n is a, c, t, g, unknown, or other
  misc_feature (468)..(468): n is a, c, t, g, unknown, or other
  misc_feature (536)..(536): n is a, c, t, g, unknown, or other
  misc_feature (548)..(548): n is a, c, t, g, unknown, or other
ctggagctccccgcggtggcggccgctctagaactagtggatcccccgggctgcaggaattcgtctcacccctagaaaaaaaaaactccgaatccgccgcgcgcgccccgtcctcgtcgccggcggaggcgtccgccaccgcccacagcagactatcgccggagaaggaacgccgcggggagcttttccactgccatctcccgtctgacccctccgagatcggaagcggcggccatggccatcccgctcgtgctcgtcgtgctcccgctcggcctcctcttcctcctgtccggcctcatcgtcaacaccatccaggcgatcctatttgtgacaataaggcccttttccaagagcttgtatcgccggatcaacaggttcttggccgagctgctgtggctccagcttgtctgggtggtggactggtgggcagggcgttaggtancactacatgcggatgaggaaaactanccgatcatgggtaaagagcatgccctcgtcatatcaaatcatcgaagtgataatgattggcttatggnatggatatgggnccagcgctcagggtgcctttggagtaccctcgctgtcatgaagaagtctccaaggtcccttcaagtcattggctgggcaatgggggtttgccaaaaacctctttttggaaaaggaactgggcccaaggataaaaaaaacctaaggtgggggtccccaaggggtgaaaagaattccccaaaaccattttgggcaagcctctttttttggggagggaacccccctttttcccccaaaaaaatctttcccccaccccaggaggattggcgcttttcccggggggtttccacccccccctaaaaagggttctttttcccc

SEQ ID NO: 73014 - protein, 67 aa, Zea mays
  misc_feature: Ceres CLONE 1557210
  misc_feature: SWISSPROT Homolog: EC 2.3.1.51 1-acylglycerol-3-phosphate O-acyltransferase
MAIPLVLVVLPLGLLFLLSGLIVNTIQAILFVTIRPFSKSLYRRINRFLAELLWLQLVWVVDWWAGR

SEQ ID NO: 73015 - DNA, 823 bp, Zea mays
  misc_feature: Ceres CLONE 1557215
  misc_feature: Encodes the peptide sequence at SEQ ID NO. 73016
ggagctccccgcggtggcggccgctctagaactagtggatcccccgggctgcaggaattcgtctcacccctagaaaaaccccacgccacacaccaccaccggacgctagctcaccaccaacctcagcacatcgaggagaagaggagtggccaatggcttcgtcggtggccgccgcggcgagcacattcctgggcacccgcctggcggacccggtgccgcagaacgggcgcatcgtggcccggttcgggttcggcggcggaaagcccaaggctgccgtcccgaagaaggtggcgaagacgtcgatctcctctgaccggccgctgtggttccccggcgccgtggcgcccgactacctcgacggctcgctggtcggcgactacgggttcgacccgttcgggctcgggaagcccgtggagtacctgcagttcgaactggactcgctggaccagaacctggccaagaacgaggccggcggcatcatcggcacccggttcgagtcctccgacgtcaagtccaccccgctccagccctacagcgaggtgttcggcctccagcggttccgcgagtgcgagctcatccacggccgatgggccatgctcgccaccctcggcgccctcaccgtcgagtggctcaccggcgtcacctggcaagacgctggcaaggtggagctgggtggatggggtcctccctactgggccagccgctggccgttcaccatctcgacgctcattctggatcgaaagtgcttgtgatcgggctacatcgagttcccagcgcaacggccgagcttcgaccccggagaaaaaggctgttacccccggca

SEQ ID NO: 73016 - protein, 199 aa, Zea mays
  misc_feature: Ceres CLONE 1557215
  misc_feature (63)..(192): Pfam Name: Chloroa_b-bind Pfam Description: Chlorophyll A-B binding protein
MASSVAAAASTFLGTRLADPVPQNGRIVARFGFGGGKPKAAVPKKVAKTSISSDRPLWFPGAVAPDYLDGSLVGDYGFDPFGLGKPVEYLQFELDSLDQNLAKNEAGGIIGTRFESSDVKSTPLQPYSEVFGLQRFRECELIHGRWAMLATLGALTVEWLTGVTWQDAGKVELGGWGPPYWASRWPFTISTLILDRKCL

SEQ ID NO: 73017 - DNA, 580 bp, Zea mays
  misc_feature: Ceres CLONE 1557216
  misc_feature (157)..(157): n is a, c, t, g, unknown, or other
  misc_feature (158)..(158): n is a, c, t, g, unknown, or other
ctggagctccccgcggtggcggccgctctgaactagtggatcccccgggctgcaggaattcgtctcacccctagaaaaaatccgctgctcttctccgttcgcccgcccgcccgcccctcccctctctctgtctcgccgcccggggagaaggagggcnntccgccgctcccgggggaagagcgcgccattgcccgcccgccgcgctgactgggggaagatgggttgttcccgggagtttcaccaggtggaatcttcaacaagggcccccctttggtttttccccggggtttggggcccctttctttttggaagggaaaacacggggttaccccccggggaaaaaatggggggggtttttccccccccaaaaacccccgggaatttcttttttttcttgggcccaaaaaaaaggaaaaagggggggttcccctccccaaaggggggttttttttttttttttttctcccccgggggaaaaaaaaaaggggggggggggggggtgccccccccccccccgggggggtggaaaaaaaaaattttttttttttcttttttttggtggggaggggcgccacacccc

SEQ ID NO: 73018 - DNA, 798 bp, Zea mays
  misc_feature: Ceres CLONE 1557219
  misc_feature: Encodes the peptide sequence at SEQ ID NO. 73019
  misc_feature (430)..(430): n is a, c, t, g, unknown, or other
  misc_feature (431)..(431): n is a, c, t, g, unknown, or other
  misc_feature (433)..(433): n is a, c, t, g, unknown, or other
ctggagctccccgcggtggcggccgctctagaactagtggatcccccgggctgcaggaattcgtctcacccctagaaaaaacctcggtcattcctcattcgcgaaaagaaaaacacaaggcgaccgcagagggcaggacaggacagagacgccgaggctaggcagtccatctgttggggtggccagtggggatctcgccggccgggaggtctggggggcgggggctgccaaacttcgccatattggtgaatcactgaatccgcccctgccagcaaccgttctgacgtggcggggtgggggcaggatccaaatggcggcggcaatagaggaactgcggctcctgggatccatccctgtactggaaggtccgggagaggtcgacggcgtgggtgggtgaaggaagggcgaccgcgaggcggcggcgacgacnnangagatcctgcgattcatggactcggtggacagctacctgctcctcatggactccctatcctccgctcttcgtcagggctggcttgacctgggcaagtgctcgcccattctatgggcacatcacgccgtttcgagtacactggtttgattcacaaggagcaatccgctgccactaaacctcaaaatgttggatcaggaagggcctgaaatcctcggagtcaaaaccaccctttgcaaaattaaaaaggggcttttgcaaaaaaaaatgccccccccccctttgatttcatggggaggagggatttttcctgaccccaaaattagggcttctcgggaattcttttccacccccccaaaaaaaggaaa

SEQ ID NO: 73019 - protein, 43 aa, Zea mays
  misc_feature: Ceres CLONE 1557219
MDSVDSYLLLMDSLSSALRQGWLDLGKCSPILWAHHAVSSTLV

SEQ ID NO: 73020 - DNA, 870 bp, Zea mays
  misc_feature: Ceres CLONE 1557220
  misc_feature: Encodes the peptide sequence at SEQ ID NO. 73021
ctggagctccccgcggtggcggccgctctagaactagtggatcccccgggctgcaggaattcgtctcacccctagaaaaatcccatccccgcacttcaccggcctcctcctccttcccgtccatcgccgtcgccggggcgccctacaacttcaaaatggcggctaccgccaccgccatggctatagcaactatctcccccgccgctccgatcccatccgcgcccttcccatccctccccctcggcctccgcctccgccctcaacccctccttttcgctgcttcccgccgccgcctcctccatgttcccaaagccgcctcctgggacgaatccgtccccgaggatggtggagatgcggaggaatccgttgccgctggggacgacgaggacgaggaccacaagccgcggcccgagccggtgtcctcctccgagttccagttcgcggcgccacccgagggctacgtcgagcccgcggcgtttgacgagctaccgccggagtccccagaagacgtggcggcggcgtacgaatctctctacgggccggccttcagcggcgagacattgctggggaacaatgtcttcgaggtcaaggtggtcgaccccatcgacatggaacgggagcagcgtccgaacgacgatttcaccgaacgcgtcgtgcaggtcaaccgcgtcaccaaggtcgtcaagggagggaggcagctctcctaccccgcaaatcctcgtctttggcgacatgaaaggccaccttggtggtcggcttgggaaaagccaaggaaggtcacggaaggccatcacccaagggccgccattgaaagggcgggggcaaacccttggtcccaagggcccgcctaactaaaaaacattccgactt

SEQ ID NO: 73021 - protein, 231 aa, Zea mays
  misc_feature: Ceres CLONE 1557220
MAATATAMAIATISPAAPIPSAPFPSLPLGLRLRPQPLLFAASRRRLLHVPKAASWDESVPEDGGDAEESVAAGDDEDEDHKPRPEPVSSSEFQFAAPPEGYVEPAAFDELPPESPEDVAAAYESLYGPAFSGETLLGNNVFEVKVVDPIDMEREQRPNDDFTERVVQVNRVTKVVKGGRQLSYPANPRLWRHERPPWWSAWEKPRKVTEGHHPRAAIERAGANPWSQGPA

SEQ ID NO: 73022 - DNA, 793 bp, Zea mays
  misc_feature: Ceres CLONE 1557223
  misc_feature: Encodes the peptide sequence at SEQ ID NO. 73023
gagctccccgcggtggcggccgctctagaactagtggatcccccgggctgcaggaattcgtctcacccctagaaaaaaaagcagagcacgagacacccaagaaacacacagaagcgaggagcactacttgttggttggattctcttcagtctagcagctagtccagttaagtttcagacacatggggagcattggcagaggcacggccaactgcgccaccgtgccgcagccgccgccgtcgacagggaagctcatcacgatcctgagcatcgatggcggcggcatccgcggccttatcccggcgaccatcattgcgtacctcgaggccaagctccaggagctggacggcccggacgctcggatcgccgactacttcgatgtgattgccgggacgagcaccggcgccctgctcgcgtcgatgctggcggcgccggacgagaacaaccggccgctgttcgccgccaaggacctcaccacgttctacctcgagaacggcccaaagatcttcccacagaaaaaggctgggttgctgacgccgctgaggaacctgctgggcctggtgcggggccccaagtacgacggcgtgttcctgcacgacaagatcaaaaactgacgcacgacgtccgggtggcgggacacgtggaccaacgtcattcgggcggcgttcgaagtcaaagtccttgagcccatcatttttcttgaagtacaaggcccagaaccaaaccccttcaaaagagggcacctttttcgaaaatttggattaaaacacttgggggggggcccaaccttattt

SEQ ID NO: 73023 - protein, 143 aa, Zea mays
  misc_feature: Ceres CLONE 1557223
  misc_feature (28)..(144): Pfam Name: Patatin Pfam Description: Patatin-like phospholipase
  misc_feature: SWISSPROT Homolog: EC 3.1.1.5 Lysophospholipase
MGSIGRGTANCATVPQPPPSTGKLITILSIDGGGIRGLIPATIIAYLEAKLQELDGPDARIADYFDVIAGTSTGALLASMLAAPDENNRPLFAAKDLTTFYLENGPKIFPQKKAGLLTPLRNLLGLVRGPKYDGVFLHDKIKN

SEQ ID NO: 73024 - DNA, 800 bp, Zea mays
  misc_feature: Ceres CLONE 1557224
  misc_feature: Encodes the peptide sequence at SEQ ID NO. 73025
  misc_feature (605)..(605): n is a, c, t, g, unknown, or other
ggagctccccgcggtggcggccgctctagaactagtggatcccccgggctgcaggaattcgtctcacccctagaaaaaacggcccaatacctgccctcctcgggtccttccaacctcggcctctccgcgcccgccgccacattgccatcgccatcgccgccgcatccacccacgggcccaccaaacgacctcgctgcgcccacccgtccgcccccatctagctcagcggtcccgcacaaccgaccactcggcagaatgccgccgcttcggcctccgccgccgcggctcctgctcaacaacgtctcgtgcatgcggaacgcgcagacggtgctccgcgacatcaacctcagcgtccacgacggcacagccctcgtcctgaccggtgcgaacggctccggcaagaccaccctcctccgcatgctggcgggcttttcgcgtccctcggcgggggagatcctctggaatggtcacgacatcacctccccgggcgttttccagcagtacaagctgcagctcaactggatgtcgctcaaggacgccgtcaaagagaagctcacggtgctcgagaacgtccagtggttcgagctcctcgagggggaaggacngcagcaggtcggggccagccatcgagctcatgggcctcggcaagctcatgaacgagaaaggcagatgctctccatggggcaaaagaaacggctgcagctcgccaggctgctcgctatcgaccgacccctctggctgctggaacaacccctcaatcccccctgggacccataggggtaccaagccgccttgaataa

SEQ ID NO: 73025 - protein, 173 aa, Zea mays
  misc_feature: Ceres CLONE 1557224
  misc_feature (36)..(172): Pfam Name: ABC_tran Pfam Description: ABC transporter
  misc_feature: SWISSPROT Homolog: EC 3.6.3.41 Heme-transporting ATPase
  misc_feature (117)..(117): Xaa is any aa, unknown, or other
MPPLRPPPPRLLLNNVSCMRNAQTVLRDINLSVHDGTALVLTGANGSGKTTLLRMLAGFSRPSAGEILWNGHDITSPGVFQQYKLQLNWMSLKDAVKEKLTVLENVQWFELLEGEGXQQVGASHRAHGPRQAHERERQMLSMGQKKRLQLARLLAIDRPLWLLEQPLNPPWDP

SEQ ID NO: 73026 - DNA, 836 bp, Zea mays
  misc_feature: Ceres CLONE 1557225
  misc_feature: Encodes the peptide sequence at SEQ ID NO. 73027
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (711)..(711): n is a, c, t, g, unknown, or other
gagctccccgcggtggcggccgctctagaactagtggatcccccgggctgcaggaattcgtctcacccctagaaaaagaccttactagcgagccgaggtatcttgttacttttactgttggtattgggcaaaaggcaaatattgatgcagcggtcagaaagttttcagacaaattcaccattatgttgttccattatgatggtcggactacagagtgggatgaatttgagtggtctaaaagagcaatccatgtgagtgccaggaagcagacaaaatggtggtatgcaaaacgatttttgcatcccgatgttgttgccagatatgattacattttcatctgggatgaggatctaggtgtagagcatttcaacgcagagaagtacattgagcttgttagaaagcatgggttggaaatctctcagcctggtttgcaacctgatagaggactaacatggcaaatgactaaacggcgtggtgaccaggaagttcacaaagtaactgaggagagaccaggctggtgcactgatccacatctaccaccatgtgcagcatttgttgagattatggcaacagtgttctccagaaatgcatggcgctgtgtatggcatatgattcagaatgacttggtccatggatggggtcttgactttgctcttagaaaatgtgtggagccggctcatgagaaaattgnnnagtgtgatgctcaatggnatgttcatcaatcagttccttccacttggcacccagggcaagtcagataatgggagaacaccatggggaagggggtagagcacgctgcagaaaagaatggggggaaatttcaaacaaggctggct

SEQ ID NO: 73027 - protein, 252 aa, Zea mays
  misc_feature: Ceres CLONE 1557225
  misc_feature (1)..(252): Pfam Name: DUF707 Pfam Description: Protein of unknown function (DUF707)
  misc_feature (230)..(230): Xaa is any aa, unknown, or other
  misc_feature (231)..(231): Xaa is any aa, unknown, or other
  misc_feature (237)..(237): Xaa is any aa, unknown, or other
APRGGGRSRTSGSPGLQEFVSPLEKDLTSEPRYLVTFTVGIGQKANIDAAVRKFSDKFTIMLFHYDGRTTEWDEFEWSKRAIHVSARKQTKWWYAKRFLHPDVVARYDYIFIWDEDLGVEHFNAEKYIELVRKHGLEISQPGLQPDRGLTWQMTKRRGDQEVHKVTEERPGWCTDPHLPPCAAFVEIMATVFSRNAWRCVWHMIQNDLVHGWGLDFALRKCVEPAHEKIXXCDAQWXVHQSVPSTWHPGQVR

SEQ ID NO: 73028 - DNA, 761 bp, Zea mays
  misc_feature: Ceres CLONE 1557231
  misc_feature: Encodes the peptide sequence at SEQ ID NO. 73029
ctggagctccccgcggtggcggccgctctagaactagtggatcccccgggctgcaggaattcgtctcacccctagaaaaacgacaaaggggaaaggttcgcttcttctcgcatcttgctttacttcgagtgccatggccgatccggcggaggagaacgttgtctcgccgccaccgacccctgcggccccagccgtgggcgcctcagactcgcccctgcagcctgttgctgacggcgcctcaacggagaaggtgtctgccccggcgccggaggtaaggtcccggggattcaggcttcttggagaggacacttccgtgcacaaatcccttgggggcggtaaaactgctgacgttctgttatggaaagacaagaaaacttctgctgttgtaataggcggcgcaactgtcatctgggttctgttcgaagtgcttgattaccacctcctgaccctggatatccatgtactggattggtgggcttgcccccttatttcctggggggccaaaccaacccctttccatcagaaaaaattcccccgggatatttccggtagtggccggggttttttaagggaccttttttttgggaaaagggtttcccccgggggcttttttcggggaagggggcatcccccaccagggggccccctttcccctttttttttccccccggggggaaattcccccaaaaagggggggggccccttgtatttttcttagaaaaaagaaatttttttttgtggggggggggggggtagaaaca

SEQ ID NO: 73029 - protein, 194 aa, Zea mays
  misc_feature: Ceres CLONE 1557231
MADPAEENVVSPPPTPAAPAVGASDSPLQPVADGASTEKVSAPAPEVRSRGFRLLGEDTSVHKSLGGGKTADVLLWKDKKTSAVVIGGATVIWVLFEVLDYHLLTLDIHVLDWWACPLISWGAKPTPFHQKKFPRDISGSGRGFLRDLFFGKRVSPGGFFRGRGHPPPGGPLSPFFFPPGGNSPKKGGGPLYFS

SEQ ID NO: 73030 - DNA, 889 bp, Zea mays
  misc_feature: Ceres CLONE 1557234
  misc_feature: Encodes the peptide sequence at SEQ ID NO. 73031
ctggagctccccgcggtggcggccgctctagaactagtggatcccccgggctgcaggaattcgtctcacccctagaaaaagcctcgccgcgcgcgcgtacgttcggttctcggccactgctcagctctcgctgcagcgatggccctgcaggccccgtcactcatgcgcgcgccggcggcacagcggtccgcgccgccacggccctccttctccgccccgtggtcgctgcggctgccggcgcctgcgcggcgccgggtggccactgccgcgcggatcaccatgcgggtcgcgtccaagcaggcctacatctgccgtgactgcgggtacatctacaacgacaggacgccgttcgacaagctggctgacaactacttctgccctgtttgtggagctccaacacacaaggttcagaccctacgagccaacagtcttcaaagaacgcgaaccccacccgatgccagaaaaggcgagggaaggagggagcctaaagaagggaggagaagcatgggggaaaaccctttgcctatttgccatccttcggtccgggataaattgcccttggcgtgggccctggaattttttaaccctcaaaaaaaggttttaccaggctaaaaccaaccaaaaaaaaaatccccttttggggggcggggggaaaaagggagttttcatggcccgtttttgggaggtccttttttttcccctctttggtaaaaaccccttggcaaaaggggggcaggacctctggtgggcaccatgtgaacacaacaaggggggctccccaaaaacaaggttataacaaaaaaggtttatggggcggcgcctccaccccctgggggagaaaatccgccgcgcccttttttctaaaaaacccccgccgcgtgtgttaacg

SEQ ID NO: 73031 - protein, 157 aa, Zea mays
  misc_feature: Ceres CLONE 1557234
  misc_feature (55)..(92): Pfam Name: Rubredoxin Pfam Description: Rubredoxin
MALQAPSLMRAPAAQRSAPPRPSFSAPWSLRLPAPARRRVATAARITMRVASKQAYICRDCGYIYNDRTPFDKLADNYFCPVCGAPTHKVQTLRANSLQRTRTPPDARKGEGRREPKEGRRSMGENPLPICHPSVRDKLPLAWALEFFNPQKKVLPG

SEQ ID NO: 73032 - DNA, 898 bp, Zea mays
  misc_feature: Ceres CLONE 1557235
  misc_feature: Encodes the peptide sequence at SEQ ID NO. 73033
  misc_feature (312)..(312): n is a, c, t, g, unknown, or other
  misc_feature (415)..(415): n is a, c, t, g, unknown, or other
  misc_feature (437)..(437): n is a, c, t, g, unknown, or other
  misc_feature (804)..(804): n is a, c, t, g, unknown, or other
aaagctggactccccgcggtggcggccgctctagaactagtggatcccccgggctgcaggaattcgtctcacccctagaaaaaaaaacccaagtaggcttgccctcgcggtcgcagctagcgaaccctaatggagatcgctgaggccctgcaggcctacacgggcctcacacccgcggccgccgccaccatcctcgccctcatggtggccacctacctcctcgtctcctccctcttcgtcgcccccgcccccgcccccgccccactttccaagccgccccagcagcagcgcgagggggagaaggcacaggangaagaggaggaagaaccgatgcctttcgtgtatccggaccccgtggaggtgggcgagctcacgctcgagcagctcagtgtgtatgacggccaggacccagccnagcagatcctcaatgccatccngggggccaggtctaccaacgtctcccggcgggaaggctctttttatggccctcaaggaaacaaattccctggtttgcccgggaagggatccaacccggggccctgggattggattgtcattttgacccaaaacaaccccccccgggggaaatgggaacggccttaaccccccaataaaactgggaggggttccaaaaaattggggggaaaaaatttccgggggagagggttccccaagggggggcccccctttctccttttaaaaaacccacaaaaaaaaggggggaaaaaacacccgcggggggtgtctttccccggggaaaagggggggcccccaaaaaacccccccggtgttttgcccccccgncccccccccccccccggggtttttttttttttttttcgcgggggggagacccacccccccaggaaattttatttgggggcccccctcttggggg

SEQ ID NO: 73033 - protein, 157 aa, Zea mays
  misc_feature: Ceres CLONE 1557235
  misc_feature (61)..(61): Xaa is any aa, unknown, or other
  misc_feature (96)..(96): Xaa is any aa, unknown, or other
  misc_feature (103)..(103): Xaa is any aa, unknown, or other
MEIAEALQAYTGLTPAAAATILALMVATYLLVSSLFVAPAPAPAPLSKPPQQQREGEKAQXEEEEEPMPFVYPDPVEVGELTLEQLSVYDGQDPAXQILNAIXGARSTNVSRREGSFYGPQGNKFPGLPGKGSNPGPWDWIVILTQNNPPRGKWERP

SEQ ID NO: 73034 - DNA, 810 bp, Zea mays
  misc_feature: Ceres CLONE 1557238
  misc_feature: Translation starting site: 167
  misc_feature: SWISSPROT Homolog: EC 1.11.1.11 L-ascorbate peroxidase
ctggagctccccgcggtggcggccgctctagaactagtggatcccccgggctgcaggaattcgtctcacccctagaaaaagcccccagcagatcttgtgaccctccctcagccgcgtcgcgtcgcatcctacgatccaaagctctctctggtcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgagattcccttccaccccggtagggaggacaagcctcagcccccacctgagggccgccttcctgatgccactaagggttctgaccacctgaggcaagttttgggcagcagatggggctgagcgatcaggacattgttgccctctctggggggcacacccttggggaggtgcacaaagagcggtcttggtttctaggggggctggactacaaccccttgggtctttgacaactcttaacttcaaggaccttctgagtggggataaggaggggccttcttcagctccaaagtgacaaagccctgctgagtgac

SEQ ID NO: 73035 - DNA, 834 bp, Zea mays
  misc_feature: Ceres CLONE 1557239
  misc_feature: Encodes the peptide sequence at SEQ ID NO. 73036
  misc_feature (784)..(784): n is a, c, t, g, unknown, or other
  misc_feature (785)..(785): n is a, c, t, g, unknown, or other
  misc_feature (799)..(799): n is a, c, t, g, unknown, or other
  misc_feature (834)..(834): n is a, c, t, g, unknown, or other
ggagctccccgcggtggcggccgctctagaactagtggatcccccgggctgcaggaattcgtctcacccctagaaaaaccacacggttcctctctgaccactcctctcctctcctctcgccggcgcatcgcccgactgtcagtcagcctcagccatggccgcggaggaggagcagggcttccgcccgctggacgaggcgtccctgctcgcctacatcaaggccacgccggcgctcgcctcccgcctcggcggcggtggcagtctagactccatcgagatcaaggaggtcggcgacggcaacctcaacttcgtctacatcgtgcagtccgaggccggcgccatcgtcgtcaagcaggcgctcccgtacgtgcgctgcgtgggggactcgtggcccatgacgcgggagcgcgcctacttcgaggcctccacgctgcgggagcacggccgcctgtgcccggagcacacccccgaggtgtaccacttcgaccggaccttgtcgctgatggggatgcgctacatcgagcccccgcacatcatcctccggaagggcctcgtcgccggtgtcgagtacccgctgctcgccgaccacatgtccgattacatggccaagacgctcttcttcacctccctcctctataacaataccacggatcataagaacggaggtgagctgcttcactgctgtttgaattgcttgtcgacttggcaattggctcccagtcgctggtacgtgggcacgtggccatgcctgtaaaggggagatgcgcactaactggacgggatnntgcatggtgtgtgnctgttgtgcagttgctaagtactctgcgaaccgtn

SEQ ID NO: 73036 - protein, 199 aa, Zea mays
  misc_feature: Ceres CLONE 1557239
  misc_feature: SWISSPROT Homolog: EC 2.7.1.100 S-methyl-5-thioribose kinase
MAAEEEQGFRPLDEASLLAYIKATPALASRLGGGGSLDSIEIKEVGDGNLNFVYIVQSEAGAIVVKQALPYVRCVGDSWPMTRERAYFEASTLREHGRLCPEHTPEVYHFDRTLSLMGMRYIEPPHIILRKGLVAGVEYPLLADHMSDYMAKTLFFTSLLYNNTTDHKNGGELLHCCLNCLSTWQLAPSRWYVGTWPCL

SEQ ID NO: 73037 - DNA, 863 bp, Zea mays
  misc_feature: Ceres CLONE 1557240
  misc_feature: Encodes the peptide sequence at SEQ ID NO. 73038
aaagctggagctccccgcggtggcggccgctctagaactagtggatcccccgggctgcaggaattcgtctcacccctagaaaaagccgcgctcctcttcttctacgccgttcactctctctagtctctcccttcccttctccacgcctccgcccccactcgtgagactctacctagccctagcgccagcaccacccgcccaacctcccggagagagagagagagaggaggaggccttcgccgccgccgttgccgtcggccgagacgccaggatgttcgggtaccagaagggcctcgatgtcgaggcggggacatcgggcgccgccgccacgggcggcgcgcgccagctctacccggggatgcaggagagccccgagctgcgctgggcgctcatccgcaagatctacgtcattctctccctccagctgctcctcaccgccgtcgtcgccgcagtcgtcgtcaaggtccgcgccatcccgcacttcttcaccaccaccagcgccggcctcggcctctacatcttcctcatcatcctcccctttatcgtgctgtgcccgttgtacttctaccacgagaagcacccagtcaacctgatcctgctcggcctcttcaccgttgccatcagctttgctgtgggcatgacatgtgccttcaccaggggcaaggtcattctggaatctgcaattctgacaacagtggtcgtgcctcagccttaccgcatacactttctggggccgtgaaataggggcaaagactttcagcttccctgggtccctttcctgttcgcccgccctccaaaggggctgccttgtgtttcgcacctccttcccgaatcctgtttcccactggggcaaagctctccct

SEQ ID NO: 73038 - protein, 155 aa, Zea mays
  misc_feature: Ceres CLONE 1557240
MFGYQKGLDVEAGTSGAAATGGARQLYPGMQESPELRWALIRKIYVILSLQLLLTAVVAAVVVKVRAIPHFFTTTSAGLGLYIFLIILPFIVLCPLYFYHEKHPVNLILLGLFTVAISFAVGMTCAFTRGKVILESAILTTVVVPQPYRIHFLGP

SEQ ID NO: 73039 - DNA, 833 bp, Zea mays
  misc_feature: Ceres CLONE 1557242
ctggagctccccgcggtggcggccgctctagaactagtggatcccccgggctgcaggaattcgtctcacccctagaaaaaagcactgtccggccgcttgtctctctccgcatactgatctgcaatcctcgttcggctacactcggtagctatggtgtcttctggcatgcgagccggagttggagacggagccggttgccgtgtggtggtcttcccgttcccgttcaggggccactatcactcggtgatgcagctggtccgcgcgctgcacttcggtgtctctggatgacgttcattacagcgggcgactggacctggcggactagctggacgatacgctttagtgaccatgacgggggagggaaaccgaaactgctggctttcgagtaacaagacccccttggcttccctttttaaaacccggagtaggggggcccccctgttaggggacccacctttttggggggttgtttttcccgcccaaggggaaggggcccccccctccccgggggggggggttttccccccgcggaatttccaaattggaaaaagggggggggtttttaaaagggggggttctttttaaaaaaaccccggggggggggccctctccccggggtttaaaaaaagggggcccaagaaaaacccctttgggggggggaacaccccaggggggagcaccccccgcctcttattttctcataagggggggcccccccccccggggaaaataaaaggaagagtggggagggggagtttttctcttcttattaaaaaaaaagatctctctccccgcgggagataaataggtaggagagaaaaagagttgggtgg

SEQ ID NO: 73040 - DNA, 790 bp, Zea mays
  misc_feature: Ceres CLONE 1557243
  misc_feature: Encodes the peptide sequence at SEQ ID NO. 73041
  misc_feature (335)..(335): n is a, c, t, g, unknown, or other
ctcaccgcggtggcggccgctctagaactagtggatcccccgggctgcaggaattcgtctcacccctagaaaaaagagcgaacagagcaagcagagcgagcgagctgtccggccaaaccctcacggccgcctccacaatgccgcgccatctcgcgctgctcctgcccctgctcctgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttncgtggcggcgcccgcggcggccggcgggtgggtggcgtggggcctgaacccgacgggcgagggcatggccggcgcgcaggcgctggtggcgctggcgggggccggggccgcggcgcccgccgtgcggacgtacaacatcacggggtacgtcccgctgggcaaggcctccacgccgctggacttcccggcgaccgacctcgccgcggacgccgcgggcggcaagatccgggtgtacggcaagctgcagctgcgcaaggggatgaaggccgtgaaccaggtgtggcaggtcggcgcgtcctccacgggcggcgcccccgacaagcacgcgttccaagcggacaacctcggcgccaagagcaagctcgtcctcgccggcaatgcccccgcggcggccgaagccccctcgcccgtcctcgcgcccgaagctggcggcccgtccgcgcggaaaaaaaggg

SEQ ID NO: 73041 - protein, 130 aa, Zea mays
  misc_feature: Ceres CLONE 1557243
  misc_feature (1)..(114): Pfam Name: DUF568 Pfam Description: Protein of unknown function (DUF568)
MAGAQALVALAGAGAAAPAVRTYNITGYVPLGKASTPLDFPATDLAADAAGGKIRVYGKLQLRKGMKAVNQVWQVGASSTGGAPDKHAFQADNLGAKSKLVLAGNAPAAAEAPSPVLAPEAGGPSARKKR

SEQ ID NO: 73042 - DNA, 895 bp, Zea mays
  misc_feature: Ceres CLONE 1557244
  misc_feature: Encodes the peptide sequence at SEQ ID NO. 73043
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (732)..(732): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (747)..(747): n is a, c, t, g, unknown, or other
taaagctggagctccccgcggtggcggccgctctagaactagtggatcccccgggctgcaggaattcgtctcacccctataaaaagaagtcacttcttcctccctctgcacccccacgagctccatgggcgccaccgccatgattgggattaccaaactacgttgtcggcacgaaccgctctcctcccttcccccggctacgtcgtaggacgcccgggcctgtacgctgcttcctcctctatgccgccgcccctcttcttgctggtcgccttcctcctccgtctctccgtgccggggccgggtgcgaccaacaaaagcactgaagaggatccctgtcgccgacaccggcttcatgggttcagccaacaatgaagacaccacgcttaaacgatcatagtcgggcgaccttcgccgccgccttattgtctccagctccaccgctgggacccgggaacccgccagcggcttttacaggagtgctgcccgccattaatcagggtggcggcaacatcagctcgtgggtcccctggggcattctgctcgcccatgggaaacagttccttcaaggcagggattttcttcgccgcgcgctcatacagattccccaaaggcctttttttgggatggtggtnnngggtccttctttggggggtggaaagttttgaaaaaattttttgccccccccctctccccagagnnnnnnnnnnnnactagtgggtttttttttagtgnannnnnnnnnnnccncccacccgttaccaaagaggggtgggcccttttttaattccccaaaacattgtggggacggtcccctccccccctggggggataatcccccgggctccccggagacccgatttcttgcaaaaaccctttttgggggggccgggtttgc

SEQ ID NO: 73043 - protein, 98 aa, Zea mays
  misc_feature: Ceres CLONE 1557244
  misc_feature (89)..(89): Xaa is any aa, unknown, or other
MKTPRLNDHSRATFAAALLSPAPPLGPGNPPAAFTGVLPAINQGGGNISSWVPWGILLAHGKQFLQGRDFLRRALIQIPQRPFFGMVVXGPSLGGGKF

SEQ ID NO: 73044 - DNA, 764 bp, Zea mays
  misc_feature: Ceres CLONE 1557245
  misc_feature: Encodes the peptide sequence at SEQ ID NO. 73045
ctccccgcggtggcggccgctctagaactagtggatcccccgggctgcaggaattcgtctcacccctagaaaaaaccaccaccactttctcactgaccactgtgccgcggcatgctcaccggacggacacaaggtcgacgaccactaagcatagagaacgacgatggccgcgtcggcgctgcagcagaccatcagcttcctcgggcaggccctggtctcccgccccgccggcgtcgatgccggcggccgcatcaccatgcgccgcaccgtcaagagcgctccccagagcatctggtacggccctgaccgccccaagtaccttgggccgttctccgagcagatgccgtcatacctgacgggcgagttccccggcgactacgggtgggacaccgcggggctctccgcggaccccaagacgttcgcgcgcaaccgggagctggaggtgatccactcccggtgggcgatgctgggcgcgctggggtgcgtgttcccagaggtcctggcgaagaacggcgtcaagttcggcgaagccgtgtgggtcaagggcggcgcagatcttctcggagggcgggctggactacctggggaaacccgaacctggtgcacgcgcagagcatcctgggccatctggccgggctaagtggtggtcaatgggcttcgtccaagggtttggaacggggccccctccaaggaagggtcccaaaagggggtaccccgaaaggggccttttaaaccgcttggggcctcgtcaaaaaatccggaaa

SEQ ID NO: 73045 - protein, 158 aa, Zea mays
  misc_feature: Ceres CLONE 1557245
  misc_feature (59)..(153): Pfam Name: Chloroa_b-bind Pfam Description: Chlorophyll A-B binding protein
MAASALQQTISFLGQALVSRPAGVDAGGRITMRRTVKSAPQSIWYGPDRPKYLGPFSEQMPSYLTGEFPGDYGWDTAGLSADPKTFARNRELEVIHSRWAMLGALGCVFPEVLAKNGVKFGEAVWVKGGADLLGGRAGLPGETRTWCTRRASWAIWPG

SEQ ID NO: 73046 - DNA, 799 bp, Zea mays
  misc_feature: Ceres CLONE 1557246
  misc_feature: Encodes the peptide sequence at SEQ ID NO. 73047
ctccccgcggtggcggccgctctagaactagtggatcccccgggctgcaggaattcgtctcacccctagaaaaagtcacaaggagaccctcctcagccgctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaaccttccggcctaccgcaccgccgtgagcccgctgctgcggggcgtcgaggtcggcctcgcgcacggctacctcctcgtggggcccttcgcgctcacgggcccgctccgcagcacgcccgtgcacggccaggccggcgcgctcggcgccgccggcctcgtcgccatcctcagcgtctgcctcaccatgtacggcgtcgcctccttcaacgagggggacccgtccacggcgccctcgctcacgctcaccggcaggaagaaggaggccgacaagctgcagacctccgacggctgggccaagttcaccgggggattcttcttcggcggcatctccggcgtg

SEQ ID NO: 73047 - protein, 187 aa, Zea mays
  misc_feature: Ceres CLONE 1557246
  misc_feature (44)..(187): Pfam Name: PsaL Pfam Description: Photosystem I reaction centre subunit XI
MASQVMKSSLVVHSRPRGLSGAAALTRRPGRFTVKAIQPEKATYQVVQPINGDPFIGSLETPVTSSPLVAWYLSNLPAYRTAVSPLLRGVEVGLAHGYLLVGPFALTGPLRSTPVHGQAGALGAAGLVAILSVCLTMYGVASFNEGDPSTAPSLTLTGRKKEADKLQTSDGWAKFTGGFFFGGISGV

SEQ ID NO: 73048 - DNA, 707 bp, Zea mays
  misc_feature: Ceres CLONE 1557247
  misc_feature (92)..(92): n is a, c, t, g, unknown, or other
  misc_feature (648)..(648): n is a, c, t, g, unknown, or other
  misc_feature (649)..(649): n is a, c, t, g, unknown, or other
caaaagctggagctcccgcggtggcggccgctctagaactagtggatcccccgggctgcaggaattcgtctcacccctagaaaaatttcgancaacaccgcgcgcgcaatacacgggacacacgcagatccgagctaaccaccgcagatccgagattatccagccggagcgaccttttcttttttcttttacacagcgggacagagaaaggagtcaggcagccaaagccacccaccgcttttaccgatcgggcgttgccgccaccgctagcattgtcggcttcagttcccttcaaatccaccggccagcaagcaaagcccggggcccatggggtcttccccaaatagggggggggaaaggggcccccccggagaggggggaaacttaaaaacctccccccccccggggggttttcccgggggttccccccccccccccccgggggtaaaaaaaaagagaatgtgggggggggggggagagaaaaacatctcctcttggggggggccccccccccacaaaaaaaaaaccgcccggggggggggggagaaaaaaaacccccctcctccccccccgggggaggggggggtgctaaaatttaatttttacggtacgaaaaaaaagagggggagggagggagggaagcagaanntttctctcctcgctagtaagaggggggggggggttggagcctcccccccccccccccc

SEQ ID NO: 73049 - DNA, 742 bp, Zea mays
  misc_feature: Ceres CLONE 1557248
  misc_feature: Encodes the peptide sequence at SEQ ID NO. 73050
  misc_feature (623)..(623): n is a, c, t, g, unknown, or other
ggagctccccgcggtggcggccgctctagaactagtggatcccccgggctgcaggaattcgtctcacccctagaaaaagttacatcggacaagggcatcttgcggtgaagcatctaatctgagcagtcagtcgtccccccgctcgcggccgggctactgctggtcgtcaagtactcaagttgtaggcgtgcagccggggcgccggccgctagctgctgtcagcacgcgcacacagcagcagggtggtcgcccgcggccggtagccggcacgcggtcgcgacaagccgatagcaacagcaagccaggcccaagttcagtccccagagagcggcaaggtctgtcatcttctctggagggttcagaaccaccgagaattagctgtctttgaggagtacaataggaatggatgatgctcaagggtatcaagaaggagatgatcatgagttagtgctgaagaaacaagaatggatcaaaacacaagacatgctcaagagtaaacttattcttgaagatgaatttgcctggagtttaccttcggtgggctcaggtttagatgaacctgagtggtgcaaactgaagtatattggtgggactgacatcagcttcttgaaagaagacccatncacagcatgtgccgcgggtggtagtcctcaatgccgatactttagaaagtgtccatgaagagttcaatgtttgtccgactgcaagtgccatataatccctggtttccttgcatccagaa

SEQ ID NO: 73050 - protein, 92 aa, Zea mays
  misc_feature: Ceres CLONE 1557248
  misc_feature (74)..(74): Xaa is any aa, unknown, or other
MDDAQGYQEGDDHELVLKKQEWIKTQDMLKSKLILEDEFAWSLPSVGSGLDEPEWCKLKYIGGTDISFLKEDPXTACAAGGSPQCRYFRKCP

SEQ ID NO: 73051 - DNA, 767 bp, Zea mays
  misc_feature: Ceres CLONE 1557250
  misc_feature: SWISSPROT Homolog: EC 5.3.4.1 Protein disulfide-isomerase
  misc_feature (518)..(518): n is a, c, t, g, unknown, or other
ggagctccccgcggtggcggccgctctagaactagtggatcccccgggctgcaggaattcgtctcacccctagaaaaaggcaaccattccttcaagtgttgtggttctcaccccagagacctttgactcaattgtccttgatgaaaccaaagatgtccttgttgagttctatgccccatggtgtggtcactgcaagagtcttgcaccgacgtatgagaaggtggcttctgttttcaagttggatgaaggagttgttattgctaaccttgacgctgacaaacacagggatttggctgagaagtatggagttagtggatttcctaccttgaagtttttcccaaagggaaacaaagctggtgaagattatgatggtgatagggacttggttgactttgtcaagttcattaacgagaagagtggtaccagccgtgacacaaagggtcaactaacctcagaggctggccgtatagcaagtctggatgtcctggctaaggaagtccttggtgcttccggtgacnagcgaaaggaagtcctctccagtatgggaagaggaagcagataagctcagtgggttctgctgcaaagcatgggaaaaggctattgttacccttcccaaaagaaaaatccttaaagaaaaggcaacccagttttcctggaaaaaggaaaaccaagaaagcttttgatcccccctgttttgggaaaaaaaacaactataccccccccccaagggggcaaaagagtttttttctcccaaaaaaacaaccttt

SEQ ID NO: 73052 - DNA, 864 bp, Zea mays
  misc_feature: Ceres CLONE 1557251
  misc_feature: Encodes the peptide sequence at SEQ ID NO. 73053
aagctggagctccccgcggtggcggccgctctagaactagtggatcccccgggctgcaggaattcgtctcacccctagaaaaaatcgcgccgggacacgggagacaatggcgttcacgacgctcggcggctgtggggcgcaggcttcagtgcggttggctccccagaatggaatccttggatctaattcgaagccattcgcgggcatcatactcaagaaacctcagcaggttggatccctgcccctccgtgcaaggggatccattttttcttcaccacgcaggcttttctcccctaaggcagcagcccctaaatcaggggattccatacgcattgcagtgctaggggccagcggttatactggagctgagattgttcggattctagctaaccaccctcagtttcacacaaaagtgatgactgcagatagaaaagctggcgagcaatttggatcagtatttcctcacttgataacacaggacctgccgagactggtcgcaataaaagaccctgacttttcagatgttgatgctgttttttgctgcttgccacatggtacaccccgggaaatatcaaaagcttaccccgacacttaaagattgttgatttctcagcggacttccgactacgcaacattaatgaagatgcttagggggaatggacattccccccggggcacccgaaccttcaggggggaaactttgttttggttttgccccaaccttaacccggaatgacctaaaaaaatgccccccctgggaagcaaaaaaccaggggggttttccccacaaattttataaaactccggctctggttcccttttggggaaaagggcaaaaactctgttttagagcttaaaccacat

SEQ ID NO: 73053 - protein, 162 aa, Zea mays
  misc_feature: Ceres CLONE 1557251
  misc_feature (75)..(158): Pfam Name: Semialdhyde_dh Pfam Description: Semialdehyde dehydrogenase, NAD binding domain
  misc_feature: SWISSPROT Homolog: EC 1.2.1.38 N-acetyl-gamma-glutamyl-phosphate reductase
MAFTTLGGCGAQASVRLAPQNGILGSNSKPFAGIILKKPQQVGSLPLRARGSIFSSPRRLFSPKAAAPKSGDSIRIAVLGASGYTGAEIVRILANHPQFHTKVMTADRKAGEQFGSVFPHLITQDLPRLVAIKDPDFSDVDAVFCCLPHGTPREISKAYPDT

SEQ ID NO: 73054 - DNA, 815 bp, Zea mays
  misc_feature: Ceres CLONE 1557255
  misc_feature: Encodes the peptide sequence at SEQ ID NO. 73055
  misc_feature (638)..(638): n is a, c, t, g, unknown, or other
  misc_feature (639)..(639): n is a, c, t, g, unknown, or other
  misc_feature (641)..(641): n is a, c, t, g, unknown, or other
  misc_feature (647)..(647): n is a, c, t, g, unknown, or other
  misc_feature (731)..(731): n is a, c, t, g, unknown, or other
ggagctccccgcggtggcggccgctctagaactagtggatcccccgggctgcaggaattcgtctcacccctagaaaaaacccactccagaaaacctcacaaaaaccctcgctccccacaacccgccgccgcccacgccgccgcctgtaccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgttggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaacttggatgggatggacttctcgaattttggcggtatgggtggtatgggtggcatgggtgatatggctggcttgggtggtcttggtggcatgggtggaatggcgatgggggggggattgggaaatgnntntttttngggaggttggggtggggaaaaattgtgaaaactaaagtggggggaaatgttggggagggcaaaaaaattgaagggggggaaggnaaaaatgggttggggtttaaagggtggaaaaagcttaaaaaatgagaaaaaattttttttgggggaaaaaaaaataaagggaga

SEQ ID NO: 73055 - protein, 170 aa, Zea mays
  misc_feature: Ceres CLONE 1557255
  misc_feature (5)..(79): Pfam Name: CS Pfam Description: CS domain
  misc_feature: SWISSPROT Homolog: EC 5.3.99.3 Prostaglandin-E synthase
  misc_feature (159)..(159): Xaa is any aa, unknown, or other
  misc_feature (160)..(160): Xaa is any aa, unknown, or other
  misc_feature (162)..(162): Xaa is any aa, unknown, or other
MSRHPEVKWAQRIDKVYITVQLPDAKDAKVNLEPDGVFTFSGSVGTNLYELKLDLNDKVNVEASKISVGVRSIFCIVEKAEAKWWKKLVRDDQRAPHFVKVDWDKWVDEDDDGADVNLDGMDFSNFGGMGGMGGMGDMAGLGGLGGMGGMAMGGGLGNXXFXGGWGGEKL

SEQ ID NO: 73056 - DNA, 815 bp, Zea mays
  misc_feature: Ceres CLONE 1557256
  misc_feature: Encodes the peptide sequence at SEQ ID NO. 73057
ctccccgcggtggcggccgctctagaactagtggatcccccgggctgcaggaattcgtctcacccctagaaaaatcccacacactccacagcgcccgcgcaggctcgctgcaagcgcaaagcagccacagcaccccctgcacctgcagactgcaaccgcaatgtcggctctcgggacgctctccggcggcgctgccggtgtctccggcctcctccgcctccgccgccgggccgccccagcccccgcgatcgcggcgccgtcgcacctccccgctgggaccgtcaagtgcgcggccgccgtgcccgatgccgccccgatcgtctggggccgtcagctccgcccggcgctcctcctacccgcggcgctgctcccttcgttgcagcccgccaggaggcacacgctgcagccgcccgccgcagccgccgagtccgcaggggaggccaagtctgtgggtttcctggagaagtacccggccctggtcaccggcttcttcttcttcatgtggtacttcctcaacgtcatattcaacatcctcaacaagaagatctacaactacttcccatacccatactttgtgtccttgatccatctagtagtgggtgtcgtatactgcctcatcagctggagtgtcggtctccccaagcgagcgcctatcaatggcacgctcctcaagcttctcttccagtccccctggggccatggaattgtccaatcacctagcaggggccctttcccgccggtggaaccccatttgcccaacaataaaagcctgggaacccttttttagggaaggggatacaattttcccttggaaa

SEQ ID NO: 73057 - protein, 208 aa, Zea mays
  misc_feature: Ceres CLONE 1557256
MSALGTLSGGAAGVSGLLRLRRRAAPAPAIAAPSHLPAGTVKCAAAVPDAAPIVWGRQLRPALLLPAALLPSLQPARRHTLQPPAAAAESAGEAKSVGFLEKYPALVTGFFFFMWYFLNVIFNILNKKIYNYFPYPYFVSLIHLVVGVVYCLISWSVGLPKRAPINGTLLKLLFQSPWGHGIVQSPSRGPFPPVEPHLPNNKSLGTLF

SEQ ID NO: 73058 - DNA, 813 bp, Zea mays
  misc_feature: Ceres CLONE 1557260
  misc_feature: Encodes the peptide sequence at SEQ ID NO. 73059
ctccccgcggtggcggccgctctagaactagtggatcccccgggctgcaggaattcgtctcacccctagaaaaaatccgctccccgccttccgcttccctaccccccgcatcacctaccaacgccgacaccatgggggccttcgcgaaggaggagcaccagttcctcgccgagctcggcctcgcgcagcgcaacccgggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgacgccgctaagacatggatggcgattcctgctccaaagcgaggagagatcgttaggcaaatcggtgatgcactgagagcaaagctccatcaccttggcaggcttgtgtcacttgagatggggaaaattcttcctgaagggatcggtgaggttcaggaaatcattgacatgtgtgattatgctgtgggactaagtcgcccccttaaatggatccctttaaccccttcgaaccacccaccccctttgtggttgggggggggggaacccccccttggaaatgtggggggggttaaaaaggcgccattaaaattccccccttgggcccgggcctctggggggagaaaaactcttcccctttttttctttggggccgcgggggaaaaaaaatttttgtccccccccgggggaaagaggggggtgtgtccacaaaaaaaacccccccgcgggggggtaaaatatttttgtggggagagaaaaaaaa

SEQ ID NO: 73059 - protein, 227 aa, Zea mays
  misc_feature: Ceres CLONE 1557260
  misc_feature: SWISSPROT Homolog: EC 1.2.1.3 Aldehyde dehydrogenase (NAD(+))
MGAFAKEEHQFLAELGLAQRNPGAFACGAWGGSGPTVTSTSPTNNQVIAEVVEASVHDYEEGMRACFDAAKTWMAIPAPKRGEIVRQIGDALRAKLHHLGRLVSLEMGKILPEGIGEVQEIIDMCDYAVGLSRPLKWIPLTPSNHPPPLWLGGGEPPLGNVGGVKKAPLKFPPWARASGGRKTLPLFFFGAAGEKKFLSPPGGKRGVCPQKKPPRGGVKYFCGERKK

SEQ ID NO: 73060 - DNA, 891 bp, Zea mays
  misc_feature: Ceres CLONE 1557262
  misc_feature: Encodes the peptide sequence at SEQ ID NO. 73061
gcggtggcggccgctctagaactagtggatcccccgggctgcaggaattcgtctcacccctagaaaaaattggcaagggtttagggcgcagcagaatctggtgtctcttgctccgaccccgttggcgactgagacgcgatccccttctcctgcactgccgtcctccgtcgctgcgatgcctcggtattactgtgactactgcgacacctacctgacccatgactcgccatctgtccggaaacaacataatgctggatacaaacacaaggcgaatgttcgaacctactatcagcaatttgaggagcagcaaactcaaagtttaattgatcaaagaatcaaggagcatcttggacaagctgcagctttccaagcaggtgcccctttcaaccaacatctgcttgcattcccaggagctatggcccgccctcgtcttccaattctgccaacccctggcatgcctcatgggtttcctcaagcacctggcgcaccattgatgccaggaattaggcccccgattttaccagctccaggttatcctggtcctccaccaaccatgcagcaaccaggcgccccacctgggtccatgccacaaccgggcgctccacctggttccatgccacaaccaggcactccacctggttccatgccaaatggcaagatggcccccactccaaaggccttccagggctacccacctcccaaatctgggaatccccagggggcctccccattccctaacagtgggaggcacctgccaggccaattacccagagcataattctcacgaggcattctggcgagggcccaaactttcttggggggcatccgttcaggaataccaacgcgaatctgaattccaaccaacatcagggcaggttcatccactttagt

SEQ ID NO: 73061 - protein, 200 aa, Zea mays
  misc_feature: Ceres CLONE 1557262
  misc_feature (1)..(38): Pfam Name: zf-U1 Pfam Description: U1 zinc finger
MPRYYCDYCDTYLTHDSPSVRKQHNAGYKHKANVRTYYQQFEEQQTQSLIDQRIKEHLGQAAAFQAGAPFNQHLLAFPGAMARPRLPILPTPGMPHGFPQAPGAPLMPGIRPPILPAPGYPGPPPTMQQPGAPPGSMPQPGAPPGSMPQPGTPPGSMPNGKMAPTPKAFQGYPPPKSGNPQGASPFPNSGRHLPGQLPRA

SEQ ID NO: 73062 - DNA, 726 bp, Zea mays
  misc_feature: Ceres CLONE 1557268
  misc_feature: Translation starting site: 173
ctccccgcggtggcggccgctctagaactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccgggcgggcacgtgaacccctgcgtgaccttcggcggccttctgggggggaacatcaccctgtttccggggctcctgtactgggtggggcaactgctgggggtccccccggggggggggtttccgggtccccttttccaaaggggggggggggcccggggccccttcgggtttaaaggggtttttcttgttgggaagggcccttgctctcggaaaaacgaaaaacccttccgggggggggggtaccccgggggacccccccccgggggggggcccccaaaaaaaggggggccccgtggggaccactccccccccc

SEQ ID NO: 73063 - DNA, 837 bp, Zea mays
  misc_feature: Ceres CLONE 1557270
  misc_feature: Encodes the peptide sequence at SEQ ID NO. 73064
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (337)..(337): n is a, c, t, g, unknown, or other
ctccccgcggtggcggccgctctagaactagtggatcccccgggctgcaggaattcgtctcacccctagaaaaaattcccaagcaaacagccaaacacacgcgaagaaaaggagatagagtacaggttacagagaggcagagagcaaagatgtgtggtggtgcgatcctcgccgagctcatcccgactacgccggcccgccgcggcggcgcggcgtggcccgccggcaagtgcaagcggcggaaggcggacgacttcgaggccgcgttccgggagttcgacgaggactccgaggaggaggaggaggaggacgagggggtggtggagagnnngcccgncttcgtcgtccgcgcctcgtccgcggcgacgcagcccagggcgcgccaggagcaccccatccggcgccgggcgcccgaccagcagtacaggggcgtccggcgccgcccgtggggcaagtgggccgccgagatccgcgaccccgtcaagggcgtccgcgtctggctcggcaccttcgcctccgccgaggccgccgcgcgcgcctacgaccacgccgcgcgccacatccgcgggcccaggggcaagcgcaacttcccctcctcctccgcctacgccgacggggccccttccagccggcagcgcgcccgcgccgcccacgccgtcatcggacttcaggaaagagaccgccgcccggccgttgctgcccttgaaccccaagccgccaaattgttacgaaatcgaacggctcccaggaattgttctaggcaagggcggagtcggccggccaacgacaaggcccccgagcctcggaccggacttcaacgttcgaggggcgggccgg

SEQ ID NO: 73064 - protein, 229 aa, Zea mays
  misc_feature: Ceres CLONE 1557270
  misc_feature (90)..(141): Pfam Name: AP2 Pfam Description: AP2 domain
  misc_feature (60)..(60): Xaa is any aa, unknown, or other
  misc_feature (61)..(61): Xaa is any aa, unknown, or other
  misc_feature (63)..(63): Xaa is any aa, unknown, or other
MCGGAILAELIPTTPARRGGAAWPAGKCKRRKADDFEAAFREFDEDSEEEEEEDEGVVEXXPXFVVRASSAATQPRARQEHPIRRRAPDQQYRGVRRRPWGKWAAEIRDPVKGVRVWLGTFASAEAAARAYDHAARHIRGPRGKRNFPSSSAYADGAPSSRQRARAAHAVIGLQERDRRPAVAALEPQAAKLLRNRTAPRNCSRQGRSRPANDKAPEPRTGLQRSRGGP

SEQ ID NO: 73065 - DNA, 788 bp, Zea mays
  misc_feature: Ceres CLONE 1557271
  misc_feature: Encodes the peptide sequence at SEQ ID NO. 73066
  misc_feature (647)..(647): n is a, c, t, g, unknown, or other
  misc_feature (652)..(652): n is a, c, t, g, unknown, or other
  misc_feature (788)..(788): n is a, c, t, g, unknown, or other
ctggagctccccgcggtggcggccgctctagaactagtggatcccccgggctgcaggaattcgtctcacccctagaaaaaaacacagcaagtcccgaccttgcctcctactgcagcagcagcataaccagaggggagtgcagcaagccgtttcgagagacagctttaggctactgctagcagtatggcttccgctgcgcgcttcctggtggccgtggtcgtggcgtgtgcactcctggccagcaacaactgccatgcggcgcgccacttggccgacacggccgcggctcccgctgctgctggtgtcgtccctggcctccccgccgtgccgaccttgccaacggtgcagccagtgccggcgctgccacctatgccggccgtgcccgcggtcaccgtgccgcagatgacgctgccgcccatgccagcggctcccaaggtggccgtgccgctgccgctgccgccaatgcccgccatcccatccgtgctgcccaagctgaccctaccaccgatgcccactgtcgttccaaccgtcgtccccaaagtggccttgccgccgatgccgtcggtcccgaacgtgaacgtgcccatgccgttcgcggcaccgcctccatcggcgtagacacatgtgctcctgccaggtttgcgttncgcgntggccacgccatggcacaggtggtgcggttgaccggcgtacgcgagagtcatgtcatttgtttgtgagtacctctttgtaccgtgcgtcgcgtggctttcttttttgtggtactattggtacctacgttatgtatn

SEQ ID NO: 73066 - protein, 144 aa, Zea mays
  misc_feature: Ceres CLONE 1557271
MASAARFLVAVVVACALLASNNCHAARHLADTAAAPAAAGVVPGLPAVPTLPTVQPVPALPPMPAVPAVTVPQMTLPPMPAAPKVAVPLPLPPMPAIPSVLPKLTLPPMPTVVPTVVPKVALPPMPSVPNVNVPMPFAAPPPSA

SEQ ID NO: 73067 - DNA, 836 bp, Zea mays
  misc_feature: Ceres CLONE 1557273
  misc_feature: Translation starting site: 180
  misc_feature (596)..(596): n is a, c, t, g, unknown, or other
  misc_feature (597)..(597): n is a, c, t, g, unknown, or other
aaagctggagctccccgcggtggcggccgctctagaactagtggatcccccgggctgcaggaattcgtctcacccctagaaaaaaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccaccgtggcgtgcttcctgctccgcttctcgacgggcgggcaggccacgggcaccttcgggctgacgggcgtgtcnngtgtgggaggcgctggtgctggagatcgtgatgaccttcgggctggtgtacacggtgtacgccacggcggtggacccgaagaagggcagcctgggcaccatcgcccccattgccatcggcttcatcgtggggcaacatcccgggggtggggcggcgcctttcgacggcgcggtcatggaacccccgccgtgtccttcggccccgccctcgttcaagctggggagtgggggctacaagtg

SEQ ID NO: 73068 - DNA, 870 bp, Zea mays
  misc_feature: Ceres CLONE 1557282
  misc_feature: Encodes the peptide sequence at SEQ ID NO. 73069
ctccccgcggtggcggccgctctagaactagtggatcccccgggctgcaggaattcgtctcacccctagaaaaaattcatcccagcggaagagcaccaagcttctctagcagcatatacgcatccacccactggaaacagaccaaccctaccctaccctgcagcgcgcgcagagggggaaaggagctccagcaaaaagtttgtccagctcctcctcctactacagcgctagaaggatctgatcatcgagcagcatggcgcggcggccgcagcccatgcccaacctggtgcccacgctcctcctgctcctcgtcgtcgtcgtggccgccgccgcggcggtcgtgagagccgacgacgacgagaagtgcagcaacccgtgcgggaacccctgccgcgagccgtgcgtgtacgccagcccgccgccgccgcccgtgtactcgcccccgcccccgccgccgacgcccgagtactacccgccggcgaccccgaccccgaccacgccctactgcccgccgccgccgtcgggcggcggcggctacgagccgtcgcccgggtacacgccgtcgacgccctacacgcccggctacaaccccacgccctccgggtccggctggtacgcgccgccctacacgccgccgtccgcagggacgctgtacccgcaggaccccgggttccgggccaacggcgcgccgcgggggcgccgcggaccctctttttccttcgccgccggcggggggcttgcggcctgctttcgggtttgtttgggacccgaccgaaccgggacgggattggaagggcccgccaaatccccgccccgtaccggtaacggtaaacgggaacccgaacggaaccttgtggcccccgttcgtgg

SEQ ID NO: 73069 - protein, 205 aa, Zea mays
  misc_feature: Ceres CLONE 1557282
MARRPQPMPNLVPTLLLLLVVVVAAAAAVVRADDDEKCSNPCGNPCREPCVYASPPPPPVYSPPPPPPTPEYYPPATPTPTTPYCPPPPSGGGGYEPSPGYTPSTPYTPGYNPTPSGSGWYAPPYTPPSAGTLYPQDPGFRANGAPRGRRGPSFSFAAGGGLAACFRVCLGPDRTGTGLEGPAKSPPRTGNGKREPERNLVAPVR

SEQ ID NO: 73070 - DNA, 709 bp, Zea mays
  misc_feature: Ceres CLONE 1557283
  misc_feature: Encodes the peptide sequence at SEQ ID NO. 73071
  misc_feature (414)..(414): n is a, c, t, g, unknown, or other
  misc_feature (646)..(646): n is a, c, t, g, unknown, or other
ctcaccgcggtggcggccgctctagaactagtggatcccccgggctgcaggaattcgtctcacccctagaaaaacctccgctctcctctcccacctcaaatcccagacgccacgccacccaacacatacaaacacacgcacgcgcgcgcgcgcgcctcccgctgttccgcaaaacaaaggaaacgaaggagaggaggccatggcgccgagaacgtcagagaaaaccatggcaccggcggcggccgctgccacggggctcgcgctcagcgtcggcggcggcggcggggccggcggcccgcactacagaggcgtgaggaagcggccgtggggccggtacgcggcggagatccgcgacccggcgaagaagagccgggtgtggctcggcacctacgacacggccgaagacgccgcgcnggggcctaactaagccccccccggccccaagttaccccgggggccccaagggccaaaaaaaaaaatttcccctttcccccctgggggggggcccccccttcccccaaaaaggggggtggccgggaaaaaaaaaaaaaaaaaaaccccccggggaaagaaacctcttttaaaaaaaaaaaaacccaaggggggccccccttggggggaaggaggggccctccccccccccggntttaaaaaaaaggaggaagaagtttttttcccccccccccgcgggggggggggggcgcgcccc

SEQ ID NO: 73071 - protein, 75 aa, Zea mays
  misc_feature: Ceres CLONE 1557283
  misc_feature (33)..(74): Pfam Name: AP2 Pfam Description: AP2 domain
  misc_feature (72)..(72): Xaa is any aa, unknown, or other
MAPRTSEKTMAPAAAAATGLALSVGGGGGAGGPHYRGVRKRPWGRYAAEIRDPAKKSRVWLGTYDTAEDAAXGPN

SEQ ID NO: 73072 - DNA, 836 bp, Zea mays
  misc_feature: Ceres CLONE 1557284
  misc_feature: Encodes the peptide sequence at SEQ ID NO. 73073
  misc_feature (521)..(521): n is a, c, t, g, unknown, or other
  misc_feature (647)..(647): n is a, c, t, g, unknown, or other
ctccccgcggtggcggccgctctagaactagtggatcccccgggctgcaggaattcgtctcaccccctagaaaaacgggcgcgccgcacaaggttcgatccgccggctccggtggcgcacccagatcagatccccctttcgctggtttctttccccttggccaagcccaaaccgtctttaaatacacccgtcgtcgtccgcatcccccgcctgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaagagaaccgccgtgccctccgtgagctcctattctgttgccctggtgctctccagtacatcagcggtgtgatcctcttcgaggagaccctgtnacagaagaccaaggatggcaagccttttgttgatgtcctcaaggagggaggcgtcctccctggcatcaaggttgacaagggtaccattgaggttgttggcactgataaggagaccacacccaaggncatgacgaccttggcagcgctgcgccagtactacgaggcaagtgcccgcttttgcaagtggcgcgctgttctcaagattgccctaatgagccatcacagcttggcatcggactgaaacgctcagggtctgggtcgctacgccatcatctgccaagagaaagggctgggggccaattggtgagcctgaga

SEQ ID NO: 73073 - protein, 159 aa, Zea mays
  misc_feature: Ceres CLONE 1557284
  misc_feature (11)..(160): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (80)..(80): Xaa is any aa, unknown, or other
  misc_feature (122)..(122): Xaa is any aa, unknown, or other
MSAYCGKYKDELIKNAAYIGTPGKGILAADESTGTIGKRLSSINVENVEENRRALRELLFCCPGALQYISGVILFEETLXQKTKDGKPFVDVLKEGGVLPGIKVDKGTIEVVGTDKETTPKXMTTLAALRQYYEASARFCKWRAVLKIALMSHHSLASD

SEQ ID NO: 73074 - DNA, 877 bp, Zea mays
  misc_feature: Ceres CLONE 1557287
  misc_feature: Encodes the peptide sequence at SEQ ID NO. 73075
  misc_feature (877)..(877): n is a, c, t, g, unknown, or other
ctccccgcggtggcggccgctctagaatagtggatcccccgggctgcaggaattcgtctcacccctagaaaaagccgcctcctccccactgcctcgtgtggccgtcgtctcccgttcggaacgccaagcccccctccggcgaaatggcccccaagcgaggtggcagggcgccggtgccggccaagaagaagacggataaagtgacgaaccctctgtttgagaagaggccgaagcagttcggcatcggcggcgcgttgccgcccaagaaggacctgcaccggttcgtcaagtggcccaaggtcgtgcgtatccagcgccagcgccgcatcctcaagcagcgcctcaaggtaccaccggcgctcaaccagttcacccgcaccctcgacaagaacctcgctacgaacctggtttaagatgcttctcaagtaccggcctgaagacaaaggctgccaaagaaggagaagctttcctgaagagggccccaagcctgagaattgaaggaaaaaactgttgaagtccaaagaaaaccaatttgttgttgaaagtatgggccctttaaccatggtggacttttccctcatttggagccaaaaaaaagggcctcaacctttgtttggccatccgccccatggaagtgggattcccaattggaaacggggttgtgggggggcttccacaccccctgtgccaaaaaaaaaaaggaaggcccccttttccggattttttttaaaaaaaaaagggcccccccctggaaaaaccaatgtttcccaaaaaaaagaaaagtgccctctccctttggggttccaccccacttgtttaaaaaaaaagaaaaaaaaaccttttgggtctccccacaagatacttgggggggggttan

SEQ ID NO: 73075 - protein, 89 aa, Zea mays
  misc_feature: Ceres CLONE 1557287
MAPKRGGRAPVPAKKKTDKVTNPLFEKRPKQFGIGGALPPKKDLHRFVKWPKVVRIQRQRRILKQRLKVPPALNQFTRTLDKNLATNLV

SEQ ID NO: 73076 - DNA, 889 bp, Zea mays
  misc_feature: Ceres CLONE 1557288
  misc_feature: Encodes the peptide sequence at SEQ ID NO. 73077
  misc_feature (590)..(590): n is a, c, t, g, unknown, or other
  misc_feature (598)..(598): n is a, c, t, g, unknown, or other
ctccccgcggtggcggccgctctagaactagtggatcccccgggctgcaggaattcgtctcacccctagaaaaatagaaaactgaaggggaagaaggtgttcgtgcgcgccgacctcaacgtcccgctcgacgatgcccagaagatcaccgacgacacccgcatccgcgcctccgtccccaccatcaagttccccctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaagaagttgagaagttggctgccgctttgccagaaggtggagttctgctcctagagaatgttagattctacaaggaggaagagaagaacgaacctgagtttgctaagaagctagcatctgttgctgacctttatgtcaatgatgcttttggcacggcacacagagctcatgcttcaaccgaaggagttaccaagtatttgaagcctgctgttgccggcttcctcatgcagaaggaacttgactaccttgntggagctngtgcccaaccaaagaaagccatttgccgctattgttgggtggatccaaggtctccagtaagaatggtgtccaatgagtccttggctggcgaaggtcgaatatctcattcctggggggtggggatgaatccaccctttttaccagggcacaaggatatttcggttggaaaaattctcccgtggaaaaaggaaaaacttgagctccccaactttcctttttttggaaaaggccaagcgcaaaggggggttttctccttttgccttccccccggaatattgtgtttaggcggga

SEQ ID NO: 73077 - protein, 190 aa, Zea mays
  misc_feature: Ceres CLONE 1557288
  misc_feature (1)..(188): Pfam Name: PGK Pfam Description: Phosphoglycerate kinase
  misc_feature: SWISSPROT Homolog: EC 2.7.2.3 Phosphoglycerate kinase
  misc_feature (91)..(91): Xaa is any aa, unknown, or other
  misc_feature (94)..(94): Xaa is any aa, unknown, or other
MANDCIGEEVEKLAAALPEGGVLLLENVRFYKEEEKNEPEFAKKLASVADLYVNDAFGTAHRAHASTEGVTKYLKPAVAGFLMQKELDYLXGAXAQPKKAICRYCWVDPRSPVRMVSNESLAGEGRISHSWGVGMNPPFLPGHKDISVGKILPWKKEKLELPNFPFFGKGQAQRGVFSFCLPPGILCLGG

SEQ ID NO: 73078 - DNA, 831 bp, Zea mays
  misc_feature: Ceres CLONE 1557292
  misc_feature: Encodes the peptide sequence at SEQ ID NO. 73079
  misc_feature (815)..(815): n is a, c, t, g, unknown, or other
ctccccgcggtggcggccgctctagaactagtggatcccccgggctgcaggaattcgtctcacccctagaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcagagtggatgcccggccagccacgccctgcccacctcgacggctcctctcccggggacttcagcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcacgagtgggcggccgtccccggcgggcaggccacgtacctgggcgccccagtgccatgtggcacgctgccgaccatcctggtgatcgagttcgtggccatcgccttcgccgagcaccagcgcaccatggagaatgaccccgagaagaagaggtaccccggcggcgccttcgacccgctcggcttgctcaaggaccccgcctagttcgaggagtacaagctcaaggagatcaagaactgccgcctcgccattgctggccatcgtcgggcttctgcgtccagcagtcggcgtacccccgcaccggcccgctgggagacctcgtcttccacctcgncgaccccgtgagacaa

SEQ ID NO: 73079 - protein, 183 aa, Zea mays
  misc_feature: Ceres CLONE 1557292
  misc_feature (54)..(184): Pfam Name: Chloroa_b-bind Pfam Description: Chlorophyll A-B binding protein
MVMASSSGLRSCSAVGVPSLLAPSSRSGRLAPFCANATTSGRVTMSAEWMPGQPRPAHLDGSSPGDFSFDPLGLATVPENFERFKESEVYHCRWAMLAVPGILVPEALGLGNWVKAHEWAAVPGGQATYLGAPVPCGTLPTILVIEFVAIAFAEHQRTMENDPEKKRYPGGAFDPLGLLKDPA

SEQ ID NO: 73080 - DNA, 861 bp, Zea mays
  misc_feature: Ceres CLONE 1557297
  misc_feature: Encodes the peptide sequence at SEQ ID NO. 73081
ctggagctccccgcggtggcggccgctctagaactagtggatcccccgggctgcaggaattcgtctcacccctagaaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgctaagaaccgggagctggaggtcatccactcccgctgggccatgctgggcgcgttgggctgcgtgtttccggagctgctcgcccgcacggcgtcaagttcggcgaggccgtgtggttcaagccgggtcgcagatcttcagcgagggtgggctgggactactccggcacccgaagctgatcccgcgcagagcatcctcgccatctgggccttgcaggtcctgctcatgggccccatcgaggggggaccccgttccccgggggccgcttcggaaaaggtgttgaacccgttttacccgggggggaattttaaaccgtttgggcctcccaaaaaactttgaggcctttgggggaccccagggggagggacctcaaaaacggcccccccccccaggttcccaagtgtcgggtttttttcccgggcaattttcccgggaaggggcccctc

SEQ ID NO: 73081 - protein, 203 aa, Zea mays
  misc_feature: Ceres CLONE 1557297
  misc_feature (64)..(203): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARTASSSARPCGSSRVADLQRGWAGTTPAPEADPAQSILAIWALQVLLMGPIEGGPRSPGAASEKVLNPFYPGGNFKPFGPPKKL

SEQ ID NO: 73082 - DNA, 880 bp, Zea mays
  misc_feature: Ceres CLONE 1557299
  misc_feature: Encodes the peptide sequence at SEQ ID NO. 73083
  misc_feature (400)..(400): n is a, c, t, g, unknown, or other
tggagctccccgcggtggcggccgctctagaactagtggatcccccgggctgcaggaattcgtctcacccctagaaaaaagcgcgagtggtggcacccacgcatactcttctcccccccagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggaagccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaancccaaggcgagcacggagtacatcgcgtacagcggcgacggcttcaagctgctgatcccgtccaagtggaaccccagcaaggagcgggagttccccgggcaggtgctccgctacgaggacaacttcgacgccaacagcaacgtgtccgtcatcatccagccccacgtcccaagaagaccatcgccgactacggctcttcccgaggagttcctcttccaaggtcgactaccctgctcggcaggcaggccttacggcgggcaaaaccgaactcccaggggcgggtttccagaacccgcgcctgtggccacccgccaaacgtcctgggagagcttccatccccccgtgatcgaaccggcaagcagttactacgcccgggttcccgggcttccccaagaaccgcgtgggcgggctaacaaagggcgggcaagcaaccaacttcattctccgggcccccgtttttccgaaggggaaggtgtctac

SEQ ID NO: 73083 - protein, 245 aa, Zea mays
  misc_feature: Ceres CLONE 1557299
  misc_feature (57)..(245): Pfam Name: PsbP Pfam Description: PsbP
  misc_feature (85)..(85): Xaa is any aa, unknown, or other
MASTSCCLLHQSTARLGASPRLAAAPPRSAQLLVCKARKQEAAADQSDVSRRAALALLAGVTAAAGAKVGPAAAAYGEAANVFGXPKASTEYIAYSGDGFKLLIPSKWNPSKEREFPGQVLRYEDNFDANSNVSVIIQPHVPRRPSPTTALPEEFLFQGRLPCSAGRPYGGQNRTPRGGFPEPAPVATRQTSWESFHPPVIEPASSYYARVPGLPQEPRGRANKGRASNQLHSPGPRFSEGEGVY

SEQ ID NO: 73084 - DNA, 767 bp, Zea mays
  misc_feature: Ceres CLONE 1557300
  misc_feature: Encodes the peptide sequence at SEQ ID NO. 73085
  misc_feature (474)..(474): n is a, c, t, g, unknown, or other
  misc_feature (523)..(523): n is a, c, t, g, unknown, or other
ctccccgcggtggcggccgctctagaactagtggatcccccgggctgcaggaattcgtctcacccctagaaaaaaaggctgccgcgcgcatcgtcatcactagtcagtcgaggtcgaggggcggacgaggagctgaggagagagaagcttcacggagcttgcttgggagttggggacttggggacttgggggttgccgagctgtccgtctttcccagtttcccctcccctctacccaccagctacctcgggagggcaaggcaaacatctgcggcctcctttcccgaacccgggttggatggagcgggacttcctggccgcgatcggcaaggagcagcagcacccgcgcaaggagaaggcaggcggaggcgcggaggaatcagcttacttcggggcagcagccgtcccggcgatggactggtccttcgcgagcaagccctgcgccgccccggcgctgatgtcgttccggtcggcngcgaaggaggagcctttcgttccgcagttctccgccttcgacggcaccnatgacacagccccctcgtatgctcacgcaccagagatcgttcggccccgacagcacgcagtacgccgcgctgcacgcgcgcagaacggggctagagtcctttccggtctcttcgccgtttcagccgaggcaccccgatgttcagggtccaaaagcttgcccagcccttccgaaaagttccccgggtcaaagcagccggccttttcccattaaaaaaccccctgtggccgttttccactgttggt

SEQ ID NO: 73085 - protein, 145 aa, Zea mays
  misc_feature: Ceres CLONE 1557300
  misc_feature (76)..(76): Xaa is any aa, unknown, or other
MERDFLAAIGKEQQHPRKEKAGGGAEESAYFGAAAVPAMDWSFASKPCAAPALMSFRSAAKEEPFVPQFSAFDGTXDTAPSYAHAPEIVRPRQHAVRRAARAQNGARVLSGLFAVSAEAPRCSGSKSLPSPSEKFPGSKQPAFSH

SEQ ID NO: 73086 - DNA, 886 bp, Zea mays
  misc_feature: Ceres CLONE 1557301
  misc_feature: Encodes the peptide sequence at SEQ ID NO. 73087
  misc_feature (1)..(1): n is a, c, t, g, unknown, or other
  misc_feature (421)..(421): n is a, c, t, g, unknown, or other
  misc_feature (566)..(566): n is a, c, t, g, unknown, or other
  misc_feature (569)..(569): n is a, c, t, g, unknown, or other
  misc_feature (572)..(572): n is a, c, t, g, unknown, or other
  misc_feature (575)..(575): n is a, c, t, g, unknown, or other
naaagctggagctccccgcggtggcggccgctctagaactagtggatcccccgggctgcaggaattcgtctcacccctagaaaaagtcacctgcacattgcagaccgcctcagcgcctcaccaagcgaaactcgttggcggctagggttttgctgcctcccgagcccaaaccctagagcacccgcgcccatcccatggcgtgctaggcttcgattgagactggggggattagtaccgcaggctgggattagagcaagcgccgagcggaaatggcatcgagtaaccaattcgatctacttggagacgtcgagaacgacgaccctgcccacctcctcgcagctgccgagaagaaggcggccgcggtgcctaagcccgcgcccgcgccggccaagttgcccaccaagcctccgccgcccgcgcnaacctgtgagggaggaaaggaactatggtgctccaccgcgcgatggtccaggacgtggaagaggcggccgcggtggcaggactggcccgaggcgagattttggcgatgctgatgcccacggctttgaggggggggtatggtggcngcngcngcngttttggggacggttggagttgctcgcggtgaaaatggtgaaggtagcaagggcaaaaaaggggcctggggccccgccaggcttaccgggggaggtgggcgaactgggtgggtacaaccaatggcaggctggggaagaatttcgaacctcctccccggggcattgaagccccccagcggcccaaggcctgggttacgggattaaacacttaaggggcctgggccttggaaaattggggaaactccaattgaaggagggctttaaaaagggacacttgggattttgtttattcctgaggagaacccttgcgg

SEQ ID NO: 73087 - protein, 87 aa, Zea mays
  misc_feature: Ceres CLONE 1557301
  misc_feature (51)..(51): Xaa is any aa, unknown, or other
MASSNQFDLLGDVENDDPAHLLAAAEKKAAAVPKPAPAPAKLPTKPPPPAXTCEGGKELWCSTARWSRTWKRRPRWQDWPEARFWRC

SEQ ID NO: 73088 - DNA, 857 bp, Zea mays
  misc_feature: Ceres CLONE 1557304
  misc_feature: Encodes the peptide sequence at SEQ ID NO. 73089
  misc_feature (414)..(414): n is a, c, t, g, unknown, or other
  misc_feature (415)..(415): n is a, c, t, g, unknown, or other
  misc_feature (470)..(470): n is a, c, t, g, unknown, or other
tggagctccccgcggtggcggccgctctagaactagtggatcccccgggctgcaggaattcgtctcacccctagaaaaaattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgtgatcctcttcgaggagaccctctaccagaagactaggatggcnnagcttttgtcgatgtcctcaaggaaggaggcgtcctccctggcatcaaggtcgancagggcaccattgaggtttgtgggcactcgacaagaagaccaccatccaggggcaccaatgacctcggcaagcgctgcgctaaatactacgagggccggggcccgcctttgccaagggggcctggcttttcttaaaaatggcccccaacaagccctccaaactttggcatttaacctgaaagccccaggggttggggttcttaaccccaataatttggcaagaaaaaaagttcttggggcccaatttttgagccctagaaaacccttttttagaggcccccccaaaaaaattaaaaccccgggcccttttttctccagggaaaaaattcttttgtgggccttgttatagaagggtttcctaaaaaaaaaaccagtgtgtctccttgg

SEQ ID NO: 73089 - protein, 220 aa, Zea mays
  misc_feature: Ceres CLONE 1557304
  misc_feature (11)..(214): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (87)..(87): Xaa is any aa, unknown, or other
  misc_feature (105)..(105): Xaa is any aa, unknown, or other
MSAYCGKYADELIKNAAYIGTPGKGILAADESTGTIGKRLSSINVENVEENRRALRELLFCCPGALQYISGVILFEETLYQKTRMAXLLSMSSRKEASSLASRSXRAPLRFVGTRQEDHHPGAPMTSASAALNTTRAGARLCQGGLAFLKNGPQQALQTLAFNLKAPGVGVLNPNNLARKKVLGAQFLSPRKPFFRGPPKKIKTPGPFFSREKILLWALL

SEQ ID NO: 73090 - DNA, 1718 bp, Zea mays
  misc_feature: Ceres CLONE 1557305
  misc_feature: Encodes the peptide sequence at SEQ ID NO. 73091
aaagcggcgactggacctggagagccggcatggcacgcctgctcctctccgtctcagtccccatgtccgctagcagcagcagccgcattgtggttcctagtaccgcgcggcgccgaggccacagcggcgtctgtgtcgctgtgcccgccacctccaccgccaccgccacccacggacaagaatttgaccccgcggcggcgccaccgttcgggctgggcgacatccgcgccgccatccccaagcactgctgggtgaaggacccctggcgctccatgggctacgtggtgcgcgacgtggtcctggtgctgggtctcgccgccgccgcggcgcgcctcgacagctggctcgtctggccgctctactgggcggcacagggcaccatgttctgggcgctcttcgtgctgggacatgactgcggccacggcagcttctccaacaaccccagactcaacagcgtggtcggtcacattctgcactcgtccatcctggtgccatacaacggctggcggattagccacaggacgcaccaccagaaccacggccacgtggacaaggacgagtcatggcatcccctccccgagcgtctgttcaagagcctggacagcgtcgtcctgatgctgcgcttcaggctgcccttccctatgctcgtctacccattctacctggccaacaggagccccggcaagtccggctcccacttccacccggccagcgacctcttccagcccagcgagagcaaacaagtgctcacctccacggcgtgctggctcgccatggtcgcactcctagctggcctcgccttcctcatgggccctctgcagatgctcaagctctacctggtcccctactgggtttttgtcatgtggctcgacttcgtcacctacctgcatcatcacggacacaatgacaagcttccatggtaccgaggaaaggaatggacctatcttcggggtggcctgacaacgctcgaccgggactacgggtggatcaacaacatccaccatgacattgggactcatgtcatccaccatctcttcccgcagatcccacactaccatctcatagaggcaacagaggcagccaagccggtgctgggaaattactacagagagccgcaaaagtctggccctctccccttgcatctacttggtgatctggttcagagcttgaggcgtgaccactatgtcagcgacacaggggatgtcgtctactaccaaactgaccccaccattagctgttctggtccattcacttgactaattgagggaggctggaagttatccgaaacacaaggatcagaggctaccggagagatctgatctatgagccacacacttgcatataacaataagtcaatcattctttgggcaaaacaagctacagtacactttccagtgctttactatcaggactcattagcacatacttagctggtactgttgcaagaaagcaatgtgcagtacctccgcttactgctgtcctcacatatgcagtacattatttgcaaaatgcaagtggactacctgcgccttagatctctctgcaaaagtaaaacagggggggggggggacttgaagttggagacatgggccttttcctgacaaatcatgtattgctgcttcatgacaaaatgagaatattctgacaaaataaataatgcatggaaatagaaaacgaggtaccaagtcttctttctggtccaaaaaaaaaaaaaaaaa

SEQ ID NO: 73091 - protein, 408 aa, Zea mays
  misc_feature: Ceres CLONE 1557305
  misc_feature (111)..(355): Pfam Name: FA_desaturase Pfam Description: Fatty acid desaturase
  misc_feature: SWISSPROT Homolog: EC 1.14.99.33 Delta(12)-fatty acid dehydrogenase
MARLLLSVSVPMSASSSSRIVVPSTARRRGHSGVCVAVPATSTATATHGQEFDPAAAPPFGLGDIRAAIPKHCWVKDPWRSMGYVVRDVVLVLGLAAAAARLDSWLVWPLYWAAQGTMFWALFVLGHDCGHGSFSNNPRLNSVVGHILHSSILVPYNGWRISHRTHHQNHGHVDKDESWHPLPERLFKSLDSVVLMLRFRLPFPMLVYPFYLANRSPGKSGSHFHPASDLFQPSESKQVLTSTACWLAMVALLAGLAFLMGPLQMLKLYLVPYWVFVMWLDFVTYLHHHGHNDKLPWYRGKEWTYLRGGLTTLDRDYGWINNIHHDIGTHVIHHLFPQIPHYHLIEATEAAKPVLGNYYREPQKSGPLPLHLLGDLVQSLRRDHYVSDTGDVVYYQTDPTISCSGPFT

SEQ ID NO: 73092 - DNA, 855 bp, Zea mays
  misc_feature: Ceres CLONE 1557307
  misc_feature: Encodes the peptide sequence at SEQ ID NO. 73093
  misc_feature (674)..(674): n is a, c, t, g, unknown, or other
  misc_feature (675)..(675): n is a, c, t, g, unknown, or other
ctccccgcggtggcggccgctctagaactagtggatcccccgggctgcaggaattcgtctcacccctagaaaaggagcgctcgctgtgattcctgcgagtacccaagcccaaccaaaccctagcccggcagccattctcttcgttccctctttgctctgcgcgccacaccacacgacctccccgaagcagacgtgcccgctgcccgtccgtcccccgtggccatggccgcgacgtggtcttcgtcttgctgcgccgcgaccgcgtcgagcagcgctctgcttcgtcatgcccgcgtcaagagcgcgccttgggtagccggtgccagccggagtagctacaggcagcggcggcggcggcgggagctgtccatccgcgccacggccgcggcgccgccgccgcccgtggtctacgcggacgccggcgccgacaacgtggcctcgctgaagatcaagctcctgagcgcggtgtccgggctgaaccgtggcctggcagcgagccaggaggacctggaccgcgcggacgcggcggcgcgggagctggaggcggcggcggggtgccccgtcgacctcagcagggacctcgataagctgcagggccggtggcggctgctgtacagcagcgcgttctcttcgcggacgctcggcggcagccgccctggccccgccacgggcgnncctctcccatcacgctcggccaggtgttcagcggatcgacgtggtgagccgcgacttcgacacatcgtggagcttgagctcggcgcgccggggcctcctgccgccctcgaggcacggcgaccctggcgcaaatttccaaatcatcgggacctccggcatcagaatcccttcgagaaaaca

SEQ ID NO: 73093 - protein, 211 aa, Zea mays
  misc_feature: Ceres CLONE 1557307
  misc_feature (72)..(206): Pfam Name: PAP_fibrillin Pfam Description: PAP_fibrillin
  misc_feature (151)..(151): Xaa is any aa, unknown, or other
MAATWSSSCCAATASSSALLRHARVKSAPWVAGASRSSYRQRRRRRELSIRATAAAPPPPVVYADAGADNVASLKIKLLSAVSGLNRGLAASQEDLDRADAAARELEAAAGCPVDLSRDLDKLQGRWRLLYSSAFSSRTLGGSRPGPATGXPLPSRSARCSADRRGEPRLRHIVELELGAPGPPAALEARRPWRKFPNHRDLRHQNPFEKT

SEQ ID NO: 73094 - DNA, 930 bp, Zea mays
  misc_feature: Ceres CLONE 1557312
  misc_feature: Encodes the peptide sequence at SEQ ID NO. 73095
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (352)..(352): n is a, c, t, g, unknown, or other
  misc_feature (445)..(445): n is a, c, t, g, unknown, or other
  misc_feature (458)..(458): n is a, c, t, g, unknown, or other
  misc_feature (826)..(826): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctggagctccccccggtggcggccgctctagaactagtggatcccccgggctgcaggaattcgtctcacccctagaaaaacaccaacctcagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaangtggcgaagacatcgacctcctctgaccggccgctgtggttccccggcgccgtggcgcccgactacctggacggctcgctggtcggcgactancgggtcgacccgntcggtctcgggaagcccctggaatacctgcagttcgagttggactccctgggacaagacctggccaaaaaatgaagcccgggggatcaatgggaacccgggttcaagtccttcccaaagccaagtcccccccctttggcaccccttaagggaaggggttcgggcctcccaaggggttcccccaggggggaaagtttcttccccgggcccctgggggcaatttttcccaccccccttggggcccctcctcctggtaaaaggggggtaccccggggggttcccctttggaaagaaccccccccaaaagggggaaaattttgggggaaaagggtttcccccctcctatggggggaaacccccccgccgccnttttttttcccttttgaggagccttttttgttttaaaaaaaaaggggggccccctataaaaaccccccccaacaaaaaagtttttttgggaaaaaaaacacaag

SEQ ID NO: 73095 - protein, 104 aa, Zea mays
  misc_feature: Ceres CLONE 1557312
  misc_feature (45)..(45): Xaa is any aa, unknown, or other
  misc_feature (76)..(76): Xaa is any aa, unknown, or other
  misc_feature (81)..(81): Xaa is any aa, unknown, or other
MASSVAAAASTFLGTRLADPAPQNGRIVARFGFGLGGKAKPAPKXVAKTSTSSDRPLWFPGAVAPDYLDGSLVGDXRVDPXGLGKPLEYLQFELDSLGQDLAKK

SEQ ID NO: 73096 - DNA, 843 bp, Zea mays
  misc_feature: Ceres CLONE 1557314
  misc_feature: Encodes the peptide sequence at SEQ ID NO. 73097
  misc_feature (706)..(706): n is a, c, t, g, unknown, or other
  misc_feature (843)..(843): n is a, c, t, g, unknown, or other
ctggagctccccgcggtggcggccgctctagaactagtggatcccccgggctgcaggaattcgtctcacccctagaaaaaatcgttcgcttcctttcgtcaactccacttctcttctccgcgtcacctcctcttcgccgccgccgacgcttcacccggcagccagccatggatgaggagtacgacgtgatcgtactaggcacggggctcaaggagtgcatcctcagcggtctcctctctgtagacggcctcaaggttttgcatatggacagaaatgactactatggaggagattccacctcactcaaccttaatcagctctggaagaggtttagaggggaagacaagcccccagcacatctaggtgcaagcagagactacaatgtggacatggtgccaaagtttatgatggcaaatgggacattggttcgaaccctcattcacaccgacgtgacaaagtacttgtcattcaaagctgttgatgggagctatgttttcagcaaagggaagatttacaaggtccctgccactgatatggaggctctgaagtcccctttgatgggcctattcgagaagcgcagagcaaggaacttcttcatttatgtccaagattacaatgaagctgatccaaggacacatcaaggattggaccttactagggtgacaactagagaacttatagcaaaatatggtttaagtgatgatancagtggatttcgttggacatgcacttgctcttcatagagatgatcgttatctcgatgaacgggcacttgatacagtgaaaagatgaaactatatgcagactctcttgcacgctttcaaggaggctcaccttatatcn

SEQ ID NO: 73097 - protein, 191 aa, Zea mays
  misc_feature: Ceres CLONE 1557314
  misc_feature (1)..(192): Pfam Name: GDI Pfam Description: GDP dissociation inhibitor
  misc_feature (180)..(180): Xaa is any aa, unknown, or other
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEALKSPLMGLFEKRRARNFFIYVQDYNEADPRTHQGLDLTRVTTRELIAKYGLSDDXSGFRWTCTCSS

SEQ ID NO: 73098 - DNA, 861 bp, Zea mays
  misc_feature: Ceres CLONE 1557315
  misc_feature: Encodes the peptide sequence at SEQ ID NO. 73099
agctccccgcggtggcggccgctctagaactagtggatcccccgggctgcaggaattcgtctcacccctagaaaaaaaaaaaaaaaaaaaaaaatgaagcgcccgcaaccgcaacaagctgctgcggagcagatcatggcgctgtacgacgcctgctggttccgccgcctcgtgctgctcgcttcccctcctcccgcggcggcacctcggccatctgtaccggcgcagcaggcgccggtggagcgcgacgagttgggtactacgcacacgccgcatgcgcagcggcctgcttcttcgagtcccacggccggcgggctgcggcaccggcgaacgcggagcgacgaggctaccgcggccgcgttcctgggcatggagccgctgaggctccccgacagaggcaaccgcgcgcgcctccagaccatactctcgggcaaagacgggctcgtggccgcgccgccgccggaacggagaaggcccgggcccgggaggcggcggcagcggcggcgcgggcggagcatgtcggagctggagttcgaggaggtcaagggcctgcaggacctcggcttcaccttctccgacgccgaggtggacgccgagctcgcgtccatcgtgccgggcctaaagaggaagcggtccgaggaggagaacaacaacaaccgggccacggcggcgtcgacgtcttcggcccggccggaagctgccgacgacgcgtccgtggccgccgtcgcggcgccgaggcggccgtacttctcggaagcgtgggacagcgaggaagaaaaagaggtcaggagggcgctgcgcaactggcggatccgcccggttggcgacgcaacgagctcaggagcaccttccgggaggggg

SEQ ID NO: 73099 - protein, 242 aa, Zea mays
  misc_feature: Ceres CLONE 1557315
MALYDACWFRRLVLLASPPPAAAPRPSVPAQQAPVERDELGTTHTPHAQRPASSSPTAGGLRHRRTRSDEATAAAFLGMEPLRLPDRGNRARLQTILSGKDGLVAAPPPERRRPGPGRRRQRRRGRSMSELEFEEVKGLQDLGFTFSDAEVDAELASIVPGLKRKRSEEENNNNRATAASTSSARPEAADDASVAAVAAPRRPYFSEAWDSEEEKEVRRALRNWRIRPVGDATSSGAPSGRG

SEQ ID NO: 73100 - DNA, 814 bp, Zea mays
  misc_feature: Ceres CLONE 1557316
  misc_feature: Encodes the peptide sequence at SEQ ID NO. 73101
  misc_feature (289)..(289): n is a, c, t, g, unknown, or other
  misc_feature (609)..(609): n is a, c, t, g, unknown, or other
  misc_feature (641)..(641): n is a, c, t, g, unknown, or other
  misc_feature (711)..(711): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
aaagctggagctcaccgcggtggcggccgctctagaactagtggatcccccgggctgcaggaattcgtctcacccctagaaaaaacgccacgctctccaacgccacagcttgcgcccgcaatggcactcgtctccgcctcctcgtcctccaccaccgccgtcacggcgctccccaggaatgggcagcgggcgtcgtcctccttcctcggcggcaagacgctgctgagacaggccgaggcggcccggccgtcgttcgccgttgcgcgcccgcggccggaccccaacaggnccggaatctgggtttcccccgggggaaaggcaccccccctccccccccgtgggggttctaaaaaaggggaaagcccctttttcccccggggggaaaaaaaattgggggggtttttttttataaacccccccggggggggggggggcccccccgggggatttttttttttttcccacccccccccccaaaaaaaaaaaaacacccccccccccccccccggggggggggggagaaaaaagaaaaaaaaaattatttttttgtcctctataccccccccccaagaaaaaaaaaaaaaaaaagaagggggggggggggggggngttcaaaaaaaaacaaacactcaccccatttnttttctggggggggggtggggggaaaagcaaaaaaaaaaaaaatttcttctttcccccccccggcgcccncccgcgcggaaaacccgcgggaaggaaggggagaaacaaaaacaccacannnnaaattattataaatgataattatcctccaaacaccacacacgaggggaga

SEQ ID NO: 73101 - protein, 219 aa, Zea mays
  misc_feature: Ceres CLONE 1557316
  misc_feature (57)..(57): Xaa is any aa, unknown, or other
  misc_feature (174)..(174): Xaa is any aa, unknown, or other
  misc_feature (214)..(214): Xaa is any aa, unknown, or other
  misc_feature (215)..(215): Xaa is any aa, unknown, or other
MALVSASSSSTTAVTALPRNGQRASSSFLGGKTLLRQAEAARPSFAVARPRPDPNRXGIWVSPGGKAPPLPPRGGSKKGESPFFPRGEKKLGGFFFINPPGGGGGPPGGFFFFSHPPPQKKKNTPPPPPGGGGRKKKKKIIFLSSIPPPQEKKKKKEGGGGGGVQKKTNTHPIXFLGGGWGEKQKKKKFLLSPPRRPPARKTRGKEGEKQKHHXXNYYK

SEQ ID NO: 73102 - DNA, 739 bp, Zea mays
  misc_feature: Ceres CLONE 1557317
  misc_feature: Encodes the peptide sequence at SEQ ID NO. 73103
  misc_feature (362)..(362): n is a, c, t, g, unknown, or other
  misc_feature (392)..(392): n is a, c, t, g, unknown, or other
ctccccgcggtggcggccgctctagaactagtggatcccccgggctgcaggaattcgtctcacccctagaaaaaagcagtgaccacggcgaccatcgccggctcgccgccatgaagcacctccacctctcatcttctcttcctctcctcctccaccgcccctccaagccccatctcctccaccctagccgccgccgcgcctccatccgcaacgccgcatccggcggcggctccggcgaacccacccccgccgcggaaacggcctcaggtacctctccgccagccgctgccaagcccgccggcgtcaaggaccgcctcaaggcgaggaaccaggcccgccgggtccggctggactccccgccncctgaagtggtggtggtgccaaaaaaaaancccgcccccgccgcgtcgttcgtctcctgtgccgaaaaaaaagggtcgggcggaaggggtggggaggagaataaacctggggcgaaaaaggcctggaaactcttacctcggggaagaaagggccttgctccttttgggggtaaaaaaagtttggcccaaagccttcccatttttaaacaagggggtcggggggccctggggggtcccgggtttccccctcttttggggggggggccccctttggatttggggggcttttttaaacaaaggtttttgaaaaagggccccccgggccggggtttggtgcccgtaccccaacaaacgagaggccccggggggtattataa

SEQ ID NO: 73103 - protein, 209 aa, Zea mays
  misc_feature: Ceres CLONE 1557317
  misc_feature (94)..(94): Xaa is any aa, unknown, or other
MKHLHLSSSLPLLLHRPSKPHLLHPSRRRASIRNAASGGGSGEPTPAAETASGTSPPAAAKPAGVKDRLKARNQARRVRLDSPPPEVVVVPKKXPAPAASFVSCAEKKGSGGRGGEENKPGAKKAWKLLPRGRKGLAPFGGKKSLAQSLPIFKQGGRGALGGPGFPPLLGGGPPLDLGGFFKQRFLKKGPPGRGLVPVPQQTRGPGGYY

SEQ ID NO: 73104 - DNA, 842 bp, Zea mays
  misc_feature: Ceres CLONE 1557319
  misc_feature: Encodes the peptide sequence at SEQ ID NO. 73105
  misc_feature (177)..(177): n is a, c, t, g, unknown, or other
  misc_feature (178)..(178): n is a, c, t, g, unknown, or other
  misc_feature (305)..(305): n is a, c, t, g, unknown, or other
  misc_feature (306)..(306): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (701)..(701): n is a, c, t, g, unknown, or other
  misc_feature (702)..(702): n is a, c, t, g, unknown, or other
  misc_feature (739)..(739): n is a, c, t, g, unknown, or other
  misc_feature (797)..(797): n is a, c, t, g, unknown, or other
  misc_feature (805)..(805): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
ctggagctcaccgcggtggcggccgctctagaactagtggatcccccgggctgcaggaattcgtctcacccctagaaaaaatcttcgtgaggaccttcaaccatctcaggcggaatggcggcttctggtgagggcgcgtcgctgccgtctccggcgggcggggtaggatgcgcaccnngccgccgcgtcagctatttctacgtagccgtcgatcggagactactactacgggcaaggtcacccgatgaagccccaccgcatccgaatggcgcactcgctggtggtccactacggccctccaccgnnctcctcgagcttctcccgccccctacccgggccttctgagggccgaaatccggcccggttttccacttccgaaagaacaaccgttggcccttttcctctggggttccccccccccccggaaaaacccccgggggggtttctttttaaaaaccccgggggggcccatttataaagccccttttttaaacccccctcgggggaaagaaaaatattccccccccccgggttttttttaaaaaaggggggttttcttttttccccccccttttttttgggccgaaaggggggcctccctcccccccccttgggggggggaggaaaaaaataaaatttttgggggggcgccccccccccccccccccctaaaaaaaaaattatttttttaaacnnnccgnnccccccccgcgggggggagagagagacgaaccccccnctcccttaaaaaaaataaaatttctcccccccccctcgccaaataaaaaaataaattnataattanannnnggagagggggggggggcggcgcggccctcccc

SEQ ID NO: 73105 - protein, 77 aa, Zea mays
  misc_feature: Ceres CLONE 1557319
  misc_feature (21)..(21): Xaa is any aa, unknown, or other
MKPHRIRMAHSLVVHYGPPPXSSSFSRPLPGPSEGRNPARFSTSERTTVGPFPLGFPPPPEKPPGGFLFKNPGGAHL

SEQ ID NO: 73106 - DNA, 854 bp, Zea mays
  misc_feature: Ceres CLONE 1557322
  misc_feature: Encodes the peptide sequence at SEQ ID NO. 73107
catagctggagctccccgcggtggcggccgctctagaactagtggatcccccgggctgcaggaattcgtctcacccctagaaaaaaccagcaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggagaccttcgcgcgcaaccgggagctagaggtgatccactcccggtgggcgatgctgggggcgctgggctgcgtgttcccggagatcctggctaagaacggcgtcaagttcggcgaggcggtgtggttcaaggccggcgcgcagatcttctcggagggcgggctggactacctggggaccccaacctggtgcacgcgcagagcatcctggccatctgggcggtgcaggtgggtgctcatgggcctcgtcaagggctaccgggttcggcggcggccgctcgggggaagggtccaacaggggtaccccggggggcgccttttaaccccgtgggcctcgccaaaaaaccggaaaaaccgccccaaacccaaggggaagggagccaaaaaagggcccccctgccaatgtttcccaaggtttggggtttcttttggagaggca

SEQ ID NO: 73107 - protein, 229 aa, Zea mays
  misc_feature: Ceres CLONE 1557322
  misc_feature (59)..(198): Pfam Name: Chloroa_b-bind Pfam Description: Chlorophyll A-B binding protein
MAASALHQTTSFLGQALVARAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGTPTWCTRRASWPSGRCRWVLMGLVKGYRVRRRPLGGRVQQGYPGGRLLTPWASPKNRKNRPKPKGKGAKKGPPCQCFPRFGVSFGEA

SEQ ID NO: 73108 - DNA, 992 bp, Zea mays
  misc_feature: Ceres CLONE 1557324
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (389)..(389): n is a, c, t, g, unknown, or other
  misc_feature (672)..(672): n is a, c, t, g, unknown, or other
nnnnnnnnnnnnnnnnnnnnnnnnnnnnnnnnnnnnnnnnnnnnnnnnnnnnnnnnnnnaaaaaaaggggnnnnnnnnnnntgnnnttttcaaagctgggactccccgcggtggcggccgctctagaactagtggatcccccgggctgcaggaattcgtctcacccctagaaaaagccaaacacatcggcgcatcaaccaccccttccgctcatcctcttccctcccaccgattcgcccgctggctcgccgcccgcccgtagcctgcgcccgctcgagatctagaccagacgccgcagccgcggccgcgggctgacaggatctctgtcctccctacgcggcgaaccgctaggaacgcgccctagacgacgaaggagacggggtcatggnagcgtctccctgggacgcccctccccaagcaggcacgggaggttggaggctcattttaatgaacaaaatggatcgctaacccgaaaaatgggttcccttgaaaaacaaaaggggtcaaaaaaaaaaaaatttggagccccgaaaataaaaaaaaaaacccttggaaaacagttttcccccaaaaaaaaatttcccccaaaaaggcaaaactcggggggaataaacaccgggggggtgcccaaaaaaaaatttttttttctaaaaaaccccggaaaaacacccntaaaaattggggaaaaatttttttttggaaaaacacccttttttcccaggaagaaatttttttcccgggccgccttcttaaaaaaaaaacttccgcgggggggggaaaaaaaaaaaaaaaaggggggtgttgtttttcccccctcttttttggcggccgaaaaattattttttttttcaaaaaaacaaaaaatattttttttgtttgtgttttataaaaaacaaaacccccccaaaaaacacacagggggggggagaggaagaagccccctctccccttctcccgagggaaaaaaaacaaaaaaccccgcgtgtgtttgg

SEQ ID NO: 73109 - DNA, 951 bp, Zea mays
  misc_feature: Ceres CLONE 1557325
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (41)..(41): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (70)..(70): n is a, c, t, g, unknown, or other
  misc_feature (71)..(71): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (81)..(81): n is a, c, t, g, unknown, or other
  misc_feature (100)..(100): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (618)..(618): n is a, c, t, g, unknown, or other
  misc_feature (657)..(657): n is a, c, t, g, unknown, or other
  misc_feature (658)..(658): n is a, c, t, g, unknown, or other
  misc_feature (667)..(667): n is a, c, t, g, unknown, or other
  misc_feature (673)..(673): n is a, c, t, g, unknown, or other
  misc_feature (803)..(803): n is a, c, t, g, unknown, or other
  misc_feature (895)..(895): n is a, c, t, g, unknown, or other
  misc_feature (938)..(938): n is a, c, t, g, unknown, or other
ncctttttnnnnggnnnggnnnnngcttgngnnngnngcgntttttcggnnnnnntttcnnnnntnngtnnccnnnnncgngcgggcgtggggtgtgtgngtggtgctgaggggggggcnnnncgggggnnnnnccaaaactggaactccccccgggggcggccgctctagaactagtggaatcccccgggctgcaggaattcgtctcacccctagaaaaaaccatccactgcatgcctggcgcgagaggcaccagccaaagcccacagttccccccatttcatttgtgtggtagccgaggactgggagggagctgctcaaccttttttttgtgtgtgtgtgaaagatcgagagcgccgctcaaccaatagagctgtttcctctggccttgtgtctttcctccgtccctggggggtccctggcggggggggnnnnggcccccccttttttttccgggccccccgggggttttgggaatttccccccctcttaaaaaaaaaaaagggggttttccccttttgcccccccccctgttggggggccccccaaaaaaagagggttttttccctgggggggggccacccccccccccccccccccgctgaattgaaatagtanacccccccccccgcggggggggtttttttctcccccacnnaagggccgngggagnaggagaccaacccccccccccccccgcccctcacttttttgtgggtgcccgcgccaaaaaaaaaaaaaaaataccacccctggggtcgctcccctcggtggggcgggggcggggagagagagaaacaggncctcacccctcttgtgtggtggaccccccccccccccgcccccggaaaaaaaaaaaaccacaccccccctttcttttcttccccccgccccnaaaggagaaggaggagtagcttttttttttttctcctccccgnccccccacacccc

SEQ ID NO: 73110 - DNA, 848 bp, Zea mays
  misc_feature: Ceres CLONE 1557328
  misc_feature: Encodes the peptide sequence at SEQ ID NO. 73111
  misc_feature (716)..(716): n is a, c, t, g, unknown, or other
ctccccgcggtggcggccgctctagaactagtggatcccccgggctgcaggaattcgtctcacccctagaaaaaatgcattcttggtaggtcgtgacacggcctcgctgcagcccgagtccccgggcgtctttttctccgccaccgcacccctgggcacctcccaccgccgcatcgccgtcgacctattcgacgagtccgccttcgccgtgcgctgggccgtcgccaactacctacgcttcggggacgccgtcattctgctccacgtgcgccccacctccgtgctctacggcgtcgactggggcgccgtcgacgtctccctccccatccctagcgcctactccgaggatggctttggtggcggtgacgccgattccgaggccgccgctgcgcgcaggatggaggacgactacgacgctttcacggcctccaaggccaatgacatcgccaggccgctcaaggacgcgggcatcccctacaagatccacatcgtcagggaccacgacatgaaagagcgcctctgcctcgaggtcgagcgcctctcgctcagcgccgtcatcatggggagcaagggcttcggctccacgcggaggaccagcaaggggaggctcggcagcgtcagcgactactgcgtgcatcacattgtctgccctgttgtggtggtgcgcttccctgatgacgtttctgcccagtgtggggaggcaggtggtttgttcnccgccgttgggtgctgagatgtgctgcacttccttcccggaggaggaagaaggcgagtatcatgacatcgcttagggacacaagggatactggacttcgttgaagtattggggaagcctcttgggatcagaa

SEQ ID NO: 73111 - protein, 111 aa, Zea mays
  misc_feature: Ceres CLONE 1557328
  misc_feature (107)..(107): Xaa is any aa, unknown, or other
MEDDYDAFTASKANDIARPLKDAGIPYKIHIVRDHDMKERLCLEVERLSLSAVIMGSKGFGSTRRTSKGRLGSVSDYCVHHIVCPVVVVRFPDDVSAQCGEAGGLFXAVGC

SEQ ID NO: 73112 - DNA, 745 bp, Zea mays
  misc_feature: Ceres CLONE 1557330
  misc_feature: Encodes the peptide sequence at SEQ ID NO. 73113
  misc_feature (278)..(278): n is a, c, t, g, unknown, or other
  misc_feature (326)..(326): n is a, c, t, g, unknown, or other
  misc_feature (327)..(327): n is a, c, t, g, unknown, or other
  misc_feature (339)..(339): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (375)..(375): n is a, c, t, g, unknown, or other
  misc_feature (381)..(381): n is a, c, t, g, unknown, or other
  misc_feature (388)..(388): n is a, c, t, g, unknown, or other
  misc_feature (389)..(389): n is a, c, t, g, unknown, or other
ctggagctccccgcggtggcggccgctctagaactagtggatcccccgggctgcaggaattcgtctcacccctagaaaaagtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcnggcggatcccggagaaacgttcgccaagaaccgggggagctggaggtnncatccactcccngctggggcccnnntgctggggcgcgttggggctgcngtgttnccccggnnaagctgctcgcccccgcaaaacggccgttccaagtttcggcccaaaggccccttggttgggtttcaaagggcccgggggtcccaaaaatctttcacccaagggggggggctgggaaataccctcggggaaccccgaagccttgaatcccccgccccaaaaaacatcccttcccccctttttggggccctgcccaaggtcggggctccttgggggccccactctcagggggtaccccggtttcccccgggggggcccccctccgaaaaagggggtgtttaaaacccgttttttacccccgggggggggggtttttttaaacacccttttggggcctcccccacaaaaaaaacccctc

SEQ ID NO: 73113 - protein, 176 aa, Zea mays
  misc_feature: Ceres CLONE 1557330
  misc_feature (109)..(109): Xaa is any aa, unknown, or other
  misc_feature (113)..(113): Xaa is any aa, unknown, or other
  misc_feature (117)..(117): Xaa is any aa, unknown, or other
  misc_feature (125)..(125): Xaa is any aa, unknown, or other
  misc_feature (127)..(127): Xaa is any aa, unknown, or other
  misc_feature (129)..(129): Xaa is any aa, unknown, or other
GAPRGGGRSRTSGSPGLQEFVSPLEKVPSSLFGEARVTMRKTAAKAKPAASSGSPWYGPDRVLYLGPLSGAPPSYLTGEFPGDYGWDTAGLSGGSRRNVRQEPGELEVXSTPXWGPXAGARWGCXVXPXKLLAPAKRPFQVSAQRPLGWVSKGPGVPKIFHPRGGAGKYPRGTPKP

SEQ ID NO: 73114 - DNA, 800 bp, Zea mays
  misc_feature: Ceres CLONE 1557331
  misc_feature: Encodes the peptide sequence at SEQ ID NO. 73115
  misc_feature (800)..(800): n is a, c, t, g, unknown, or other
ctccccgcggtggcggccgctctagaactagtggatcccccgggctgcaggaattcgtctcacccctagaaaaacctagaaaaattttcccttccccttccgctcgagtctgctctagggtttttgccaagccgccgtcgccgtcgctctgccctcgtatcccctcccacgacaccgagacaccaagatgacggcgcagaccgcggaggagctcgccacccagatcgagcagcagaagctcgaggagcagaagaccgaggcagaggaagttgtggtggaggatgaggaggaggaagatgaggacgatgacgatgatgacaaggatgatgatgaactcgatggggatgccagtggcaagtcaaagcaaagcaggagtgagaagaagagccgcaaggccatgctgaagcttggcatgaagcccatcactggtgtcagccgcgtcactgtaaagaaaagcaagaatatactctttgtcatctccaaaccagatgtgttcaagagcccgaattccgacacgtatgtcatattcggcgaggctaagatcgaggacctcagctcccagctgcagacccaggcagcagagcagttcaaggctcctgacttgagccagatgatctcgaatccagagacgtctggcccgggacaggaggacaatgatgaggaggtcgacgaaactggtgttgaggccaaggacattgagctggtgatgacccaggcatctgtttcaaggcccaaggctgtcaaggccctcaaggcttctaatggggacattgtcactgccatcatggatctgacaaccn

SEQ ID NO: 73115 - protein, 204 aa, Zea mays
  misc_feature: Ceres CLONE 1557331
  misc_feature (62)..(121): Pfam Name: NAC Pfam Description: NAC domain
  misc_feature (165)..(202): Pfam Name: UBA Pfam Description: UBA/TS-N domain
MTAQTAEELATQIEQQKLEEQKTEAEEVVVEDEEEEDEDDDDDDKDDDELDGDASGKSKQSRSEKKSRKAMLKLGMKPITGVSRVTVKKSKNILFVISKPDVFKSPNSDTYVIFGEAKIEDLSSQLQTQAAEQFKAPDLSQMISNPETSGPGQEDNDEEVDETGVEAKDIELVMTQASVSRPKAVKALKASNGDIVTAIMDLTT

SEQ ID NO: 73116 - DNA, 871 bp, Zea mays
  misc_feature: Ceres CLONE 1557337
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (131)..(131): n is a, c, t, g, unknown, or other
nnttttnnnnnnnnnnnnnnnnnnnnnnnnnttttttttnnnttnnnnttnnnnnnnnnnnnnnncctatnnnnnnncaaaactggggctcccccggtggcggccgctctagactagtggatcccccgggnctgcaggaattcgtctcacccctagaaaaaaaataagagcttccgttcgtaaaatttgtacaaaatgtcgactgattcgcaggcgtgggcgaattagagtcatttgttccaatccgaagcataaacaaagacaggggtaatctttcgaaaaagaagcttttctttctaatagcttttctttctaattaaagtaaaaagtaccccacggaaatgcccaaaattgccaattaaaaaaaatgaaaagtaaagggatatatttttaaccctgaaaaccggaaaaacttttggaaaccctttttttccccttttttgggttaaattttcccaaacctccaaaatttttttttgggagggattttattttaaaaaatttttttgccaccaaaaaaagggccctttttccccccaaaaaaaaaaaataaagggggtttttccccccccccttttttgggaaaaaaaaagggggggggggccggaaaattttttttggggggttttttttggcgcccgcctttggggggggaaaaaaaatgggcccccccccccccccttttttttttttatagagggttttttttttcacccccggcggcaaaaaaaaaaaaaaagatggttttcccccccccccctttgttttaaaaaaaaaataaattttccccccccccaaaaaaaagggggggggggggaaaaattttatttttttctccccgcccgggggggtggggacctccacacacacc

SEQ ID NO: 73117 - DNA, 816 bp, Zea mays
  misc_feature: Ceres CLONE 1557338
  misc_feature: Encodes the peptide sequence at SEQ ID NO. 73118
ggagctccccgcggtggcggccgctctagaactagtggatcccccgggctgcaggaattcgtctcacccctagaaaaaaccctctcctcctcctccagtcctccctcgctcttcctcctcgcgaaacgacgcggaggaggttgccggtcaggccaccgccgcgcccgcccgcccgccggagacccggtccgcagccaacgcgtgacgtagggaggacacgcagccatggccacttcctcctcgtcgctcacaacgctccactcccgcttcctctctcccaccccttcctcgccctacatggcggcgctgccccgacggcgaagggccggagcgcggtaccctcgcatccgggccattgacctcgaccagaacacgattgtggccatttcggtgggcgtcgtcagcatcgccgtgggaataggtgtccctgtgttctacgagacccaaatcgacaatgccgccaagagggataatacacagccatgcttcccctgcagtggttctggcgcgcaggtatgcaggttttgcagtggaaagggcattgttactgtagtacttggtgcaggcgagactgaaagatcgcagtgtgtcaactgcggaggcatcggctctttgacatgcactacatgcccagggcaccgggattcaacccacgctttcttgaccgccagaagttcaagggatgacgatttgatgaagggtttttttgccctccttgggtaggttttggccaagaatgtaacttcccggcctaattttgaggaaaaaggttggcggaccccaaaaaaaagtgtcccctttccgccccttgggaac

SEQ ID NO: 73118 - protein, 141 aa, Zea mays
  misc_feature: Ceres CLONE 1557338
MAALPRRRRAGARYPRIRAIDLDQNTIVAISVGVVSIAVGIGVPVFYETQIDNAAKRDNTQPCFPCSGSGAQVCRFCSGKGIVTVVLGAGETERSQCVNCGGIGSLTCTTCPGHRDSTHAFLTARSSRDDDLMKGFFALLG

SEQ ID NO: 73119 - DNA, 831 bp, Zea mays
  misc_feature: Ceres CLONE 1557340
  misc_feature: Encodes the peptide sequence at SEQ ID NO. 73120
  misc_feature (587)..(587): n is a, c, t, g, unknown, or other
  misc_feature (588)..(588): n is a, c, t, g, unknown, or other
ggagctccccgcggtggcggccgctctagaactagtggatcccccgggctgcaggaattcgtctcacccctagaaaaagctgcctcttggcatttccctccggcaatgcttcggacccttgcacctcctccctgcaagttgccatcgaccgagaagctaccactactggctgctcggctcaaaaggcgctcgggagtcgggtctagcgaaccaaatgagccgcgcggggagatgctgctgctgctgctgctaggattagccacgggcctcgccgccgccgccgccggggaagccgagacgcagggcggcggcggggcggtctccggcggcggccacggcccgaaggtcagtcccgcggtcctgttcgtcgtggcggtagccgccgtggtgctgctcgtctcctgcctgctgcacctcgtggtcaggctcctgctcatacgccgccgcggccgtgcgcgcgcgcggggcggcggcggcgacggggaggagtccgcgctgcagaggcagctgcggcagctgttccacctgcacgacgccgagctcgaccaggacgtcatcgacgcgctgccagtgttccgttcgagttnnttttttttgggtgggcccccgtcttcttgctccggggcacaaaggaaggcgttcgacttgcgcgtccttgcctgttgcgagtttccccgggccgagggaccgggctgcggcctgcttgcccgccgttggcggggcaccgccgtttccacgcccgggcttgcatcgaaacaccttggcttgcctgttcccaagcttccaccttttccccccctttttgccgggcgccccccccctctcgggggg

SEQ ID NO: 73120 - protein, 242 aa, Zea mays
  misc_feature: Ceres CLONE 1557340
  misc_feature (161)..(161): Xaa is any aa, unknown, or other
MLRTLAPPPCKLPSTEKLPLLAARLKRRSGVGSSEPNEPRGEMLLLLLLGLATGLAAAAAGEAETQGGGGAVSGGGHGPKVSPAVLFVVAVAAVVLLVSCLLHLVVRLLLIRRRGRARARGGGGDGEESALQRQLRQLFHLHDAELDQDVIDALPVFRSSXFFLGGPPSSCSGAQRKAFDLRVLACCEFPRAEGPGCGLLARRWRGTAVSTPGLASKHLGLPVPKLPPFPPLFAGRPPPLGG

SEQ ID NO: 73121 - DNA, 949 bp, Zea mays
  misc_feature: Ceres CLONE 1557343
  misc_feature: Encodes the peptide sequence at SEQ ID NO. 73122
  misc_feature (362)..(362): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (869)..(869): n is a, c, t, g, unknown, or other
  misc_feature (871)..(871): n is a, c, t, g, unknown, or other
  misc_feature (872)..(872): n is a, c, t, g, unknown, or other
  misc_feature (874)..(874): n is a, c, t, g, unknown, or other
  misc_feature (875)..(875): n is a, c, t, g, unknown, or other
  misc_feature (894)..(894): n is a, c, t, g, unknown, or other
  misc_feature (895)..(895): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
ctggagctccccgcggtggcggccgctctagaactagtggatcccccgggctgcaggaattcgtctcacccctagaaaaaacccaccaacccaccatccccgatcgcccttggagatggagatggtcggcggcagcgccgacgccatccccggcctcttgtcatacggctgggccgggctctggtccacgctggcgagcctcctgttcctgtggtccatggtgcaggaccacctccctttccagctcgaggagcagctgtccgcactggcgcgccgcgccctcgccgccgtcaccccctacgtcaccatcaccatcgacgagcacgacgccgactccttcggccgcagcgaaggctacctcnccgcggaggcctacctgggcgccacctctttcccggcccgccagcagggttcgcccccagctcctgggcggcagcgaccgcggttaaccttcgccggtcgacaaacaccttcaaggttacctgaccgccttcttccggggccccggaaagacggtggggggaaaaaaaacggaaaactcctcccccccggggaaaaaatgattatctccttgaaaacccccccttaggggagggaagaaacccccccccccaaattggcgcccaaaccttttcaaccggccgcccacccccgggggggttttttttaaaaggggccgccttaactttgcgccgagggttttttttccccaagaagggggggcggcgcgccccccccttctcctggagaaaaacacaaaagggccgcctcttctttcttacatcaaaaaaaaaacccnnnnnnnnnnnggagaaaattggggggggggggggaaaaaaaaacagaggcctccccccccttgaaaaatnanntnnttagagccgtttagtgggnntaagtggaataggaacacccccccctccctcttttgnnnnccccttcctccgcc

SEQ ID NO: 73122 - protein, 157 aa, Zea mays
  misc_feature: Ceres CLONE 1557343
  misc_feature (83)..(83): Xaa is any aa, unknown, or other
MEMVGGSADAIPGLLSYGWAGLWSTLASLLFLWSMVQDHLPFQLEEQLSALARRALAAVTPYVTITIDEHDADSFGRSEGYLXAEAYLGATSFPARQQGSPPAPGRQRPRLTFAGRQTPSRLPDRLLPGPRKDGGGKKNGKLLPPGEKMIISLKTPP

SEQ ID NO: 73123 - DNA, 805 bp, Zea mays
  misc_feature: Ceres CLONE 1557344
  misc_feature: Encodes the peptide sequence at SEQ ID NO. 73124
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (698)..(698): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (725)..(725): n is a, c, t, g, unknown, or other
  misc_feature (735)..(735): n is a, c, t, g, unknown, or other
agctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccacctagagatggatccgcaccaagagcacaaaggtggtggnnnnnnggggggggggnnnnnncnnnnnnnnnnnnnnnnnnnnggggggaanaggggnnncggtggggggacctttgcntgggggcggnttgaacaactcggactctgggagaaacctcattcaagtgaagcaaggaaaaagggcctggaatgcctaat

SEQ ID NO: 73124 - protein, 198 aa, Zea mays
  misc_feature: Ceres CLONE 1557344
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (170)..(170): Xaa is any aa, unknown, or other
  misc_feature (171)..(171): Xaa is any aa, unknown, or other
  misc_feature (175)..(175): Xaa is any aa, unknown, or other
  misc_feature (176)..(176): Xaa is any aa, unknown, or other
  misc_feature (177)..(177): Xaa is any aa, unknown, or other
  misc_feature (178)..(178): Xaa is any aa, unknown, or other
  misc_feature (179)..(179): Xaa is any aa, unknown, or other
  misc_feature (180)..(180): Xaa is any aa, unknown, or other
  misc_feature (181)..(181): Xaa is any aa, unknown, or other
  misc_feature (182)..(182): Xaa is any aa, unknown, or other
  misc_feature (183)..(183): Xaa is any aa, unknown, or other
  misc_feature (184)..(184): Xaa is any aa, unknown, or other
  misc_feature (187)..(187): Xaa is any aa, unknown, or other
  misc_feature (189)..(189): Xaa is any aa, unknown, or other
  misc_feature (196)..(196): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEEAGAAVEQFNGYTFQGRPLRVNCGPPPPRDGSAPRAQRWWXXGGGXXXXXXXXXXGEXGXRWGDLCXGA

SEQ ID NO: 73125 - DNA, 883 bp, Zea mays
  misc_feature: Ceres CLONE 1557350
  misc_feature: Encodes the peptide sequence at SEQ ID NO. 73126
  misc_feature (495)..(495): n is a, c, t, g, unknown, or other
  misc_feature (496)..(496): n is a, c, t, g, unknown, or other
aagctggagctcaccgcggtggcggccgctctagaactagtggatcccccgggctgcaggaattcgtctcacccctagaaaaaaagactcttctgctacggtgctcgcttctctgtctcggtcggcggactctgtcgctcctcctcctagcgcgagcgagcgagctagctcacctactctgtggctggacctcgcgcgcgcgcgcgggatggcgccgtcgtcctcgccctcgccctcggcggccggctcccacgcgggcctcgccatcgcggccaccgccatggcgctctccggcacgctcgtcctctactccctgtgccgcgcgaagcagcagcgcctggtgctcccctcctccgacgacgacgccccgtcccctcgccctcggctccgcccgtgcctctcctcgtccgagaaagcgaagaagaagaagcgggagatggcgcggcgcggcagccagaagcgggtgcgcttcgcggacgacgtcttgggcagggnnacatgcgccgccgccgccgcgcccaaggaaggaggcgaaccctcgtgggccgcggccctcagaacgcccatgccggcccaacgggaagggcctgtaccgggggatgcttcgggggccgctccatggctaaggggggcctgggtcctttttgcttaaggacctacaggtacccccgcgtttccccccccccgaaaaaaaccggccccacatcccttaaagggggcgcctccctcccttctaattccgggggggacctttgggggggccgcccaaacaaaaggggccccccccgccccttttatacccggggccaaggtaagattctcccctcccccccactttgggggggaaaattttttatatatagggggccgctccccccggggg

SEQ ID NO: 73126 - protein, 147 aa, Zea mays
  misc_feature: Ceres CLONE 1557350
  misc_feature (96)..(96): Xaa is any aa, unknown, or other
MAPSSSPSPSAAGSHAGLAIAATAMALSGTLVLYSLCRAKQQRLVLPSSDDDAPSPRPRLRPCLSSSEKAKKKKREMARRGSQKRVRFADDVLGRXTCAAAAAPKEGGEPSWAAALRTPMPAQREGPVPGDASGAAPWLRGAWVLFA

SEQ ID NO: 73127 - DNA, 662 bp, Zea mays
  misc_feature: Ceres CLONE 1557355
  misc_feature (47)..(47): n is a, c, t, g, unknown, or other
  misc_feature (133)..(133): n is a, c, t, g, unknown, or other
  misc_feature (159)..(159): n is a, c, t, g, unknown, or other
  misc_feature (245)..(245): n is a, c, t, g, unknown, or other
  misc_feature (274)..(274): n is a, c, t, g, unknown, or other
  misc_feature (530)..(530): n is a, c, t, g, unknown, or other
  misc_feature (551)..(551): n is a, c, t, g, unknown, or other
  misc_feature (590)..(590): n is a, c, t, g, unknown, or other
tggagctccccgcggtggcggccgctctagaactagtggatcccccntgggctgcaggaattcgtctcacccctagaaaaagtcccttcctctcctgctgcctttctctcttctcggtgaagcgtgtgttcantttcactgttttggtttcatctcccngctctttctttaccccgtgctccggccaagtgctggaaccaagaaagcctcatgggggcagccggccgacgggcggtagagaggcngagatggggctggcgcctaagtggctgcncgggctgctcggcggcggcaagaaaggccgccgtgacaaaacctcgccaaagaaaaaaacctctgggggatttcgggaaaagttccttttccggggaaaaaggaacccccgccgcccccccagctttttgagaaaaaaggccttttgaaaaacccccttttgggggggacccccccagggggaaaaccccctcttccccccggggggaatatattttccgcccggccccaaaccacaaaaaaaaaaacaggggggnaaaaaaaaaaacaaaactcgnaaaaaaaaggggggggggggggggttttttcctcccccngtttgtttccccccccccacaaaaaaaaaaaaaaaaggtgtggttgtggggaaaaaaaaaaaaaaccccccc

SEQ ID NO: 73128 - DNA, 907 bp, Zea mays
  misc_feature: Ceres CLONE 1557356
  misc_feature: Encodes the peptide sequence at SEQ ID NO. 73129
  misc_feature (9)..(9): n is a, c, t, g, unknown, or other
  misc_feature (11)..(11): n is a, c, t, g, unknown, or other
  misc_feature (13)..(13): n is a, c, t, g, unknown, or other
  misc_feature (16)..(16): n is a, c, t, g, unknown, or other
  misc_feature (17)..(17): n is a, c, t, g, unknown, or other
  misc_feature (60)..(60): n is a, c, t, g, unknown, or other
  misc_feature (64)..(64): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (750)..(750): n is a, c, t, g, unknown, or other
  misc_feature (775)..(775): n is a, c, t, g, unknown, or other
  misc_feature (864)..(864): n is a, c, t, g, unknown, or other
  misc_feature (869)..(869): n is a, c, t, g, unknown, or other
taaaaaaangngnaanngggagggcggcgggggaaataaaaacagcgcaacccccgtgtnaaanaaaagcnnnnnnnnnaaaagctggagctcaccgcggtggcggccgctctagaactagtggatcccccgggctgcaggaattcgtctcacccctagaaaaaaaactgcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctccgacccggagggcaccgggggcttcatcgagcccaagtggctggcctatggcgaggtgatcaacggccgctacgccatgctgggcgcggtgggcgccatcgccccggagatcttcggcaagatgggcatcatccccccggagaccgcgctgccgtggttcaagacgggcgtcatcccgcccgcgggcacctacaactactgggccgactcctacacgctcttcgtcttcaacatggcgctcatgggcttcgccgagcaccgnccgcctccaggactggtacaacccngcggctcaatggggcaagcaagtacctgcctcgggcctcgaagaagtgcttcgccggtcttcggggcgacccggttcctaagacgggancggtngcccctcttacaaaccccggctccggacttccgggaaa

SEQ ID NO: 73129 - protein, 215 aa, Zea mays
  misc_feature: Ceres CLONE 1557356
  misc_feature (55)..(179): Pfam Name: Chloroa_b-bind Pfam Description: Chlorophyll A-B binding protein
  misc_feature (172)..(172): Xaa is any aa, unknown, or other
  misc_feature (201)..(201): Xaa is any aa, unknown, or other
  misc_feature (203)..(203): Xaa is any aa, unknown, or other
MAAQALLSGRQLLGRPVQSAVSRSSARKAPFVVRASSSPPAKQGADRQLWFASKQSLSYLDGTLPGDYGFDPLGLSDPEGTGGFIEPKWLAYGEVINGRYAMLGAVGAIAPEIFGKMGIIPPETALPWFKTGVIPPAGTYNYWADSYTLFVFNMALMGFAEHRPPPGLVQPXGSMGQASTCLGPRRSASPVFGATRFLRRXRXPLLQTPAPDFRE

SEQ ID NO: 73130 - DNA, 885 bp, Zea mays
  misc_feature: Ceres CLONE 1557357
  misc_feature: Encodes the peptide sequence at SEQ ID NO. 73131
  misc_feature (199)..(199): n is a, c, t, g, unknown, or other
  misc_feature (200)..(200): n is a, c, t, g, unknown, or other
  misc_feature (511)..(511): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (630)..(630): n is a, c, t, g, unknown, or other
  misc_feature (636)..(636): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (705)..(705): n is a, c, t, g, unknown, or other
  misc_feature (706)..(706): n is a, c, t, g, unknown, or other
  misc_feature (732)..(732): n is a, c, t, g, unknown, or other
  misc_feature (734)..(734): n is a, c, t, g, unknown, or other
  misc_feature (779)..(779): n is a, c, t, g, unknown, or other
  misc_feature (791)..(791): n is a, c, t, g, unknown, or other
  misc_feature (807)..(807): n is a, c, t, g, unknown, or other
  misc_feature (829)..(829): n is a, c, t, g, unknown, or other
  misc_feature (837)..(837): n is a, c, t, g, unknown, or other
ctccccgcggtggcggccgctctagaactagtggatcccccgggctgcaggaattcgtctcacccctagaaaaattcgtactctatatccagaaaacattgcgcaggaggcctttcttaataaaaaatcttgaaaatgttatgcgcaaattcctccaatccttggagttctttgaggaaaatgagaggaagaaactcgnnccatattcacaggccccctttggcattttttctccaaaaaagcctggttcggggggtttttctcccccccggaaaaaaagggtgtttccccccccttttgttttctaaagggaaaaaaattttgtggttgtgcccaaaaggggggggagaaaaaaatttttttttttttttttaaaaaaaaaaagaagggtttttttttttttgggggggggggccccccccgggggagaaaaaaaaaaaacacccccccggcgaggggaagaaaatttttttttgtttgccccccccccctctcttaaaacaaaaaactnccgaggagagagagatagggtgggtgggtggggggccccggcccccccccccccgccnnnggggggggggggggggataaataaatttttttattttttttnnntctcccccccccccncccccncagaggnnnnagaaaaaaaaaaacagcgccacaccccccccccccccccgggggggggggggtggagtnnttttttttttcttcctttggttggtngncacatggcgtccccactcccgttgcccccccctccacaccaaaanaagaaaaaaaantagaaagaaggggggnggggaggggggcggggttgggnacccctcncccgacaccacccccccttgctggtgttttgtttataagggtagatat

SEQ ID NO: 73131 - protein, 101 aa, Zea mays
  misc_feature: Ceres CLONE 1557357
  misc_feature (66)..(66): Xaa is any aa, unknown, or other
PRGGGRSRTSGSPGLQEFVSPLEKFVLYIQKTLRRRPFLIKNLENVMRKFLQSLEFFEENERKKLXPYSQAPFGIFSPKKPGSGGFSPPRKKRVFPPPFVF

SEQ ID NO: 73132 - DNA, 902 bp, Zea mays
  misc_feature: Ceres CLONE 1557362
  misc_feature: Encodes the peptide sequence at SEQ ID NO. 73133
  misc_feature (501)..(501): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (581)..(581): n is a, c, t, g, unknown, or other
  misc_feature (585)..(585): n is a, c, t, g, unknown, or other
  misc_feature (586)..(586): n is a, c, t, g, unknown, or other
  misc_feature (588)..(588): n is a, c, t, g, unknown, or other
  misc_feature (602)..(602): n is a, c, t, g, unknown, or other
  misc_feature (605)..(605): n is a, c, t, g, unknown, or other
  misc_feature (608)..(608): n is a, c, t, g, unknown, or other
  misc_feature (612)..(612): n is a, c, t, g, unknown, or other
  misc_feature (615)..(615): n is a, c, t, g, unknown, or other
  misc_feature (618)..(618): n is a, c, t, g, unknown, or other
  misc_feature (619)..(619): n is a, c, t, g, unknown, or other
  misc_feature (622)..(622): n is a, c, t, g, unknown, or other
  misc_feature (625)..(625): n is a, c, t, g, unknown, or other
  misc_feature (638)..(638): n is a, c, t, g, unknown, or other
  misc_feature (662)..(662): n is a, c, t, g, unknown, or other
  misc_feature (697)..(697): n is a, c, t, g, unknown, or other
  misc_feature (698)..(698): n is a, c, t, g, unknown, or other
  misc_feature (704)..(704): n is a, c, t, g, unknown, or other
  misc_feature (722)..(722): n is a, c, t, g, unknown, or other
  misc_feature (757)..(757): n is a, c, t, g, unknown, or other
  misc_feature (766)..(766): n is a, c, t, g, unknown, or other
  misc_feature (770)..(770): n is a, c, t, g, unknown, or other
  misc_feature (791)..(791): n is a, c, t, g, unknown, or other
  misc_feature (798)..(798): n is a, c, t, g, unknown, or other
  misc_feature (809)..(809): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (835)..(835): n is a, c, t, g, unknown, or other
  misc_feature (836)..(836): n is a, c, t, g, unknown, or other
  misc_feature (847)..(847): n is a, c, t, g, unknown, or other
  misc_feature (849)..(849): n is a, c, t, g, unknown, or other
  misc_feature (850)..(850): n is a, c, t, g, unknown, or other
  misc_feature (871)..(871): n is a, c, t, g, unknown, or other
ggagctccccgcggtggcggccgctctagaactagtggatcccccgggctgcaggaattcgtctcacccctagaaaaaaagcttcactcgcgtccgcccccgccgccgcctttcgtcccagcccctaaaccattctccattcctctcatcagtttagcacaatggcactggctaataagcttggtggtctgctcaagaaagccacaagttcaaatctgtctgtctaccaagcaatcagatgcatgtcatccaagctctttgttggagggatttcttatcaaactgatgatcacagtctcagggacgagtttgccaaatatgggcaagtcattgaagctaggattatcattgaccgtgaatctgggaggtctagaggttttggctttgtaacttacacgtcttctgaggaggcttcagctgccattactgccttggatggaaagactctcgatggacggagcatacgtgttaatcatgctaacgagaagacaggtggctttncgtggcggcggtggctatggtggcggcggctacggtggtggtgaggatataaggtgggggggggggggggccgtgnnnangggnngngggtggagggtaanggnggngggnggnggnnggnggngggaaaagggggngggggaactatggtggggaaacgnaaaaggggtgggggggtgggtgattatggaatttnnttgttntgaaaagtggaaggaaantttttagtggttggaaggtaaagaaaaagtttttntaaaaaagnaaantttagggtattaaaaagaganttttagntgggaaaaaangnnnnggagggaaattgaaagaaaannggggggggttnannagggggaaggtagtggggttntttgggggggggggggagaggaaaaattttt

SEQ ID NO: 73133 - protein, 127 aa, Zea mays
  misc_feature: Ceres CLONE 1557362
  misc_feature (32)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (114)..(114): Xaa is any aa, unknown, or other
MALANKLGGLLKKATSSNLSVYQAIRCMSSKLFVGGISYQTDDHSLRDEFAKYGQVIEARIIIDRESGRSRGFGFVTYTSSEEASAAITALDGKTLDGRSIRVNHANEKTGGFXWRRWLWWRRLRWW

SEQ ID NO: 73134 - DNA, 829 bp, Zea mays
  misc_feature: Ceres CLONE 1557363
  misc_feature: Encodes the peptide sequence at SEQ ID NO. 73135
  misc_feature (820)..(820): n is a, c, t, g, unknown, or other
ctggagctcaccgcggtggcggccgctctagaactagtggatcccccgggctgcaggaattcgtctcacccctagcccccctagaaaaaagtacataataagctaacagtccattccgtgcgcagccacaaagctagcttatttcccttcccttcacgcggcaagcggcggccggccttccgccgccatggccaccaccaccgcgcccgtcctcctcgtcttcctcgttgccattgccacgtccgtcgccccctcattccccatcctgacgatggcggcggacgcggacaacggcaccacccacctgagcttcttcatgcacgacatcacgtcgggcgccagcccgaccgcggtgaaggtgatcaaggggcccggcgcggggtccaccccgacggcgccggcgctgggcatgacgttcggcgacaccatggtgatcgacgacccgctgacggaggaggcgtcgcccgcgtccgccgcgctgggccgcttgcagggcttctacatgctggcgtcccagaccggggcggcgcttatggtgtgcgccaacctgctgctcacgtcgggggcccacaacgggagcacgctcgccgtgctgggccgcgacgacaccggccaggacgtccgggagatccccgtcgtcggcggcaccgggacgttccggatggccacgggatacgtgctgtggaagacgccggatgggatcaacggcaccgacgccgacgtccagctggatgtctacgtcaccacggacggcaacggcaccacggacgcgggcgacgccgaacgcggaggcggatccccgtccgcagggtcagggtcntcggggtcc

SEQ ID NO: 73135 - protein, 214 aa, Zea mays
  misc_feature: Ceres CLONE 1557363
  misc_feature (12)..(187): Pfam Name: Dirigent Pfam Description: Dirigent-like protein
MATTTAPVLLVFLVAIATSVAPSFPILTMAADADNGTTHLSFFMHDITSGASPTAVKVIKGPGAGSTPTAPALGMTFGDTMVIDDPLTEEASPASAALGRLQGFYMLASQTGAALMVCANLLLTSGAHNGSTLAVLGRDDTGQDVREIPVVGGTGTFRMATGYVLWKTPDGINGTDADVQLDVYVTTDGNGTTDAGDAERGGGSPSAGSGSSGS

SEQ ID NO: 73136 - DNA, 1080 bp, Zea mays
  misc_feature: Ceres CLONE 1557364
  misc_feature: Encodes the peptide sequence at SEQ ID NO. 73137
agctcattaccacctccgcctccgcgatcgaagctcctcacaaaccgttatcgtcgccatggcagccgccgcgcctgcaagctccgtgaaggaagtgctgccatctcccctgacctccgcctccgagccccctcccctcttcgatggcaccaccaggctgtacgttgcctatcattgcccgtacgcgcagcgcgcttggattgccaggaactacaaggacaagattaagatagtcgccatcgatcttgctgacaggccaacatggtacaaggagaaggtttatccagaaaacaaggtgccttctctggagcacaacaaccaggtgaaaggtgagagtttggatctggtcaagtacattgacagcaactttgaaggcccatcgttgctcccagaggatccttcaaaaaagcagttcgctgaggagctgcttgcatatactgatgcatttaacaaagcattatacttttgtatagtctccaaggaagatgtgtctgaggaagctgtcgctgctttggataaaatagaagacgccctcgggaaattcaacgagggtccattctcccttggtcagttcagtctggtggacattgcgtatgtaccattcatcgagaggtttcagatattctattccaacataaagaactatgatattacaaagggcagacccaaccttcagaagttcattgaggaagtggacaagattgatgcatacacacagactaaacaggacccacagtttttacttgagcagacaaagaagcggcttgggattgcttaaagcttgcggccgaggatgactctcgacagaaataccagcatagtagatcgacacttgtttagtcatttgtgtgcttgaataatgaatactacatatatggttttcaataagacatggtcctctatactgggttgtacttctgaaaacaaactagttgtcctgatattatagctttcgtggtgtgtttacgtcactgtatatgaaagggtggggagagagaatgatatgccatgtattctgtcaaatgtttttttataatgtcaagagctctgacttttaattaagaaaaaaaaaaaaaaaaa

SEQ ID NO: 73137 - protein, 239 aa, Zea mays
  misc_feature: Ceres CLONE 1557364
  misc_feature: SWISSPROT Homolog: EC 2.5.1.18 Glutathione transferase
MAAAAPASSVKEVLPSPLTSASEPPPLFDGTTRLYVAYHCPYAQRAWIARNYKDKIKIVAIDLADRPTWYKEKVYPENKVPSLEHNNQVKGESLDLVKYIDSNFEGPSLLPEDPSKKQFAEELLAYTDAFNKALYFCIVSKEDVSEEAVAALDKIEDALGKFNEGPFSLGQFSLVDIAYVPFIERFQIFYSNIKNYDITKGRPNLQKFIEEVDKIDAYTQTKQDPQFLLEQTKKRLGIA

SEQ ID NO: 73138 - DNA, 893 bp, Zea mays
  misc_feature: Ceres CLONE 1557365
  misc_feature: Encodes the peptide sequence at SEQ ID NO. 73139
ctccccgcggtggcggccgctctagaactagtggatcccccgggctgcaggaattcgtctcacccctagaaaaactgccttcccagtctcccatccctgaaaacctcacaaaaccctcgctcgctccccaccaccccgccgcgccgccgcctgtaccagctgcgtcaagatgagtcggcaccctgaggtgaagtgggctcagaggatcgacaaggtttacatcactgtacagttacctgacgcaaaggatgctaaggtcaatttggatccagatggtgtcttcacattctctggcagtgctggtacaaacttgtatgaattgaaactagatctgaatgacaaagtaaacgttgaggctagcaaaataagtgtgggggtcaggtccatattctgtatcgtagaaaaagctgaagccaaatggtggaagaaactcgttcgagatgatcaaagggcacctcactttgtgaaagttgattgggacaaatgggttgatgaagatgatgatggtgctgatatcaacatggatgggatggacttctcgaatttcggtggcatgggtggtatgggcggcatgggtggcatgggtgatatggctggtatgggtggtcttggtggcatggtgggtatgggtgggtcttggtggcatgggcggtatggggaatggatgatttctaagatgagagtgaatgatgaaaaagaaagtgtcgaaaccctcaagctgcgggacaaggctggttgaaggctgaaggagaccgaattccgctgcaaaaccaggaattggaggcggggttcagaacacgtttgagaaatggctttaatgattctaagcctagaaatggaatcctctccggttgaattactcggggaaatcggagaggaaacaaacctttacg

SEQ ID NO: 73139 - protein, 189 aa, Zea mays
  misc_feature: Ceres CLONE 1557365
  misc_feature (5)..(79): Pfam Name: CS Pfam Description: CS domain
  misc_feature: SWISSPROT Homolog: EC 5.3.99.3 Prostaglandin-E synthase
MSRHPEVKWAQRIDKVYITVQLPDAKDAKVNLDPDGVFTFSGSAGTNLYELKLDLNDKVNVEASKISVGVRSIFCIVEKAEAKWWKKLVRDDQRAPHFVKVDWDKWVDEDDDGADINMDGMDFSNFGGMGGMGGMGGMGDMAGMGGLGGMVGMGGSWWHGRYGEWMISKMRVNDEKESVETLKLRDKAG

SEQ ID NO: 73140 - DNA, 803 bp, Zea mays
  misc_feature: Ceres CLONE 1557370
  misc_feature: Encodes the peptide sequence at SEQ ID NO. 73141
aaagctggagctccccgcggtggcggccgctctagaactagtggatcccccgggctgcaggaattcgtctcacccctagaaaacagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggcctgcccagtcgtgctcatgggcgccatcgaggggtaccgcgtcgccggcggcccgctcggagaagtcgtcgacccgctctacccccggcgcagcttcgacccgcttcgccctcgcgaacaacctgaagccttcccgggactcaaagggaaggagctcaagaaccgccgccta

SEQ ID NO: 73141 - protein, 219 aa, Zea mays
  misc_feature: Ceres CLONE 1557370
  misc_feature (64)..(219): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACPVVLMGAIEGYRVAGGPLGEVVDPLYPRRSFDPLRPREQPEAFPGLKGKELKNRRL

SEQ ID NO: 73142 - DNA, 854 bp, Zea mays
  misc_feature: Ceres CLONE 1557374
  misc_feature: Encodes the peptide sequence at SEQ ID NO. 73143
  misc_feature (804)..(804): n is a, c, t, g, unknown, or other
ctggagctccccgcggtggcggccgctctagaactagtggatcccccgggctgcaggaattcgtctcacccctagaaaaaatttttcgcccgccgcccccagtcccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtccggcctgctccttatctctgggcctttcaagatcaatggagtaccgatccgccgtgtgaatcagacctatgtcattgctacatcaaccaaagttgacatctctggtgttgatgtcgccaagtttgatgacaagtactttgccagggagaagaagcagaaggtgaagaagaccgagggcgagctttttgagacagaaaaggaggcatccaagtcactgcctgactttcagaaggatgaccagaaggctgtggattctgctctgatcaaggctatcgaggctgtcccggagctgaaaacctatcttggcgcccggtctctctcagggatggtgaaaagccccatgagatgggtctctaagctcnttagttttggagttcggaggaaagctggttttgccgggggtctttgaacc

SEQ ID NO: 73143 - protein, 236 aa, Zea mays
  misc_feature: Ceres CLONE 1557374
  misc_feature (112)..(217): Pfam Name: Ribosomal_L6e Pfam Description: Ribosomal protein L6e
  misc_feature (1)..(49): Pfam Name: Ribosomal_L6e_N Pfam Description: Ribosomal protein L6, N-terminal domain
  misc_feature (222)..(222): Xaa is any aa, unknown, or other
MAPTSKLSTGIKRASRSHAYHRRGLWAIKAKNGGAFPKADKAAAAVEPKFYPADDVKPRVPSTRKPKPTKLRSSITPGTVLILLAGRFMGKRVVFLKQLKSGLLLISGPFKINGVPIRRVNQTYVIATSTKVDISGVDVAKFDDKYFAREKKQKVKKTEGELFETEKEASKSLPDFQKDDQKAVDSALIKAIEAVPELKTYLGARSLSGMVKSPMRWVSKLXSFGVRRKAGFAGGL

SEQ ID NO: 73144 - DNA, 829 bp, Zea mays
  misc_feature: Ceres CLONE 1557376
  misc_feature: Encodes the peptide sequence at SEQ ID NO. 73145
ggagctccccgcggtggcggccgctctagaactagtggatcccccgggctgcaggaattcgtctcacccctagaaaaaaggactaggagtccagtagcctgctagctatctatcagtgatccctcgcaagatcgaaacctgcgtcaccatcatccctgtcatcggctacatcggcataacaagacgcctcgatggttcgcaatcccagtcccagctgtcggcgggaggggctgaggatcgggagttcacgctggcggagatcgccgtggccaccaacaacttcgccgtcgtgctcagcaacgacgccgacactggcaccaaggtatacaagggaaggctcctgcagaacgggcctgaggtggccgtcaagcgcctcaaccgcgcgcggcggggagcggaggacgccttcttcgcggagcagcacatcctctcgccgctccgccacgaccgcatcgtccgcctcctgggcacctgcgccgacgacggcgagcgcatgctgctcacccagtacatgcccaacggctcgctccacgaccacctgcacgggcaccacctgtcgtcctcgtcggcgtcgccggtgacggcgtcctggaggactcgcgtccaggtgctgcttggcacggcgcgcgccctcaagcacctccactgcacgccggggcgctcatcatccacggaacgtcgcctcctcaacgtcctcttggacgcgcctgggcgccgcgccttggcggcttcggcgcatcgtgttggcccccggccgcgtggactccacccccgggaagcccctggccccccttctggggggggacccccacccgaaatctggcggacg

SEQ ID NO: 73145 - protein, 112 aa, Zea mays
  misc_feature: Ceres CLONE 1557376
MLLTQYMPNGSLHDHLHGHHLSSSSASPVTASWRTRVQVLLGTARALKHLHCTPGRSSSTERRLLNVLLDAPGRRALAASAHRVGPRPRGLHPREAPGPPSGGGPPPEIWRT

SEQ ID NO: 73146 - DNA, 846 bp, Zea mays
  misc_feature: Ceres CLONE 1557379
  misc_feature: Translation starting site: 155
  misc_feature: SWISSPROT Homolog: EC 1.11.1.11 L-ascorbate peroxidase
  misc_feature (650)..(650): n is a, c, t, g, unknown, or other
ctccccgcggtggcggccgctctagaactagtggatcccccgggctgcaggaattcgtctcacccctagaaaaaccaccgaattcattccacccccgtctcctccgatcggacggaccaccgggccagcagcggggcggatcgcgtcagcagccatggtgaaggcctaccccacggtgaacgaggactacctcaaggcggtcgacaaggccaagcgtaagctccgcggcctcatcgccgagaagaattgcgccccgctcatgctccgcctcgcatggcactccgcgggcaccttcgatgtggccaccaaaaccgggggccccttcggcaccatgaagaaccccgccgagcaggcgcacggagccaacgccggactggaaattgccatcaggctgctagagcccatcaaggagcagttccccatcctatcctacgctgacttctaccagcttgctggagtcgtggcagtcgaggtaaccggcggacctgatgtccccttccaccctgggaggcaggacaagcctgagcctccaccggaaggccgccttcctgatgccacccaaggttctgatcacctcaggcaggttttctccacacagatgggtttgagcgaccaggacattgttgcgctttctggtggtcacaccctgngaagatgccacaaggacaggtctgagattgagggagcctggacgtcccacccctttgatctttgacaactcttacctcaaagagcttctgaagcgagaggagggaagccttctgcagcttacaagtgacaaagccctcctctctgaatcatcctttcgccccactgttgacaaaacgcagccgaacgaggacgctt

SEQ ID NO: 73147 - DNA, 788 bp, Zea mays
  misc_feature: Ceres CLONE 1557383
  misc_feature: Encodes the peptide sequence at SEQ ID NO. 73148
  misc_feature (449)..(449): n is a, c, t, g, unknown, or other
  misc_feature (469)..(469): n is a, c, t, g, unknown, or other
ctccccgcggtggcggccgctctagaactagtggatcccccgggctgcaggaattcgtctcacccctagaaaaaaggctcctcgacagtcgatagcctcccaagtcccaactcgacctgagccgattcggaaggacggtttgcctacctctggttccggcggccatggcggtggcggcccctggccagctcaacctcgacgaggccccgtcatggggctcccgcagcgtagactgcttcgagaagctcgagcagatcggcgagggcacctacgggcaagtgtacatggcgaaggagacgggcaccaacgagatcgtcgcgctcaagaagatccgcatggacaacgagcgcgaagggttcccgatcaccgccatacgcgagatcaaaatcctgaagaagcttcaccaccagaacgttatcaagctcaaggagatcgtcaccctcccaggncccagagcgggacgagcaangggaagccaattgacggtaacaagtacaaggggagcattttacatggtttttcgagtatttgggaccatggatcccacccgggcttggctgaatcggccaggaaatgcggttccacttgggccgcacaaattaaatggttaaaatggagggaaccctgcttaaaaggcccggcccctatttgtcctggggcaaaccaaagttcccgccctcccaaaattttccaaaggggtcctaaaccctttttttaaaacaacatggagggggaaaaccttgaaaccttggggcgtattttttggccccctcgcaaaaaaaaaattt

SEQ ID NO: 73148 - protein, 148 aa, Zea mays
  misc_feature: Ceres CLONE 1557383
  misc_feature: SWISSPROT Homolog: EC 2.7.11.22 Cyclin-dependent kinase
  misc_feature (102)..(102): Xaa is any aa, unknown, or other
MAVAAPGQLNLDEAPSWGSRSVDCFEKLEQIGEGTYGQVYMAKETGTNEIVALKKIRMDNEREGFPITAIREIKILKKLHHQNVIKLKEIVTLPGPRAGRAXGSQLTVTSTRGAFYMVFRVFGTMDPTRAWLNRPGNAVPLGPHKLNG

SEQ ID NO: 73149 - DNA, 775 bp, Zea mays
  misc_feature: Ceres CLONE 1557385
  misc_feature: Encodes the peptide sequence at SEQ ID NO. 73150
ctccccgcggtggcggccgctctagaactagtggatcccccgggctgcaggaattcgtctcacccctagaaaaaaatccaaaagtcgcgtgctgtgctctgctctcgcctcgcacggactcgtggtaaaggatggagaccatgtcggctctcgcgaggacggcgccgccccttgctgggaccattcgccggccgtcctgcgcgctgcggccgacggcgtccctctccttcgccgccgcttcaacgacgccccgcggccggctcgggctggggctgagcacggcgccggcggggagcgggagggcggccagggctcgcgccgtcccgcagcgcatcgtcgcctcctcggaggttgagcgaagctacattatgatcaaaccagatggtgttcagcgtggtctggttggagagattatttctcgctttgagaagaaagggtttttgttgaaaggcttaaaacttttccagtgccccaaggacttggcgcaggagcattacaaggatttgaaggataaacctttctttcctaagctgatcgattacataacttctggcccctgttgtctgcatggcctgggagggtgcctgggtgttgttgcatcaagctcgcaaaattaataaggaactacttacccccccttcaagctgaaccccgggaaccattaagggggtggaatcttggcagtttcaaaactgggaagggaaacctttggtcccttgggaaaaggggaaaagtcccccgaaaaaaaaggggcccaagcccggggaaaaaattt

SEQ ID NO: 73150 - protein, 161 aa, Zea mays
  misc_feature: Ceres CLONE 1557385
  misc_feature (75)..(162): Pfam Name: NDK Pfam Description: Nucleoside diphosphate kinase
  misc_feature: SWISSPROT Homolog: EC 2.7.4.6 Nucleoside-diphosphate kinase
METMSALARTAPPLAGTIRRPSCALRPTASLSFAAASTTPRGRLGLGLSTAPAGSGRAARARAVPQRIVASSEVERSYIMIKPDGVQRGLVGEIISRFEKKGFLLKGLKLFQCPKDLAQEHYKDLKDKPFFPKLIDYITSGPCCLHGLGGCLGVVASSSQN

SEQ ID NO: 73151 - DNA, 843 bp, Zea mays
  misc_feature: Ceres CLONE 1557391
  misc_feature: SWISSPROT Homolog: EC 4.2.1.11 Phosphopyruvate hydratase
  misc_feature (16)..(16): n is a, c, t, g, unknown, or other
  misc_feature (20)..(20): n is a, c, t, g, unknown, or other
  misc_feature (24)..(24): n is a, c, t, g, unknown, or other
  misc_feature (237)..(237): n is a, c, t, g, unknown, or other
  misc_feature (620)..(620): n is a, c, t, g, unknown, or other
  misc_feature (621)..(621): n is a, c, t, g, unknown, or other
ctgggagctccaccgncggntggnacaggccgctctagaactagtggatcccccgggctgcaggaattcgtctcacccctagaaaaaaaagccatcttccttccgcggactagttttttctgaagattcggcgatggcggcgacgatccaatccgtgtaggcgcgccagatctttgacagccgcggcaaccctacagtcgaggtcgacgtgttttgctcagatggaaccttttgcanggcagctgttccccgtggagcatccactggtgtatatgaactctggagttgagggatggtgcctctgactatttggggaaggtggcttcaagggctttaaacaatgggattcctgttttttggacccgcctctgattgggagggacccttccgccccaaacgggaatttgtaccctcccggggtccacaccctttttggggacccaaaaaaaattggggggggggggcacaaaaaaaaacttgggggggaaaaagggaaatttcggcggggggtcaaataaacggttttttgaaaaacggggggggcccaccccacaaaagaattttttcttttttcccacaaaaattgtttccccccatcttttgggggaaacaaaaaaaannttgttggtccccccgcccccccccccctctttgttggtcccccaccggggggggtccccccctctggtaaaaaaacaaccctttttctttagaaaaaattattattatttttccccttcccccgggggaggggcgcccctcttttttttggggggcggaaaaaaaaaaaggggggggggggggagttttttatttcccccccccccgcgggctgtgtttttt

SEQ ID NO: 73152 - DNA, 816 bp, Zea mays
  misc_feature: Ceres CLONE 1557393
  misc_feature: Encodes the peptide sequence at SEQ ID NO. 73153
tcccgcggtggcggccgctctagaactagtggatcccccgggctgcaggaattcgtctcacccctagaaaaagcaaaatctagtctagagcgaaagaaatggcgagcgtggcctccgcgaggtgttacggccttctcctcccgccaagcttcgccggagcacggtgctgctcccgtccgtcctcttcgctccgtctgcggccgcggtggggcctgcgccggccgaggacccccctcgcctgcgtcgcgccgcccgactccgcggagccacagacggatgagcaggctgtgaaagctgaatctatccaagaagatgctccgactagtacacccgaggatgctgggcttccagctctcccgaataaggatctcaacagaagggtagcactactgtccactcttggagcggtggctctgtttgcatcccagaggctcaatcttagcgaggcatctcttaaagatcttgcagccaattcggttccatatgaagaggctctttcaaatggcaggcccactgtggttgagttttatgcagactggtgcgaggtctgcagagaattagctccggatatctacaaagtggaacagcaatacaaggaccgtgtcaattttgtgatgctgaatgttgacaacacgaagtgggagcaagagcttgacgagttcggggtggaaagcattccctcacttcgccctttctggattaaggaaggaaaccaaggaaaggcaaatgtttgtccggggagaactttccaaaagcagttattttcccttgaacaaaccgtggtttgcggccttggccttcctgggatgaaacccc

SEQ ID NO: 73153 - protein, 239 aa, Zea mays
  misc_feature: Ceres CLONE 1557393
  misc_feature (117)..(224): Pfam Name: Thioredoxin Pfam Description: Thioredoxin
  misc_feature: SWISSPROT Homolog: EC 1.8.1.8 Protein-disulfide reductase
MASVASARCYGLLLPPSFAGARCCSRPSSSLRLRPRWGLRRPRTPLACVAPPDSAEPQTDEQAVKAESIQEDAPTSTPEDAGLPALPNKDLNRRVALLSTLGAVALFASQRLNLSEASLKDLAANSVPYEEALSNGRPTVVEFYADWCEVCRELAPDIYKVEQQYKDRVNFVMLNVDNTKWEQELDEFGVESIPSLRPFWIKEGNQGKANVCPGRTFQKQLFSLEQTVVCGLGLPGMKP

SEQ ID NO: 73154 - DNA, 820 bp, Zea mays
  misc_feature: Ceres CLONE 1557395
  misc_feature: Encodes the peptide sequence at SEQ ID NO. 73155
ctggagctccccgcggtggcggccgctctagaactagtggatcccccgggctgcaggaattcgtctcacccctagaaaaaattatcacggcggcggtggcggagcggaaggcgaaggagtagcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctacccctgctgggttcatgggatgtcattttccatcccccaagaccccatgaagaactaccggcttgctgtacgataaccaaggggcgcttcccgcccttaccccaatcagggaatgaggatggctaagttccagcctttgcaaaggtaagggtctgtttccattttgggccaaaaagggccttcccgtcccctgaaaaccctttataaaggggcgggacccatttccgtttacccctgaaacccggtttttttaaggggcccaaaaaacacccccttcaaaagaatcgcttttctggggagaaccccaacaaaaaaatatttggggagaactcctcccaccaaaatttttttaggatggttttgggacaaaacactttgtttctcactggggggggaaaccaggg

SEQ ID NO: 73155 - protein, 106 aa, Zea mays
  misc_feature: Ceres CLONE 1557395
  misc_feature (3)..(40): Pfam Name: RS4NT Pfam Description: RS4NT (NUC023) domain
MARGLKKHLKRLNAPKHWMLDKLGGAFAPKPSSGPHKSRECLPLILIIRNRLKYALTYREVISILMQRHVLVDGKVRTDKTYPCWVHGMSFSIPQDPMKNYRLAVR

SEQ ID NO: 73156 - DNA, 871 bp, Zea mays
  misc_feature: Ceres CLONE 1557397
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
aaagctggagctccccgcggtggcggccgctctagaactagtggatcccccgggctgcaggaattcgtctcacccctagaaaaattcccatgcaccgcccgctgccgtgcccgccctgccctccaccttctcccggcgcaataaacaagtcgaggcgaggcgaggcggcagcggcggcggcggcattgccgagatttccgtgattcttgcgcttgttagttgcgctgtgtatagttgggcccggccgggggtggttccgtacagttccttctctgttggagtagtcggcggcgatgggtatcctcgcgctcatcaccggcaaggcgggcgccagcgggtttcgggtcggcgtccacggcggagcatgatcacccaacggcgccgacgccagccgcctcaccgtcgctatcacaggaagagctagtggcattgggtctggagacatcaagagtcttcggccctgagaggagccccatgtgggtcatcgctgctagaaaacacagaggctgcctcagaagcaagaaggacccttcatggagaaagaccccaccggccccgtatttggatgttctggaagctagaactcagcttcccctcaagtcttgttcaggggggctttttttttggggcccctttcccccctggaaaaactccccttcaaaaatcccctgaaaaaaaaagggcgggggnnnnnggggcagaggttgccgcccttttttacacggggaaaaaaaaaggggggtacaaaaaagattttccggaacaaataattttcgggaaactttttctgggtttaccaaatttccctccctttggaatacccctggaagggcccccttgcccaagttttcccgggggacttttggggggg

SEQ ID NO: 73157 - DNA, 852 bp, Zea mays
  misc_feature: Ceres CLONE 1557404
  misc_feature: Translation starting site: 299
  misc_feature (42)..(42): n is a, c, t, g, unknown, or other
  misc_feature (120)..(120): n is a, c, t, g, unknown, or other
  misc_feature (141)..(141): n is a, c, t, g, unknown, or other
  misc_feature (149)..(149): n is a, c, t, g, unknown, or other
  misc_feature (178)..(178): n is a, c, t, g, unknown, or other
  misc_feature (216)..(216): n is a, c, t, g, unknown, or other
  misc_feature (232)..(232): n is a, c, t, g, unknown, or other
ctccccgcggtggcggccgctctagaactagtggatcccccngggctgcaggaattcgtctcacccctagaaaaaaaaaaaaaaaaaaaaaaacctaggcctggcacgcactctcagtcntctcactgggaccgcgaccangcgctcangccttctggctccggaagctagctctccnggccagccaccccaccccgttccacccgacaatggcgngccgccgtggccctcnctcctgctctccgccctcggcggagcggcggcgcaggtgttccctccgtggaacggcacgttcccgatggggcccgggttcggaggcgggagcagcggcggcggcgcgggcgcgggcgcggggaccggcgtgccggcgatgttcgtgttcggggactcgctgacggacaacggcaacaacaacgacctgaactcgctcgccaaggctaactacccgccctacggcatcgtacttcgccggcgggccctaccggccgcttctccaacggctacaccatggtcgacgagatcgctcagctgctgggcctgccgctgctgccgtcgcacacggaccgcgcgtccaagcggcgcggcgacgcggcgctgcacggcgtgaactacgcgttcggcgcgggcggggatcctggacacacggggcaaaaacttccgggggcgcatcccgttcaaccgcaaattaagaacttcaagccaaccctggaccaactgggggccccgaaaaacaacaaaaaaacccgggccccgggccccgggcggccttggcccgaaaactctctctacggggggcatgggggaaaaaaaaaaaaccttaaaaaaatcccttgggcccaaatttaaaacccc

SEQ ID NO: 73158 - DNA, 778 bp, Zea mays
  misc_feature: Ceres CLONE 1557407
  misc_feature: Encodes the peptide sequence at SEQ ID NO. 73159
  misc_feature (471)..(471): n is a, c, t, g, unknown, or other
ggagctccccgcggtggcggccgctctagaactagtggatcccccgggctgcaggaattcgtctcacccctagaaaaaagtacactccacttgctagccatgacgaccctcgccgcgctgctccttctggttgccgcttccaatgtcgtcaaggccgtggagtaccacagctttgtagccaccccgctgtctccccacttgtacaccgctccgtccttggacgcggacgaggatgtcttcggcggcagccttgccgtcgcggaggaggcggccgcggcgtcagactcggccgtgcacttccgcgtggtccaccgggacaccttcgcggtgaacgccaccgcgggcgagctgctgaagcaccgtctgcagcgggacaagcgtagggcggcgcggatctcggaggcggccggcgccggcggtggcaacgggagaaagggcgtcgcggcgccggtggtctcggggctggcgcangggagcggggagtacttcaccaagatcggggtgggcacgccggccacgcaggcgctgatggtgctggacaccggcagcaacttggttgtgggtgcagtgcgccgccttgcccgccggtgctaccaagcaatccggccccggtggttcgaaccccggggcgctccaaacctcttaacggcccccctggggcttgcgggccccggcccctttgcccccaaagggtggaaacccggggggggcctccaaaacctggcgggcccccggggggcgtggcacattttaaccaaatgggggggccctaaacggg

SEQ ID NO: 73159 - protein, 226 aa, Zea mays
  misc_feature: Ceres CLONE 1557407
  misc_feature (124)..(124): Xaa is any aa, unknown, or other
MTTLAALLLLVAASNVVKAVEYHSFVATPLSPHLYTAPSLDADEDVFGGSLAVAEEAAAASDSAVHFRVVHRDTFAVNATAGELLKHRLQRDKRRAARISEAAGAGGGNGRKGVAAPVVSGLAXGSGEYFTKIGVGTPATQALMVLDTGSNLVVGAVRRLARRCYQAIRPRWFEPRGAPNLLTAPLGLAGPGPFAPKGWKPGGGLQNLAGPRGAWHILTKWGGPKR

SEQ ID NO: 73160 - DNA, 937 bp, Zea mays
  misc_feature: Ceres CLONE 1557408
  misc_feature: Encodes the peptide sequence at SEQ ID NO. 73161
ctcaccgcggtggcggccgctctagaactagtggatcccccgggctgcaggaattcgtctcacccctagaaaaaaaccaccacactacaactcgacaccgagaaaagcgcagcaaagcaacgcaaagcccacgccgctacagtgctacagcgagcgagcctcttgcctgccgctacgagccaacgactcgaacgcatacactccaatggcagcgacggtgatggcctccatgagccccctcgcctccgccacccccggcgcgcgtcgcgctttccctgtacggctgctgctccaggcatctgcgctcgcgccgcgccggcgcgccttggccgtgaccgtgagggcccagagcgacgacgccgaggccgagccaaaggaggcggcggcggcggccaccaccccggcgccaaagtccaaggcggcggcggcggcgagccccgggctgtgggacgcgctggcgttcagcggcccggctcccgagcgcatcaacggccggctcgccatggtgggcttcgtgtcggcgctcgccgtcgaggcgtcccgcggcaggggccttcctctcgcaggccggcagcgggtccgggcttccctgggttcgcgggccacggctgccttgctgtccgaggccctcgctggtggccgctgctcagggggggacagcgccaaagcccggaagcggcgcccaccaggaggcgcaaacgccgaagctctggaaacgggccgcttccgccatggttcgggcctcgagtgagctttggcattcagctgaagtacctcaaccgggggcaacgtgtttatcaaacgacgttagaggggggtataaaggccaaggccacggggcttttaatattttttggaaagttggaaaatcggtggaagtcctagctcccactatacggggacaccctgtccccggtataaaagaaagcctcctgct

SEQ ID NO: 73161 - protein, 181 aa, Zea mays
  misc_feature: Ceres CLONE 1557408
MAATVMASMSPLASATPGARRAFPVRLLLQASALAPRRRALAVTVRAQSDDAEAEPKEAAAAATTPAPKSKAAAAASPGLWDALAFSGPAPERINGRLAMVGFVSALAVEASRGRGLPLAGRQRVRASLGSRATAALLSEALAGGRCSGGDSAKARKRRPPGGANAEALETGRFRHGSGLE

SEQ ID NO: 73162 - DNA, 808 bp, Zea mays
  misc_feature: Ceres CLONE 1557410
  misc_feature: Encodes the peptide sequence at SEQ ID NO. 73163
agctccccgcggtggcggccgctctagaactagtggatcccccgggctgcaggaattcgtctcacccctagaaaaacaaaagaggaaaggcttgcggtggatacctaggcacccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaaggaccaccttgcaaggctaaatactcctgggtgaccgatagcgaagtagtaccgtgagggaaaggtgaaaagaacccccagtgggtagtgaaatagaacgtgaaaacgtgctgagctcccaagcagtgggagggggaaagtgatctctgaccgcgtggctggttgaagaaatgaagcgggcgactcaaaaggcagggggctttgggttaagggaaatggaaccccccccggaacccttaacgaaaaagggaaatttttctaagggggggaataggggcccccccctttttttggggggcccccccccccccc

SEQ ID NO: 73163 - protein, 87 aa, Zea mays
  misc_feature: Ceres CLONE 1557410
APRGGGRSRTSGSPGLQEFVSPLEKQKRKGLRWIPRHPETRKGVASDEMLRGVENKHRSGDSQIGQPFELPAESMSRQETTWRTETS

SEQ ID NO: 73164 - DNA, 831 bp, Zea mays
  misc_feature: Ceres CLONE 1557411
  misc_feature: Encodes the peptide sequence at SEQ ID NO. 73165
ggagctccccgcggtggcggccgctctagaactagtggatcccccgggctgcaggaattcgtctcacccctagaaaaaaatccccattgtccactccctccaaatccccgctgcgtcggccacacctcttcctcttacgcgttacacatcttcctcttcctctaaaattaacccagcgtctcgaccctgcgaattcatacgcgcgcgcgcgcgcgtgtgcacgtgcgcaggcgcggctggtagcctgcagacaccgacacgtagcagcggcgtcccgtcttccatcttccatggcggcggcgagctatgatcggctggccgtcgcggcgtccgctgtggtggtggcggcggtggcgctggcggtcgctgggctgcccgcggctggagcgctcggggtgaactggggcacgatggcgacgcaccagctgccgacggccaccgtggtgcggatgctggaggacaacggcatcaggaaggtgaagcttttcgacgccgacgccggccccatggacgcgctcgccggcaccagcgtggaggtcatggtggccatccccaacaacatgctcgacatgatgacggactacggcacggccagggactgggtgcgccagaacgtcagccgctataacttcgacggcggcgtgaacatcaagtacgtagcggtcggaaacgagcccttcctgtcgtctttcaacggcacgttcctgaacgtcacgctccccgccttgcagaaatccagcgcgctctgaacgacgcgggcttcggcgacacattcaggcgacggtgccgcctgaacgccgacgtgtacaactcgcccaaaggacacctagt

SEQ ID NO: 73165 - protein, 152 aa, Zea mays
  misc_feature: Ceres CLONE 1557411
  misc_feature: SWISSPROT Homolog: EC 3.2.1.39 Glucan endo-1,3-beta-D-glucosidase
MAAASYDRLAVAASAVVVAAVALAVAGLPAAGALGVNWGTMATHQLPTATVVRMLEDNGIRKVKLFDADAGPMDALAGTSVEVMVAIPNNMLDMMTDYGTARDWVRQNVSRYNFDGGVNIKYVAVGNEPFLSSFNGTFLNVTLPALQKSSAL

SEQ ID NO: 73166 - DNA, 828 bp, Zea mays
  misc_feature: Ceres CLONE 1557413
  misc_feature: Encodes the peptide sequence at SEQ ID NO. 73167
  misc_feature (417)..(417): n is a, c, t, g, unknown, or other
gagctccccgcggtggcggccgctctagaactagtggatcccccgggctgcaggaattcgtctcacccctagaaaaacctttgccctctccgcgcaccttccaccacgctctggattctggaagctgtttcccctttctcgagagtttagaaagctggtgcagagatggccggggagagctgcgtccccaagtccctgttcggcggcgccatcttcaccaccttccccgaccgcttccaggacgtgagcaacatccgggaggtccccgaccatcaggaggttctcgttgatccatcccgcgacgagagcctcattttcgagctacttgacctcaagggcgaggtggacgacgccggcggcgcgctctggttcctgcaagacatcgccaacgagcaagacgccgggggacaacttggntggtagagcattctgggacactttgaactggctgctttgcatctcggagaagcttctgcagtggctgcaactgcagttgggccagctggccgtctccaaaaggaagcagggccgagaaacccaaaacattggtcgaatttacctggcaaacatacccctttaagaatggcggcacccgatgtacttattccccccatatgaaccctttgtttgaaaaacccccttaaagaaaaatgctttgggccatttccccttggtccgggaaaaacctgcgtaaaaaaaaaagggggcctttcccaaagttctaaaggctttccaaacttgggggggaagaaattttaaagggggggggggaggggaaaccctttctcaaagggggccgccctttacccccaaagggggaaaaattct

SEQ ID NO: 73167 - protein, 85 aa, Zea mays
  misc_feature: Ceres CLONE 1557413
  misc_feature (8)..(86): Pfam Name: Mog1 Pfam Description: Ran-interacting Mog1 protein
MAGESCVPKSLFGGAIFTTFPDRFQDVSNIREVPDHQEVLVDPSRDESLIFELLDLKGEVDDAGGALWFLQDIANEQDAGGQLGW

SEQ ID NO: 73168 - DNA, 971 bp, Zea mays
  misc_feature: Ceres CLONE 1557416
  misc_feature: Encodes the peptide sequence at SEQ ID NO. 73169
  misc_feature (38)..(38): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
ttttagtgtgaaaagagtttggttcaagggatatcggnctatcttttaaaaaaagnnnnntttnnnnnnnnnnncccaaagctggactccccgcggtggcggccgcttctcaacagtggatcccccgggctgcatttactcgtctcacccctagaaaaaaggagaataaggaaaaaacaatggcggtgctactccgccgcgccgcggcgctcctcgtcgtcgctgctgtctgcgcggacggcgcctccacgttctactcctccgaccccaacctcggatccgcgcgcgtcgtcttccagacgaattttggtgatattgagtttggtttctttcctcatgttgcacctaagactgtcgagcacattttcaaacttgtgcggcttggatgctacaacacaaatcacttcttccgggttgacaagggtttctttgcacaagcccgccgatgttatgtcaggtcgaaccgcccctatgaatgaggagcacaaaaaaaaaacggagaaaacaattgttggtgaattttagtagtgtcaagcatgtcagggagaatccctctcccatgggaaagggcacttctgatccaaaacagtggctgggctccttcctttttccattccttctggggcaaattccaccgccatccttgaaggccccaggaatgcctggtaattttggggaaggggtcaaccttaaaggggggaaccaaatacaattggagataaagcctaagaagaagagctttcccaaacccccggaaaaaaaaaagggcaatttttttgttaaaggcccgaaatcggaacgggtaattcaaaacgttccctattcaaacacttaacatatttaagggaaaaatgcgaaaccctaaaaagaaaccctttgggaaacaccccaaaaaaaaaatccctttctccctccgcgggaagaggaaaaaaccttttccctggaaataacaagaccacccaagaaaaatg

SEQ ID NO: 73169 - protein, 99 aa, Zea mays
  misc_feature: Ceres CLONE 1557416
  misc_feature: SWISSPROT Homolog: EC 5.2.1.8 Peptidylprolyl isomerase
MAVLLRRAAALLVVAAVCADGASTFYSSDPNLGSARVVFQTNFGDIEFGFFPHVAPKTVEHIFKLVRLGCYNTNHFFRVDKGFFAQARRCYVRSNRPYE

SEQ ID NO: 73170 - DNA, 718 bp, Zea mays
  misc_feature: Ceres CLONE 1557419
  misc_feature (213)..(213): n is a, c, t, g, unknown, or other
  misc_feature (214)..(214): n is a, c, t, g, unknown, or other
ctccccgcggtggcggccgctctagaactagtggatcccccgggctgcaggaattcgtctcacccctagaaaaagtctcgtgtgaactgctgcggatcagtcgggggccataagacccttgcgcgctgcgcagcgcggcagcggtgggcggtggccggtggcaatggcgcccacgacttgcctccggatccccttcctccccgcccgaggccnngctccgctaaacgtcaacgcccctcgtcctgctccccgcgcttctctcaatcaggcgacaacgtgacattcctcccatccatttcactttccacttgccgcttggtaacggggcgaagcgtccactttggacttaaggggttctccccccccccccggttccgccctacatcccggggaaccgggcccccgggggtgtcccgcccccccaaaaccggaatttttggggcggaattaaaagggccacagtgttttccccggggttccctgggggggtaaacaaaaaagggccccaaaaaggggcccccccctttttggggggtggcccctcgggaaaccctttaaccccccttttttgggggggtaaaaaaaaaggggggttttaaaaggggggggccccccccccccaaaaaaaattttggggggggggggggaatctccccacaaacaatattttttttttgttgccccaatttttttttcttcttttctctttagaaaaaaa

SEQ ID NO: 73171 - DNA, 823 bp, Zea mays
  misc_feature: Ceres CLONE 1557421
  misc_feature: Encodes the peptide sequence at SEQ ID NO. 73172
aaaagctggagctccccgcggtggcggccgctctagaactagtggatcccccgggctgcaggaattcgtctcacccctagaaaaagcagcaaaaccgcgccccaccgcttccccgttccccaccccgaccgactgctccccctccccgcaccagcctcaagccctcaaggcatcgccggcgccgcaacttcgctgaggaagcccgcacccctgcccggatccgatggccaacagcaacctcccgcggcggatcatcaaggagactcagcggctgctcagcgagccagcaccggggatcagcgcgtcgccctcggaggagaacatgcgctacttcaacgttatgatccttgggccggcgcagtcgccctatgaaggtggagtttttaagcttgaactctttttacctgaggaatatccaatggctgccccaaaggttaggttcctgacaaagatttatcatcccaacatcgacaagcttggtaggatatgcctcgacattctcaaggacaaatggagcccagcacttcagattcgaacagttcttttgagtatacaggccctactgagtgcgccaaatccagatgaccctctttcggataacattgcaaagcactggaaagccaatgaggtagaagctgttgaaacagctaaggagtggactcgcctgtatgcgagcggtgcatgagaacgcagtgatgttcttgatgtaataacccatcatacttcagtcctcatctatggccatttgcttgataaaaaatagggtgggagaaatttggccagggaatgaagtctctacatgaatatcactccggaattggta

SEQ ID NO: 73172 - protein, 153 aa, Zea mays
  misc_feature: Ceres CLONE 1557421
  misc_feature (9)..(146): Pfam Name: UQ_con Pfam Description: Ubiquitin-conjugating enzyme
  misc_feature: SWISSPROT Homolog: EC 6.3.2.19 Ubiquitin--protein ligase
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKANEVEAVETAKEWTRLYASGA

SEQ ID NO: 73173 - DNA, 1226 bp, Zea mays
  misc_feature: Ceres CLONE 1557422
  misc_feature: Encodes the peptide sequence at SEQ ID NO. 73174
attgaggtggatcataacaaaaaagagaaaagaggagacacaacaacgatacgaacaatcaaaacagaacacaacaaaacaagaactccccgcggtggcggccgctctagaactagtggatcccccgggctgcaggaattcgtctcacccctagaaaaagagagcagagactgcagaactgaatatcccaacccaagtcccgaaccctccccaacactcccccgatctccgccactccaaaatgtggcgccgccaccacctcctccggctacttccacctccggccaccgccgccaccgccgcggccccttctcatttcctgcgccacctctctacctcaagcaccccgaccccggccgcctccctggcctcgtccctcgcgtcggcgctcaccgcgctctccacgaccccgccccccgccaccaccccggacgcttacctctccctccacttatctgacgtgccgggctaccaacgcgcccccccctgaggagctcgggctctctccgcccgacaattcccgagccgcagccgaattatcttggcgattaccgcctacggccgccgactcgctcacaccccttcctaaagggagaagctcccgcccaaagcagtaccatacaaccttagaacccgaagatcgcccaacttttacccgctaagaagccgcgcgacccctttaattccaaatgaaggtttttctccacatcccactttcccaatagggcccccccactaaatgtctttcatgagcaacccctaacaactctgcctcatacgctaagaccttgtcgtcactaacagagagaactccggggtagtctggcctcctcaaaatgtgaagataacccgccatgcgtgcactcgcggcgtgtcgcgcgtctgccacctcacaataatagtacgtcgtgacataaaaaacacacatagtactactcgcttttgagcgctgggaggcagaaggcgatagatctccacacttagtgccgagacaggaggacacgcccgcaatagcatcctctgttatatgtacaggaggagggtgaaactactgccacgctgtggcggtggcctaagaacgagtggatgcatttgcataaaacgcaaaagagtgagacaactacgcgcgtagaaatcagtctcctcacgctaagattgaacgtactgatgtatgggcgactcagtgtcaacgttcattcaagacgtgaagcgcactaacaatcggc

SEQ ID NO: 73174 - protein, 82 aa, Zea mays
  misc_feature: Ceres CLONE 1557422
MWRRHHLLRLLPPPATAATAAAPSHFLRHLSTSSTPTPAASLASSLASALTALSTTPPPATTPDAYLSLHLSDVPGYQRAPP

SEQ ID NO: 73175 - DNA, 848 bp, Zea mays
  misc_feature: Ceres CLONE 1557423
  misc_feature: Encodes the peptide sequence at SEQ ID NO. 73176
  misc_feature (628)..(628): n is a, c, t, g, unknown, or other
  misc_feature (694)..(694): n is a, c, t, g, unknown, or other
aaagctggagctccccgcggtggcggccgctctagaactagtggatcccccgggctgcaggaattcgtctcacccctagaaaaactctctctgtctctctaggttttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgccgccgctgccaaggcctcttctaaaaagaaagaaagtggtaaatcctccgtccttatggatgtcaaaccatgggacgatgagactgatatgaagaagctgganggagctgtccgcagtgtccagatggagggtctgaactggggagcatcaaagcttgtgccctgtggnatacggcatcagaagatgactatcaggttgacaattgtcgaccaatcttgtgttcctcgaacctcctattgaggacacccttacccaagagccctccaatgaatacgtccagagtgccgaatttggggcttccaccaaaactaaaattcagttt

SEQ ID NO: 73176 - protein, 195 aa, Zea mays
  misc_feature: Ceres CLONE 1557423
  misc_feature (130)..(193): Pfam Name: EF1_GNE Pfam Description: EF-1 guanine nucleotide exchange domain
  misc_feature (150)..(150): Xaa is any aa, unknown, or other
MAVFSDLHTADGLKSLEAHLAGKTYVSGDSITKDDIKVFAAVPSKPGAEFPNAARWYETVSAAVASRFPGKAVGVNLPAGSAPAAAAPADEAEDDDDLDLFGDETEEDKKAADERAAAAKASSKKKESGKSSVLMDVKPWDDETDMKKLXGAVRSVQMEGLNWGASKLVPCGIRHQKMTIRLTIVDQSCVPRTSY

SEQ ID NO: 73177 - DNA, 835 bp, Zea mays
  misc_feature: Ceres CLONE 1557424
  misc_feature: Encodes the peptide sequence at SEQ ID NO. 73178
ctggagctccccgcggtggcggccgctctagaactagtggatcccccgggctgcaggaattcgtctcacccctagaaaaaaaaaaatctccagcggcttcttccaaagctccaactccgacgagaaccgccactcctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgccttcatgagcatggagaggaggatcatattgaaaggctttggtgctgaacttgtccttactgacccactctgggaaatgaaagaactgtccaggaaagcggaagaaatacaagcaaagacccccaattcgtaacttctttcaaaattttgaaatcccgcctaacccaagaattcccttttaaacttccggggcccgaaaatttggggaaagcctccgcggggaaaaattgggggggccccttgtttttggggaaccgggggccggggggggtccccttcccccggggatcggggggggaaaacccctcgaaagagaaaaaaatccttctgggggtaggacgccc

SEQ ID NO: 73178 - protein, 145 aa, Zea mays
  misc_feature: Ceres CLONE 1557424
  misc_feature (12)..(146): Pfam Name: PALP Pfam Description: Pyridoxal-phosphate dependent enzyme
  misc_feature: SWISSPROT Homolog: EC 2.5.1.47 Cysteine synthase
MGEASPSIAKDVTELIGNTPLVYLNKVTDGCVGRVAAKLESMEPCSSVKDRIGYSMITDAEEKGLITPGVSVLIEPTSGNTGIGLAFMAAAKGYKLTLTMPAFMSMERRIILKGFGAELVLTDPLWEMKELSRKAEEIQAKTPNS

SEQ ID NO: 73179 - DNA, 845 bp, Zea mays
  misc_feature: Ceres CLONE 1557426
  misc_feature: Translation starting site: 546
ccccgcggtggcggccgctctagaactagtggatcccccgggctgcaggaattcgtctcacccctagaaaaaatccctaggcgcaggccggctcgccgtcatctcgtctcgggctctcggctcggctcggccacccaacgggcaagacgacgagggtttttgccgccgccatggcgatccctcgagcacgtctaactcgcctgctcctccacttcggcagccggggctccagattcctagcgcaacccttctctacctcttcctccgcacacggcctcttcccctctctgtggccgacgccgtccaccgccggcgcgtggcggcgcgcgttccacgatgggcggccgcgagggccgctgtgacggagcaagaagctgatcgggaaggaatccctatttgcgatccagggcctcaagcggttcaagggggacgaggagaagctagcggatttcgtgcggcggtatgtggccagactgctcaaggcggacaagctcgccgtgctcggcgagctggaacgccaggaggaggtcgatctggctgtcaagatgtttaggatcatacaaaaggaggactggtataaaccagatatttacatgtacaaagacttgattattgcactagccaaatgcaagaagatggaggaagcaatggtaatctgggggaacatgagagatgagaacttgtttcctgactcacagacttatgccgaagtaataaagaggattcttgagatatgggctcccatcagatgcaaggaatatttatgaggacatgaaaaagtcacctgattcaccagaggagttacccttttagggtattgtttgaaggggctttttacctccccc

SEQ ID NO: 73180 - DNA, 881 bp, Zea mays
  misc_feature: Ceres CLONE 1557431
  misc_feature: Encodes the peptide sequence at SEQ ID NO. 73181
ctccccgcggtggcggccgctctagaactagtggatcccccgggctgcaggaattcgtctcacccctagaaaatgttcccggcctaaacggaggcggccgtataaaggcattctcctcgcgccccacccggcggttatcttcaccaccatatcgacatcgacgccagcgagccaaggacagaacagccggcgcccggccctaaaactgccgtgcagcgggagagaagcgagggaaagatggaccggtaccagagagtggagaagcagagggaggaggcacccatcaaggaaaacgagatccgcattaccacgcaggggaggatgcgcaactacatcacctacgccaccggcttgcttcaggacaaaggttctgatgaggttgtattcaaggccatggggagggctatcaataagactgtcatggttgtggaattgatcaagaggaggattgttggcctccatcagaataccaccactggatctactgatattactgatatgtgggagccattggaggaaaggccctacttcgcttgagacaaacagacatgtctctatgataactataactctttcaaagaggagctggacacatcatctatcggatatcaatctcctttgcctgctgatgaagtgaagcctttggttaaatatgataatgacgaggattgccccctcccttgtgggccttgaaaggggtcctggtgttcaaagccttgggcggggcaagaaaaggggaaaagggggaaccggaaaagggttcaaagacaaaccctaatcccggtggaaaaaaaaaaccccccccctcaataatgggcaaggaatatcccccgggaaaaagggctaattttttggggccccgggcaagaaagggggctaca

SEQ ID NO: 73181 - protein, 99 aa, Zea mays
  misc_feature: Ceres CLONE 1557431
  misc_feature (17)..(87): Pfam Name: Alba Pfam Description: Alba
  misc_feature: SWISSPROT Homolog: EC 3.1.26.5 Ribonuclease P
MDRYQRVEKQREEAPIKENEIRITTQGRMRNYITYATGLLQDKGSDEVVFKAMGRAINKTVMVVELIKRRIVGLHQNTTTGSTDITDMWEPLEERPYFA

SEQ ID NO: 73182 - DNA, 895 bp, Zea mays
  misc_feature: Ceres CLONE 1557432
ggagctccccgcggtggcggccgctctagaactagtggatcccccgggctgcaggaattcgtctcacccctagaaaaaatccccatccactctactttacaccgcaggcagtgagccagccactgagccaccaagttaactctgagcgacgtcaagcaccaacgcacgacgaccaccaccaccacctcgagctacaagctatggcgaagcgtctcctccgctcttcgtcccttcctctggccctggtgccgccgccgctgctgcttctcctggtagcgggatcgctcgcaggggcaaccgcgcttggcagcttccctggggaacgtcgtggtcgaagcctgcagcagctgccaaacccgatgcctcagcctgtcccgcagccgcagccagacccaaacgtacggccgcaaccggggtcgccgaaaccactgccaccacagcccctgccgcaaccaaatccaaaacctcagccggagccccttccgcaaccacagccaggccggcagcctgacccaaacccacaacctcaacctcaggcctcagcctcttccggaagccaaaggcctgggccaaatcccgccgcaacccggacccgaaccgggaacccacagcccaaaacctcaacccttggccaaagccttttcccgaaaccaaaggctggggcccaattcccaaggcctaaacccaaaacccaaacccccaggccctgtgcccaattcccaaaaccccaaatggggggggagccccaaatcccaaaacttggttcccaaaaaaaaaaccaccaaccccccgtctggaataccctctcccccggggggtagaaagacacatttctctaaagggaaaaaatgaggggtggttagacccccctatttccccgtggtttttttagagt

SEQ ID NO: 73183 - DNA, 803 bp, Zea mays
  misc_feature: Ceres CLONE 1557434
  misc_feature: Translation starting site: 420
ctccccgcggtggcggccgctctagaactagtggatcccccgggctgcaggaattcgtctcacccctagaaaaaaacttgttcagggagttccactccactctcccataatgaggataggggcaggggcgaacatggctgcgtgctcctccgttccctgctccttccccgcgaagcctgaccctcaccgccgaagccccagcggcatcttaagctctcatctccctcggctccctgctacccagtttcgtcggcttcgatcactctctgccgccgcctcgccgccggcgagtcgcctccgcccacgagcctccgtgtccacgtcgcccgccccgtctaaggactacgagttcactgacgggaacggagaggtggagctgagactggacatccaaaagctcggcatagcgagttcaaaagatgttttcgttgatgtcgatgacacatccctactcatcagaggccagttctgacgggacactgaggactttggatgaacgtccaaacccctgttttgaaaggattaaagccttcccaagaccatttgggttccatcaaataaggacccaatttgggggggggaattctttaaaaaaagtttaaaccccaaaattttgaaaatggggccctgaattgtaaaaaaaaaacccccggggaaacccccccccacctttttggggggaatcccccccccctcttttgggaaagggggggatatacgggggggccccccacccctgtgggggggggaaattcccccccgccccccttttatattagggggggggggtttgttttttaaaa

SEQ ID NO: 73184 - DNA, 800 bp, Zea mays
  misc_feature: Ceres CLONE 1557435
  misc_feature: Encodes the peptide sequence at SEQ ID NO. 73185
ctccccgcggtggcggccgctctagaactagtggatcccccgggctgcaggaattcgtctcacccctagaaaaaatccaccagctgctgaggtcgtctgccatggcggagcgggagcagctagagcaggtggctagcgacgactcggcggagtggaagcaggtggcggagctgagggccgtcacccttgcccaggacccttcctgctgggatgaggacgactacacgctccggcgcttcctccgcgcgcgggaccactacatcggcgaggcgtcggcgatgctgctcaagtacctcaagtggaagcccgcggacaagccccaccgcgccatcgcagcgacggaggtggcgcgggatgcggcacaggggaagctctacctgcatggccacgaccgggagggccgccccctcatctacggcttcggcgcgcgcctccacccggcgcgcagggacctctactagttcaagcgctacgtcatccacgtcctcgacgccgcctgtgcgcgcctgccccctccccctccgggagatggtcggcatgagaatttcgccgccgtcgccaacctcgccggctggagctacgcctactgcaacatccgatgctacctggcggagctgcgaatcatgcaaagctactacccagagagcctcgcccgcgtcttactcgtctaagtgccctacgtcttcatgggcgcctggaacatcgtctatccctttatctgacgacacggctagaattaagttcgtctttctagcccgactaggaaccggacaggacgcgtcccgaagcccgtcgactac

SEQ ID NO: 73185 - protein, 119 aa, Zea mays
  misc_feature: Ceres CLONE 1557435
MAEREQLEQVASDDSAEWKQVAELRAVTLAQDPSCWDEDDYTLRRFLRARDHYIGEASAMLLKYLKWKPADKPHRAIAATEVARDAAQGKLYLHGHDREGRPLIYGFGARLHPARRDLY

SEQ ID NO: 73186 - DNA, 820 bp, Zea mays
  misc_feature: Ceres CLONE 1557438
  misc_feature: Encodes the peptide sequence at SEQ ID NO. 73187
ctggagctcaccgcggtggcggccgctctagaactagtggatcccccgggctgcaggaattcgtctcacccctagaaaaaacgcggccactggctcctcctccctgtcctgctaggctgctggctgctgctacttactactttgtacccgcgccgctcacgcccatccatcccttcgcgcacgcaacgcaaaaacaagcacaaacacgcgcgatccgatctgggccggccaagcagccacccatccatggcgactagggtttggctcaccgccctcctgcttggtttcctcgtcgccgcctcccccttcaccagccgagttgctagagctgaatccgaggaagatgctgctgcagctgaggttgttgaaggggctgatctaggtattgtgggtgatgatacacaggtttccagtgatggacctttaagtcctgctcctggtgtagagacagtagttgtcttcccaaaaaatgctggcaaaattgtactagcaggtgaagaaactgaattactagttggtctgcaaaatgacggtgaatcaattttgaatgttgttgctgttcattcaactctccatcttccttttgaccacatatgtatggccagaaccttactgttcagaatttcttcaattcatcagtttctgtttctgtgcaagcaaccttcccctacaagttcgttgtgagcaagttcttgcagcctggaacatatgaactggttgggtacatagtgtatgagatcgaccagcacccttaccggaaagtattctacaatgcacttattcaggtgtttaggctggaagcttacccaagggttgaata

SEQ ID NO: 73187 - protein, 145 aa, Zea mays
  misc_feature: Ceres CLONE 1557438
MATRVWLTALLLGFLVAASPFTSRVARAESEEDAAAAEVVEGADLGIVGDDTQVSSDGPLSPAPGVETVVVFPKNAGKIVLAGEETELLVGLQNDGESILNVVAVHSTLHLPFDHICMARTLLFRISSIHQFLFLCKQPSPTSSL

SEQ ID NO: 73188 - DNA, 831 bp, Zea mays
  misc_feature: Ceres CLONE 1557440
  misc_feature: Encodes the peptide sequence at SEQ ID NO. 73189
  misc_feature (462)..(462): n is a, c, t, g, unknown, or other
ctggagctccccgcggtggcggccgctctagaactagtggatcccccgggctgcaggaattcgtctcacccctagaaaaaatgggccaacgaaaaagagtgacgtttcttcaccaatcaccctgcgtttgttctcctgttcatcacccgtgcgtgctctctctctctctctctctctctctcgtgcggcaactgcgaggccgccgacgcccgacggcagggtgcccaggccttcttcggtcccatcgcgaggccatagttgcatcattcgcctgagacgactgcccagcaccaggactgatctcctcactaggggcgtagaggtgaagagaagaacttgacaatgagcagcataggcacaggttacgatctgtctgtcaccaccttctccccagatggtcgcgtcttccaggtcgaatatgctaccaaggccgtcgaacacagcgggactgttgttgggatncagtgcaaagatggcattgtcctgggtgttgagaagcttgtaacctcaaagatgatgctggaagggtcaaacccggagatcatttcgtgcaccggcactctgggcttggctgttgcttgtttaacaccagatggcaggccaaattttttcaaggacaaagtccaaagccttgccattttgaaaagggtctatgggaaaaccctttcctgtaaaggaaattggcttaatccccggggcaaatttatttttcttcttttgccccctttaactgggggggcccaggcccttttgggcctgccggggttttttttttggggggttttttataaaagggggggggggcccaccactctttcctggtaaaaaaac

SEQ ID NO: 73189 - protein, 160 aa, Zea mays
  misc_feature: Ceres CLONE 1557440
  misc_feature: SWISSPROT Homolog: EC 3.4.25.1 Proteasome endopeptidase complex
  misc_feature (40)..(40): Xaa is any aa, unknown, or other
MSSIGTGYDLSVTTFSPDGRVFQVEYATKAVEHSGTVVGXQCKDGIVLGVEKLVTSKMMLEGSNPEIISCTGTLGLAVACLTPDGRPNFFKDKVQSLAILKRVYGKTLSCKGNWLNPRGKFIFLLLPPLTGGAQALLGLPGFFFWGVFYKRGGGPTTLSW

SEQ ID NO: 73190 - DNA, 984 bp, Zea mays
  misc_feature: Ceres CLONE 1557441
  misc_feature: Encodes the peptide sequence at SEQ ID NO. 73191
  misc_feature (19)..(19): n is a, c, t, g, unknown, or other
  misc_feature (20)..(20): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (42)..(42): n is a, c, t, g, unknown, or other
  misc_feature (44)..(44): n is a, c, t, g, unknown, or other
  misc_feature (48)..(48): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (104)..(104): n is a, c, t, g, unknown, or other
ggggggggggggggggggnncaaggaannnnnggcnnntttnanaagnatttnnnnttnnntcccacttnnnccaaaacggagctccccgcggtggcggccgcnctacaacagaggagcccccgggctgcatttacacgacgcgcccctagaaaaaaagccggacaaagctacgcaaggagggagaaagcccgtaaaccatggcgtcctccgcgttcctcaacgctctcgtcctccgatcgccatcaccgtcgctctcgtcctcgtctaacctccgcagcaccggcgccttcgcgttcccgaaaccaccgcgcttcccatgcctgcgttctgcgcgtcgactcgtccttgcgagggcggcggcagcgccggcgccgggcgatggccccgaggacgagttggggccggagcccgagggcggttcctctgtcacgggggccgcggtggcggaggcgccagaggcgagagaggtcgcggagctcaaggcgcagctaaaggacgcgctgtacggcacggagcggggcctgcgggcgtccagcgagtcgcgagccaaagtgctggagctcatcacgcagctcgagacgcgcaaccccacgccggctcctacggaggcgcttacgctccttaaccgcaagggggaccctcgcggacacatcggtttccccaactattcccactaatgggggtttgggaaacctgcctcagcctggtggaagggggaggaaaaaatcacaaacccttggaatccggaaaaacttcacaaggggaaaaaccggatcaaggttttccaggaacctttggggcaaaacccccaaagtggccaccaaagggcaaaaatttggaaaatagaaaacccccaaaggggggggccagaaacaaaaattgaaaaagagaggagaattgggggggcacaccccaccggggggacccgaacacccattggggggcaccccggaaaaaaagttgagagagatattttcggggg

SEQ ID NO: 73191 - protein, 159 aa, Zea mays
  misc_feature: Ceres CLONE 1557441
MASSAFLNALVLRSPSPSLSSSSNLRSTGAFAFPKPPRFPCLRSARRLVLARAAAAPAPGDGPEDELGPEPEGGSSVTGAAVAEAPEAREVAELKAQLKDALYGTERGLRASSESRAKVLELITQLETRNPTPAPTEALTLLNRKGDPRGHIGFPNYSH

SEQ ID NO: 73192 - DNA, 792 bp, Zea mays
  misc_feature: Ceres CLONE 1557442
  misc_feature: Encodes the peptide sequence at SEQ ID NO. 73193
  misc_feature (611)..(611): n is a, c, t, g, unknown, or other
  misc_feature (663)..(663): n is a, c, t, g, unknown, or other
ctggagctccccgcggtggcggccgctctagaactagtggatcccccgggctgcaggaattcgtctcacccctagaaaaaaacgcctccgccgctccttccattagctcagacatggttctcggcctctacaccttcgccgacatcgacgccgacggagcaccccgcctcgaggttgccgatggcgaggagttcgtccgtgtcgatcgcgttgtcgagcttgccctcggtccccgggtgctgaaggcccctggaaccctttacctcaccaccaggagggtgatttgggtcagcgatggcggcgagggctacgctgtggacttcgttgccatctcgctccacgccgtgtcgcgtgatcccgaggcgtatccatacccctgcatctacacacagatcgagacggaagctatttctgacgaggagtctgatgtgtcagattctgaaacaaatggagaactcgagctctcaaaagttatggaaatgcgcatcataccttcagatcctggtcaattggatgaactctttgaagcattctgcaattgcgctgagcttaaccctgatcctagtgctgagagtgatgaagaacatggctgggttcatggtgatgagggntatgaagatacggtagatgggagcgacactgagttttcagattgtcacccanttggtcaaactggtgagcaggatattaaccatgctgtaatcgagctccagatcaatggaccaacgttttgaagcacccggtaaatgagggaaattcccgggaacgggaacctaggaaccctgttgaatt

SEQ ID NO: 73193 - protein, 206 aa, Zea mays
  misc_feature: Ceres CLONE 1557442
  misc_feature (44)..(119): Pfam Name: ICln_channel Pfam Description: Nucleotide-sensitive chloride conductance regulator (ICln)
  misc_feature (184)..(184): Xaa is any aa, unknown, or other
MVLGLYTFADIDADGAPRLEVADGEEFVRVDRVVELALGPRVLKAPGTLYLTTRRVIWVSDGGEGYAVDFVAISLHAVSRDPEAYPYPCIYTQIETEAISDEESDVSDSETNGELELSKVMEMRIIPSDPGQLDELFEAFCNCAELNPDPSAESDEEHGWVHGDEGYEDTVDGSDTEFSDCHPXGQTGEQDINHAVIELQINGPTF

SEQ ID NO: 73194 - DNA, 837 bp, Zea mays
  misc_feature: Ceres CLONE 1557445
gagctccccgcggtggcggccgctctagaactagtggatcccccgggctgcaggaattcgtctcacccctagaaaaactagaaaaaattttcctcatccattccaatcaatcggaccgacaccggctaaccctagcttctgtttggctgttgccttgcgggtggcggctgctttggtgcgctgcgcagtgcgctccgtccgtccgtcgaccggaaggccgtcccctggcccctgctcgtcgtcttcctcgggcgctcgtcttcctccgaacgcgcgcgggccgccgacctgcttgttctcctggaggagcgcgcccggcgggcaggcgacgcagtccagcggcgggttgaggaagaaggcgagcgaccggtggatccccgtccagccgtcccctgctcctcttcctcgggtcgggcgctcgtcatccactcttcctccagccctccatctgatccccgtacgaccgtcccctgctcgtcttcctggtgctcggctgctccagtgctcggcccctgctgcagtgctgctcggtcgcgtcggcacctgctgcagatctgctcgacctcggctgctcggcttcctggtaacctggttcctgctgaagtgctgattctagagtctgctgcgtacgtttagtagtatcaggatttttaagtgggttactggcagaaccaatattgtttctaaattctaagtgggctgttggcggggatttttccccatcggatccccgtatacccgacagggacagttccttctgctacaaatcatagtcactgatggggaaaggcagtcgcgtcctcttcgaactgaatcgcgccgcgatcacccacttat

SEQ ID NO: 73195 - DNA, 906 bp, Zea mays
  misc_feature: Ceres CLONE 1557446
  misc_feature: Encodes the peptide sequence at SEQ ID NO. 73196
  misc_feature (59)..(59): n is a, c, t, g, unknown, or other
  misc_feature (60)..(60): n is a, c, t, g, unknown, or other
  misc_feature (87)..(87): n is a, c, t, g, unknown, or other
caaaaaaaaaaaataaaaaaaacaaaaaaaaaataaaacaataaacacaaaagagattnngggcaacctacaaaccgtgaccactcncaaggaggcggccttttttcatctgtggatcccccgggctgtttgaattcgtctcacccctagaaaaagccacgcccgcgcaatcctctcaacagtcgacaccgccgatggcatcagccgcgcccgcgcccaagccaggggtcctcctcctgcgccgcacggacgcggacttcgccgccgcgctgcgggcgcgcttccgcgtccacgacctgcacgcctcgggcgcgccgctcggggccttcctcgccgccgccgcggcggaaccggagcccccgcgcgccgcgctcgtgatggccggcggcgccgtcctggtcgacgccgcgttcctggacgccgtcccctccctcggctgcgtcgtcaccacgagcgccggggtggaccacgtcgacctggcccagtgcgcgcggcgcggcgtcgccgtcgcgggcgcgggcgggaccttctccgtcgacgtcgctgaccacgccgtcgggctcctcgtcgccgtgctccgccgcgtcgccgccgccgaccgctacgtccgcgctgggctctggccggcgcagggggattacccgcttaccaccaagctcagcggcaagcgcgtaggcatccctcgggctgggcagcgtcggcctcactggtcgccaagcgccttccaggcattcgggctgcgccctggtccctacccactcgaggggcgcgcaaagggcctccgttcgcccttacggcttaccttcccccgaaaggccccgcggggcttcgaccgcggggggctcccgaaagaccctttgggtccgttccccggttgccgccgcccttaaaacaaacagccccact

SEQ ID NO: 73196 - protein, 231 aa, Zea mays
  misc_feature: Ceres CLONE 1557446
  misc_feature (12)..(146): Pfam Name: 2-Hacid_dh Pfam Description: D-isomer specific 2-hydroxyacid dehydrogenase, catalytic domain
MASAAPAPKPGVLLLRRTDADFAAALRARFRVHDLHASGAPLGAFLAAAAAEPEPPRAALVMAGGAVLVDAAFLDAVPSLGCVVTTSAGVDHVDLAQCARRGVAVAGAGGTFSVDVADHAVGLLVAVLRRVAAADRYVRAGLWPAQGDYPLTTKLSGKRVGIPRAGQRRPHWSPSAFQAFGLRPGPYPLEGRAKGLRSPLRLTFPRKAPRGFDRGGLPKDPLGPFPGCRRP

SEQ ID NO: 73197 - DNA, 844 bp, Zea mays
  misc_feature: Ceres CLONE 1557447
  misc_feature: Encodes the peptide sequence at SEQ ID NO. 73198
ctccccgcggtggcggccgctctagaactagtggatcccccgggctgcaggaattcgtctcacccctagaaaaagttccatcgccccccattgctcgccaagagttcttcttgtttaggcaaaggcaaaagcaggagcaaaaaggtttcgttggcgatggcgagctcgtggacgcttcctgaccacccgaagctccccaaggggaagccggtggctgttgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggatattcgcccaaggtgctaagcttgttgatcaagctcttgcctcacgaaagatttatgatggagatgggatcaactacatcaaagaatcttttgaaaatggtactcttcaccttattgggttgttgagtgatggtggtgtccactcccgccttgaccaactacagttacttctgagaggagtcagtgagagaggagcaaaaaaaattcgtgtgcacatccttaccgatgggcgtgacgatttggatggaagcagtgttggattcgtggagactctagagaatgatcttttggagcttcgaggcaagggtattgatgcacagattgcatctggctggtggaaggatgtatgttaccatgcaccgttatgagcatgactggggatgtggttaaacggtggctgggatgctcacgtgctcggaa

SEQ ID NO: 73198 - protein, 211 aa, Zea mays
  misc_feature: Ceres CLONE 1557447
  misc_feature (15)..(212): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASRKIYDGDGINYIKESFENGTLHLIGLLSDGGVHSRLDQLQLLLRGVSERGAKKIRVHILTDGRDDLDGSSVGFVETLENDLLELRGKGIDAQIASGWWKDVCYHAPL

SEQ ID NO: 73199 - DNA, 852 bp, Zea mays
  misc_feature: Ceres CLONE 1557448
  misc_feature: Encodes the peptide sequence at SEQ ID NO. 73200
  misc_feature (791)..(791): n is a, c, t, g, unknown, or other
  misc_feature (852)..(852): n is a, c, t, g, unknown, or other
ctccccgcggtggcggccgctctagaactagtggatcccccgggctgcaggaattcgtctcacccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgacccccaaaccttcgccaagaaccgcgagctggaggtgatccactcccgctgggccatgctcggcgcgctcggctgcgtcttccccgagctgctctcccacaacggcgtcaagttcggcgaggccgtctggttcaaggccggctcccagatcttcagcgagggcgggctggactaccttggcaaccccagcctgatccacgcgcagagcatcctcgccatctgggcctgccaggtcgtgctcatgggcgccgtcgagggctaccgtattgccggcgggccgctcggcgaggtcgtcgacccgctgtaccctggcgggagcttcaaccccctcggcctggccgacgaccccgaggccttcacccgagctcaaggtgaaagagctcaagaacggccgccctcgccatgntttccactgttcgggcttcttgttccagggcaatctgcaccgggcaaggggcccgctttan

SEQ ID NO: 73200 - protein, 239 aa, Zea mays
  misc_feature: Ceres CLONE 1557448
  misc_feature (61)..(214): Pfam Name: Chloroa_b-bind Pfam Description: Chlorophyll A-B binding protein
  misc_feature (219)..(219): Xaa is any aa, unknown, or other
MAASTMAISSTAMAGTPIKVGSFGEGRITMRKTVGKPKVAASGSPWYGPDRVKYLGPFSGEPPSYLTGEFPGDYGWDTAGLSADPQTFAKNRELEVIHSRWAMLGALGCVFPELLSHNGVKFGEAVWFKAGSQIFSEGGLDYLGNPSLIHAQSILAIWACQVVLMGAVEGYRIAGGPLGEVVDPLYPGGSFNPLGLADDPEAFTRAQGERAQERPPSPXFPLFGLLVPGQSAPGKGPAL

SEQ ID NO: 73201 - DNA, 808 bp, Zea mays
  misc_feature: Ceres CLONE 1557451
  misc_feature: Encodes the peptide sequence at SEQ ID NO. 73202
  misc_feature (621)..(621): n is a, c, t, g, unknown, or other
ctccccgcggtggcggccgctctagaactagtggatcccccgggctgcaggaattcgtctcacccctagaaaaaaagtgccactcccatccaccacaaggcttggcttggtgggaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatgcctcgacgactaccattccctggacaggaacggcaggaaggagaaaggtgtgaccgccctcgaccctagggccaacaactttgatctcatgtatgagcaggtgaaggcgatcaaggaagggcaggcagtcgagaaagccatctacnaccatgtcactggcctcctcgacccctcggaagctatcgcgccaccaaagattttcgtcattgaaggtctgcacccaatggtccatgagcgagtgaaggacctcctaaatttcagtatctaccttgaacatcatgatgaaagttagttttgcatggaaaatccagcgggaaaatgggcaaaacgtgg

SEQ ID NO: 73202 - protein, 205 aa, Zea mays
  misc_feature: Ceres CLONE 1557451
  misc_feature (61)..(205): Pfam Name: PRK Pfam Description: Phosphoribulokinase / Uridine kinase family
  misc_feature: SWISSPROT Homolog: EC 2.7.1.19 Phosphoribulokinase
  misc_feature (158)..(158): Xaa is any aa, unknown, or other
MAICSAHTTTSLRSPCTTVSNAGLRQKQVIFVTSNRRSGGGRRHGGARSFQVSCSVDKPVVIGLAADSGCGKSTFMRRLTSVFGGAAEPPKGGNPDSNTLISDTTTVICLDDYHSLDRNGRKEKGVTALDPRANNFDLMYEQVKAIKEGQAVEKAIYXHVTGLLDPSEAIAPPKIFVIEGLHPMVHERVKDLLNFSIYLEHHDES

SEQ ID NO: 73203 - DNA, 706 bp, Zea mays
  misc_feature: Ceres CLONE 1557453
  misc_feature: Encodes the peptide sequence at SEQ ID NO. 73204
ctccccgcggtggcggccgctctagaactagtggatcccccgggctgcaggaattcgtctcacccctagaaaaaaaccaaagctagctactttgttgctgtttttattcgtttgtcacataagcagtggtggtcggtcggccggcgacaatgagcggccgtgtgttcgtcctggccgctgccttcggcgtgctgctcgccgcagccgccgtgtcctcgaggcccgtcctgactccgctgggtactagccgccctgctgccggcgacctgtccgtgtacttccacgcggactcgtgcccgcagctggagacgatcgtgcggtccagcgtggacgcggcgctccagcagaacgtccgtctgacggcgggtctcctccgcctcttgttccacgactgcttcccgcagggctgcgacgcgtccattcctcctgggacaacgggcgagcgcgggccctccccgccccaacgtggggctgcaccaggaggcgtgcacctgtggaagacatccccgggaaggtgcacccgctgccgggccccccggtctggccccaaattcagggggtgggccccccaaaccccctgaacctgtccggggggcctttcctttccgggccccctgggggggggttgaaaaaccggggcccccggttccaaaaaaaaaaagtgttttaacgtgggcccccccccaaaaaggaaaaaggggggaaa

SEQ ID NO: 73204 - protein, 143 aa, Zea mays
  misc_feature: Ceres CLONE 1557453
  misc_feature: SWISSPROT Homolog: EC 1.11.1.7 Peroxidase
MSGRVFVLAAAFGVLLAAAAVSSRPVLTPLGTSRPAAGDLSVYFHADSCPQLETIVRSSVDAALQQNVRLTAGLLRLLFHDCFPQGCDASIPPGTTGERGPSPPQRGAAPGGVHLWKTSPGRCTRCRAPRSGPKFRGWAPQTP

SEQ ID NO: 73205 - DNA, 869 bp, Zea mays
  misc_feature: Ceres CLONE 1557454
  misc_feature: Encodes the peptide sequence at SEQ ID NO. 73206
ccccgcggtggcggccgctctagaactagtggatcccccgggctgcaggaattcgtctcacccctagaaaaaacccaacaaattcccgagacgccattctcaccatccacacaaagccacagcccaagagcactagagcagagtcgtcgtcgtcgtcgggcatggcggggttcaaggtgacgcggatctcggagggccccgtgaagccggcgtcggcgacgcccgaggagacgctgccgctggcttgggtggaccggtacccgacgcaccgtggcctggtggagtcgatgcacatcttccggtcgggcgcggccgaggccccggccgtgatccgggcggcgctggccaaggcgctggccttcttctacccgctggcggggcgcatcgtggagggggagcagccggggcgccccgccatccgctgcaccgccgacggcgtctacttcgcggaggccgaggcggactgcagcctggaggacgtgcgcttcctggagcggcccctgctgctgcccaaggaggacctcgtgccttaccccggcgacgaccgctggcccgtcgagccgcacaacaccatcatgatgatgcagatcaccaagtttcacctgcggcgggcttcgtgatggggctgcggttcaaccaccgccttgggggaacgggattgggccccgggccccatttcattcaaccccggtgggggaacaattgccccgggggggcctgggccgaaaacccagaagggggcttgccccctgggtggggacccgggggggaaaaagtttctccggggaaccccgagactatatagaggcgcggggcccggcttctccccgggaaaattctccccccgtgttttgggcggcctctgagga

SEQ ID NO: 73206 - protein, 152 aa, Zea mays
  misc_feature: Ceres CLONE 1557454
MAGFKVTRISEGPVKPASATPEETLPLAWVDRYPTHRGLVESMHIFRSGAAEAPAVIRAALAKALAFFYPLAGRIVEGEQPGRPAIRCTADGVYFAEAEADCSLEDVRFLERPLLLPKEDLVPYPGDDRWPVEPHNTIMMMQITKFHLRRAS

SEQ ID NO: 73207 - DNA, 840 bp, Zea mays
  misc_feature: Ceres CLONE 1557456
  misc_feature: Encodes the peptide sequence at SEQ ID NO. 73208
  misc_feature (667)..(667): n is a, c, t, g, unknown, or other
  misc_feature (698)..(698): n is a, c, t, g, unknown, or other
acccgcggtggcggccgctctagaactagtggatcccccgggctgcaggaattcgtctcacccctagaaaaattcccacacccctcaccgcgtccgcctcccctaccatctagggtttctagggttttcgaggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttacggcggcggcggtacccccccggctacggggggaggaggcgaccgtggctacggcggcggcgaccgtggttacggtggaggtggcgaccgcggctacggcggcgaccgtggctacgggggaggcggcggctatggcggtgggtacggtggaggcggcggtggaggcggccgcggctgcttcaagtgcggcgaggagggccacatggcaagggactgctcccggnccggccgctaccgaagggggaagcggcggcngcccccagcagcaattgctacaactgccggccaggaggggcacttctcccgcgactggcccaacaaaaggcgttaaggggcggggccaccgttcgcggtgggattccggggaagttccttgttcgcctttcggccgcttcct

SEQ ID NO: 73208 - protein, 210 aa, Zea mays
  misc_feature: Ceres CLONE 1557456
  misc_feature (5)..(72): Pfam Name: CSD Pfam Description: 'Cold-shock' DNA-binding domain
  misc_feature (158)..(175): Pfam Name: zf-CCHC Pfam Description: Zinc knuckle
  misc_feature (176)..(176): Xaa is any aa, unknown, or other
  misc_feature (186)..(186): Xaa is any aa, unknown, or other
MASDRVLGTVKWFNGTKGFGFITPDDGSEDLFVHQSSIKSDGYRSLNDGDAVEYTVGSGNDGRAKALDVTAPGGGPLAGGERPDGGNGGGRGGYGGGDRGYGGGGTPPATGGGGDRGYGGGDRGYGGGGDRGYGGDRGYGGGGGYGGGYGGGGGGGGRGCFKCGEEGHMARDCSRXGRYRRGKRRXPPAAIATTAGQEGHFSRDWPNKRR

SEQ ID NO: 73209 - DNA, 822 bp, Zea mays
  misc_feature: Ceres CLONE 1557462
  misc_feature: Encodes the peptide sequence at SEQ ID NO. 73210
ctcaccgcggtggcggccgctctagaactagtggatcccccgggctgcaggaattcgtctcacccctagaaaaactagaaaaagcactcccccacgagtccactctccgaccgcacgctccgcgacgcgatggccgcgctccgcctcgcctccttcaccctccgccccgccgccgccgccgccgcctcttccggcgcgactccatcggctccccggtccgcctctttctccagcgtggcgcgggggctcccctccctccgcctggccccgccccgccgccgccgcggggacctcgccaggccccgcgccgcggccgaggccgcggcggagagctacgcgtccgcgctgtcggaggtggccgtcgagaacggcaccctcgagcagacggtctccgacctcgagaagctggagaagatcttctccgacgaggccgtcgccgagttcttcgacaaccccaccgtcccgcgcgaggagaaggccgagctcatcggcgagatcgccaagtcgtccgagcttcagccgcacgtcgtcaacttcctcaacgtcgtcgtcgacaacttccgcgcgtccatcgtgccgcagatcgtcgtcgagttcgagaacgtctacaactcgctcacggggcacgaggtcgccaccgtcacctccgtcgtgcagctcgagtcgcaagacctcgcgcagatcgcgcagcacgtccagaaaatgaccggcgcccagaacgtcccgcctccagacgcaactcgacccggcggctcaatcgccggcttccccgggcagtacggccggcgagggctccaacttgatcaacatgagccgtccgat

SEQ ID NO: 73210 - protein, 231 aa, Zea mays
  misc_feature: Ceres CLONE 1557462
  misc_feature (65)..(222): Pfam Name: OSCP Pfam Description: ATP synthase delta (OSCP) subunit
  misc_feature: SWISSPROT Homolog: EC 3.6.3.14 H(+)-transporting two-sector ATPase
MAALRLASFTLRPAAAAAASSGATPSAPRSASFSSVARGLPSLRLAPPRRRRGDLARPRAAAEAAAESYASALSEVAVENGTLEQTVSDLEKLEKIFSDEAVAEFFDNPTVPREEKAELIGEIAKSSELQPHVVNFLNVVVDNFRASIVPQIVVEFENVYNSLTGHEVATVTSVVQLESQDLAQIAQHVQKMTGAQNVPPPDATRPGGSIAGFPGQYGRRGLQLDQHEPSD

SEQ ID NO: 73211 - DNA, 831 bp, Zea mays
  misc_feature: Ceres CLONE 1557466
  misc_feature: Encodes the peptide sequence at SEQ ID NO. 73212
  misc_feature (464)..(464): n is a, c, t, g, unknown, or other
acccgcggtggcggccgctctagaactagtggatcccccgggctgcaggaattcgtctcacccctagaaaaaagccgcacaatccatccatccatctattctccagtccacccattccattccactacccacgcgcagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggcgtcgcctcgccggccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgacgcccccctcaacnagcagatcaacgtggagtacaacgcctcgtatgcataccactccctcttcgcctacttcgaccgcgacaacgtggctctcaaaggatttgccaagttcttcaaggaatccagcgacgaggagagggagcacgctgaaaagctcatggagtaccagaacaaacgtggaggcagggtgaggctccaatcgattgtgacgcctttaaccgagtttgaccaccctgagaaaggagatgctctgtacgctatggagctggctctggcccctgaaaagctggtcaatgagaagctgcacaacttgcatggtggggcaacaaagggcaatgaatctcagctgacagacttcatcgagagtgaggtcctcgaagt

SEQ ID NO: 73212 - protein, 217 aa, Zea mays
  misc_feature: Ceres CLONE 1557466
  misc_feature (91)..(215): Pfam Name: Ferritin Pfam Description: Ferritin-like domain
  misc_feature: SWISSPROT Homolog: EC 1.16.3.1 Ferroxidase
  misc_feature (96)..(96): Xaa is any aa, unknown, or other
MMLRVSPSPAAAVPTQLSGAPATPAPVVRVAAPRGVASPAAGAACRAAGKGKEVLSGVVFQPFEEIKGELALVPQSPDKSLARHKFVDDCDAPLNXQINVEYNASYAYHSLFAYFDRDNVALKGFAKFFKESSDEEREHAEKLMEYQNKRGGRVRLQSIVTPLTEFDHPEKGDALYAMELALAPEKLVNEKLHNLHGGATKGNESQLTDFIESEVLE

SEQ ID NO: 73213 - DNA, 807 bp, Zea mays
  misc_feature: Ceres CLONE 1557470
  misc_feature: Encodes the peptide sequence at SEQ ID NO. 73214
aaagctggagctccccgcggtggcggccgctctagaactagtggatcccccgggctgcaggaattcgtctcacccctagaaaaatagaaaaaacgccgctgctccaagaaaccaccgccgagcccaaccgcacaagcgcgcgaggcaggagagagagagagagaggcggggagcaaaacaatggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggaggaatgatcttcgcgctcgtctactgcaccgccggcatctccggaggacacatcaacccagctgtgactttcgggctgttcttagccaggaagctgtccctgactagggccctcttctacattatcatgcaatgcctgggtgccatctgtggagctggagtggtgaagggcttccagcagggactttacatgggcaacggtggtggcgccaatgttgtcgcacctggctacaccaagggtgatggccttggcgctgagattgttggcaccttcatcctagtctacaccgtcttctcggccaccgatgccaagaggaatgccagggactcccat

SEQ ID NO: 73214 - protein, 209 aa, Zea mays
  misc_feature: Ceres CLONE 1557470
  misc_feature (47)..(209): Pfam Name: MIP Pfam Description: Major intrinsic protein
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRALFYIIMQCLGAICGAGVVKGFQQGLYMGNGGGANVVAPGYTKGDGLGAEIVGTFILVYTVFSATDAKRNARDSH

SEQ ID NO: 73215 - DNA, 838 bp, Zea mays
  misc_feature: Ceres CLONE 1557473
ccccgcggtggcggccgctctagaactagtggatcccccgggctgcaggaattcgtctcacccctagaaaaaaaccgttcgtctctcttcctggtggcggcggctaccacatattcggcggcgcggtgggcgcggccccagcggttgtgggtgctgccccggcggcctgcggccccggcggctcgcggccccgagccccggcctcggtggcggcacggacgcggcggctccggcctagcgcgagcgcatggcgcgcagccgcgcccccgacggcgcgggggcgagtttgcgcggcggcccgtccgtgagtgcgcggacccctgcgcgcacaggcgcgggcacagcctccggcgcgcgcgggcatgcggcccgcctgcgcgtgagcgcggactcctcggcgcggagctcggcctccggcgcgcaccgtcgtgcgcgggtgcggcctcccctgtgcacgcgggttagcccccacggcactggtgagccccaggctggcacgtgcacagccccggcgcgcgaacgcaagcacagcggttccgtgcggcttccacgacgcgcagacgccgtgctcaaccgtgcgctggcgcggccggccgggtcccggccccccccggcggcgcgggcttcccctggcgggcgggctgccacaacggccccggtgcaaaggccccgggccgggcggggcgctccgggcaattccttcggaattaacaccccctgctggcgggaaggaaaattcggggcctggcccccccgaacggcggggacaaagcgcttttcaaccccgagagggtgggcccttgggcgcctggggaacccttttttggcccaaaaacgc

SEQ ID NO: 73216 - DNA, 735 bp, Zea mays
  misc_feature: Ceres CLONE 1557479
  misc_feature: Encodes the peptide sequence at SEQ ID NO. 73217
ggagctcaccgcggtggcggccgctctagaactagtggatcccccgggctgcaggaattcgtctcacccctagaaaaagcctccccagcgtaacaagtgtccttcctccatcttcctcctccactccactcccaagtccccaccacccccaaccccgtctctccactgcggcgcaggcttcgcttcggctccgctcggctcgagcagaagaaaatgcaacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcaccacagaggatagcgtctatgacgctgtcaaatctatgactcagcacaacgtgggagcttttgggtggttgtcaaacctggacagaataaaatccatcgctgggcattggccactgaaagaagattatctccggaaaaatcatagtggcagggaaagggcttcccaagtccaacttaaagggtggggaaactccctgacctgaaagaaaaaaaaaacctgattccccaggggaaatccccgaaaacccaaagggtccctggcaggggcaaatggtgagccttccttggaacaagaaaaa

SEQ ID NO: 73217 - protein, 141 aa, Zea mays
  misc_feature: Ceres CLONE 1557479
MQRAVQAVRSHGNVLKYAVLQHISAPKPAMLPAAFSRFMSVSSARLEDRGFETATVADVLKSKGKSADGSWLWCTTEDSVYDAVKSMTQHNVGAFGWLSNLDRIKSIAGHWPLKEDYLRKNHSGRERASQVQLKGWGNSLT

SEQ ID NO: 73218 - DNA, 835 bp, Zea mays
  misc_feature: Ceres CLONE 1557483
  misc_feature: Encodes the peptide sequence at SEQ ID NO. 73219
ctccccgcggtggcggccgctctagaactagtggatcccccgggctgcaggaattcgtctcacccctagaaaaaaacggcaacggcagcctctcctccgcgccatcaggcagccatgggtccgggcgcgtccacctccgcgcagccgctgtcccgactcctcctcagcctcccgaagccaggcgccgcgaggcacccccgctcctcttcctcctctccttcccagcctcgcccggacgtcgccgcggccaggagccccggcctcgtcctccggcggcgcgaggcagcggccgccctgctgtcgaccgccttcctctcccgcttcgccctccccgcggctgccgcggacggcggggagtgcccgctggaggtggcgccgtccgggctcgccttctgcgaccgcgtcgtcggcaccggcgccgccgcccaggagggacagctcatcagggcgcattacacggggaggctggaggacggcacggtgttcgacagcagctacaagcgcgggaagccgctcaccttccgcgttggcgtcggagaggtgatcaaaggatgggatcagggtattgttggcggcgaagggatcccgccgatgctcgctgggggtaagcggacgctgaagctgccaccggcgctggcctacggcgagaagggcgccgggtgcagagggtgggagcccacctcgtgcgtcatcccgccgaactccacgctcctcttcgacgtcgagtacgtcggcagagccaccggctgaggtctccgggaactctgaatgcgcgaggccaagattcagactgatccatgtggacaacgatcgtagttgcccgggcactaagagg

SEQ ID NO: 73219 - protein, 211 aa, Zea mays
  misc_feature: Ceres CLONE 1557483
  misc_feature (99)..(206): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MGPGASTSAQPLSRLLLSLPKPGAARHPRSSSSSPSQPRPDVAAARSPGLVLRRREAAAALLSTAFLSRFALPAAAADGGECPLEVAPSGLAFCDRVVGTGAAAQEGQLIRAHYTGRLEDGTVFDSSYKRGKPLTFRVGVGEVIKGWDQGIVGGEGIPPMLAGGKRTLKLPPALAYGEKGAGCRGWEPTSCVIPPNSTLLFDVEYVGRATG

SEQ ID NO: 73220 - DNA, 837 bp, Zea mays
  misc_feature: Ceres CLONE 1557485
  misc_feature: Encodes the peptide sequence at SEQ ID NO. 73221
  misc_feature (553)..(553): n is a, c, t, g, unknown, or other
  misc_feature (747)..(747): n is a, c, t, g, unknown, or other
ctccccgcggtggcggccgctctagaactagtggatcccccgggctgcaggaattcgtctcacccctagaaaaaagccttatagccacataccggccagccgcagcaagtgcccagaaggccagaaccagaaccaagcagctcgttgcaacctcatatcatcccctgccacgcacctccgtccgccgcgccatggaatcgaggaggagggccgtgcccaccgtgacggcggttgcggtggcgacgctgctgctgacgatgatgacgtcgtcgggcgtgggcggcgacttcgcggcggaccgggcggagtgctcggagcagttggcggggctggcgacgtgcctgacgtacgtgcaggagcaggcgacggcgacggcgccgacgcccgactgctgcgcgggcctcaaggcggtgctgcagagcagccgcaagtgcctgtgcgtgctggtcaaggaccgggacgaccccaatctaggcctcaagctcaacgtcgacaaggcgctcgggcctcccgccgtctggcacgcgcccgcctacatctccgactgccccangctgctgggactgccggccgggctcaaggacgcacaggtggtcgagcagtacgcgaagcaacaagctgcggcggcggcgcaagtcggcgcacccaccagtggacgcagcaacgcggcgggcgagccgaccgccggccccccgaaaaacggaacctcacccccccgtcggtgtttggaaatgggaaggtcccttnttttcccccttagggcccccctcccccccggtggtcccccttttctgtgggcttttcggggctcgcggtgggggggaagatagaattccg

SEQ ID NO: 73221 - protein, 212 aa, Zea mays
  misc_feature: Ceres CLONE 1557485
  misc_feature (121)..(121): Xaa is any aa, unknown, or other
  misc_feature (186)..(186): Xaa is any aa, unknown, or other
MESRRRAVPTVTAVAVATLLLTMMTSSGVGGDFAADRAECSEQLAGLATCLTYVQEQATATAPTPDCCAGLKAVLQSSRKCLCVLVKDRDDPNLGLKLNVDKALGPPAVWHAPAYISDCPXLLGLPAGLKDAQVVEQYAKQQAAAAAQVGAPTSGRSNAAGEPTAGPPKNGTSPPRRCLEMGRSLXFPLRAPLPPGGPPFLWAFRGSRWGGR

SEQ ID NO: 73222 - DNA, 861 bp, Zea mays
  misc_feature: Ceres CLONE 1557486
  misc_feature: Encodes the peptide sequence at SEQ ID NO. 73223
  misc_feature (421)..(421): n is a, c, t, g, unknown, or other
  misc_feature (427)..(427): n is a, c, t, g, unknown, or other
  misc_feature (467)..(467): n is a, c, t, g, unknown, or other
  misc_feature (500)..(500): n is a, c, t, g, unknown, or other
  misc_feature (524)..(524): n is a, c, t, g, unknown, or other
ctcaccgcggtggcggccgctctagaactagtggatcccccgggctgcaggaattcgtctcacccctagaaaaaatggtgttcttctcatcatgtaattcagtaaagttccacgctgaacttctgaatttccttgggatagagttttctgatatccatggaaaacagaagcaacagaagcgaactactacattctttagcttttgcaaggcagaaaagggcatcttattgtgcactaatgtggctgcccgtggacttgatattcctgacgtggattatatcttgcaatatgaccctccagatgaaccaaaggattacattcacagagttggtcgtaccgcacgtggtgagaaaggcaaaggaagtgcattgctgttcttactaccagaagaactgaagtttctaatttacctgaaggcggncaaggntaccctgacggaatatgagtttcatcagaagaatgtgccnaatttgcaatcgcagcttgagaaatatgttggntggagaatactttctgaaccagtnctgccaaggaacctacagatcctacgttttggcatatgactctcactctatgaaagaattttttaaggcccatcaacttgatctgcaaaaaggagctgcctcattcgggttcaagaaaccccccaaaggaaaccggaccctggaaacaggggggggaacctccgaaaaaaaaaaggaaaataaacgggggaaaaaggttgggattcggcttttaaacccttcggggggaaagagaaaaagggggggcccgaaaaaaaaacagtgggggagaattttcaaaagggggaaaaaaaggcgggcctccccccattggggtggctccccccccggtgttttt

SEQ ID NO: 73223 - protein, 186 aa, Zea mays
  misc_feature: Ceres CLONE 1557486
  misc_feature (40)..(116): Pfam Name: Helicase_C Pfam Description: Helicase conserved C-terminal domain
  misc_feature (140)..(140): Xaa is any aa, unknown, or other
  misc_feature (142)..(142): Xaa is any aa, unknown, or other
HRGGGRSRTSGSPGLQEFVSPLEKMVFFSSCNSVKFHAELLNFLGIEFSDIHGKQKQQKRTTTFFSFCKAEKGILLCTNVAARGLDIPDVDYILQYDPPDEPKDYIHRVGRTARGEKGKGSALLFLLPEELKFLIYLKAXKXTLTEYEFHQKNVPNLQSQLEKYVGWRILSEPVLPRNLQILRFGI

SEQ ID NO: 73224 - DNA, 798 bp, Zea mays
  misc_feature: Ceres CLONE 1557487
  misc_feature: Encodes the peptide sequence at SEQ ID NO. 73225
  misc_feature (756)..(756): n is a, c, t, g, unknown, or other
ctccccgcggtggcggccgctctagaactagtggatcccccgggctgcaggaattcgtctcacccctagaaaaaagaagcctccccgcgtcgcgtcgcgtcgcgcacgccgtcctgcccgccccttttcacacccccgacgcaaccgcatcgccgcccgccctctatatcctcccgcaccgtctctctctctctctcctcctagcacaccagacgccgccgcgagcccccagcatcccagcccagatgttcctcgccgacaagtacagctcgctgctgcccttccaccaccaccattccaagcccagccgacgccagcagcagaagggggaggcgcaccggttcggcacggcgctggccgcgcgcctccggggcctgctgccgctgccggcctccccgctcgcggcgctcgtgcgggtggccgacctcctcgcgctcacgctcgccgaggcggggcccgcgctcgcctgctccggcgagggcgccgccgtcgccgcccacctcgacgccggcgtcgcgctcctcgacgcctgcaacgccatcgccgcgcggctcgacggcctccgcaggcgccgtctcctcgcgagcctcgcgctccacctcctcctctcctccacctcgccgtccgggcggacgcgcgcgcgcgcggcgctcgcggaccgcgacaccccggcggcgtccccggcccctccgccgctcccttggctcccgttcgagcagcccccgcgggcagctcacggccgcccgcgcgcgtccntcgccgccggtggaacgccgtctcctcgctcgcgggggcggg

SEQ ID NO: 73225 - protein, 184 aa, Zea mays
  misc_feature: Ceres CLONE 1557487
  misc_feature (171)..(171): Xaa is any aa, unknown, or other
MFLADKYSSLLPFHHHHSKPSRRQQQKGEAHRFGTALAARLRGLLPLPASPLAALVRVADLLALTLAEAGPALACSGEGAAVAAHLDAGVALLDACNAIAARLDGLRRRRLLASLALHLLLSSTSPSGRTRARAALADRDTPAASPAPPPLPWLPFEQPPRAAHGRPRASXAAGGTPSPRSRGR

SEQ ID NO: 73226 - DNA, 943 bp, Zea mays
  misc_feature: Ceres CLONE 1557488
  misc_feature: Encodes the peptide sequence at SEQ ID NO. 73227
  misc_feature (329)..(329): n is a, c, t, g, unknown, or other
  misc_feature (344)..(344): n is a, c, t, g, unknown, or other
  misc_feature (371)..(371): n is a, c, t, g, unknown, or other
  misc_feature (372)..(372): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (746)..(746): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
ctggagctccccgcggtggcggccgctctagaactagtggatcccccgggctgcaggaattcgtctcacccctagaaaaagcggtgtccaccactccctcctctcctctcccgtcctatccatccggcacgcccagcatccatccactcctcccctgctccggctccggctccggctccgccatgggcctttcaacagtttactccccggccggaccgcgcctcgtgccggcccctctcggccgctgccgctctgcccagccccgccgcccgcgccgagacccgctcgccaccgtccggtgctccgtcgacgccaccaagcaggcgcangatggcgtggcgacngcggtcgcgaacgaaacccccgcgtcnncgaaagagtggcttcggggtcttctgcaccacctacgaacttcaggcggaggacaagaacaagtcggggaagaagctagtggnnnnnnnnnttaaaatttttctttgttcaagggcccgcccgggaagaaataaaaaaaaacttgccggttaaaaaccccctttttttgggggggaggtttgttttttggaaaaaccccaccccaaaggcctttaagcctctccgcggcctccaaaaaaaaaaaatttttttaaacccccccccccccaaaggggggggtttttttttgaaacactggggagggagaaacaaccccccttttatataccaccccccccccccccaaaagaaaaaaaacctttttttttacaaanaaaaaaaaaannnnnnaaaacctggagaacgttttaaaaaaaaaaaaaggagggccccccttttttggggggaaaaaaaacccccgactccccccccttaaaaaaaagatccttcctcccctctgataaaataataggggggaaaattttttttttgtcggggggagaaaaaaatttttttttgtgttcttcctttc

SEQ ID NO: 73227 - protein, 91 aa, Zea mays
  misc_feature: Ceres CLONE 1557488
  misc_feature: SWISSPROT Homolog: EC 1.1.1.82 Malate dehydrogenase (NADP(+))
  misc_feature (49)..(49): Xaa is any aa, unknown, or other
  misc_feature (64)..(64): Xaa is any aa, unknown, or other
MGLSTVYSPAGPRLVPAPLGRCRSAQPRRPRRDPLATVRCSVDATKQAXDGVATAVANETPASXKEWLRGLLHHLRTSGGGQEQVGEEASG

SEQ ID NO: 73228 - DNA, 898 bp, Zea mays
  misc_feature: Ceres CLONE 1557490
  misc_feature: Encodes the peptide sequence at SEQ ID NO. 73229
  misc_feature (396)..(396): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (427)..(427): n is a, c, t, g, unknown, or other
  misc_feature (428)..(428): n is a, c, t, g, unknown, or other
  misc_feature (433)..(433): n is a, c, t, g, unknown, or other
  misc_feature (445)..(445): n is a, c, t, g, unknown, or other
tcaccgcggaggcggccgcttttcacaagtggatcccccgggctgatttacttcgtctcgcccctagaaaaagacgacactgcacacctctcaccagtctttttaccgccacaccacacccagctgtccccatcgcgcgcacactctctcggtctctccctcccagtcccagcgtttgcggtccagtccagagagctcgagcagccatggcggctcccctgttcctcctcctcctgctgctggctatgttcacaggctcaaacgcggcgttctgcgtgtgcaagacgggcgtgcccgaccaggcgatgcaaggcggggatcgactaacccccgcctttttgatggtttcccgaaacaaagcccccccaggttttttttttgttagggggagggggnaaacccccccccaaaaaaannnnnnnggggnnaaganatggggggcaanaaccacccaaagccacggggggggccaccccgggggaaatttgaaaaggggaggtcgcctacacattaaacgtgggagagggaaccccctaaaagtttcggggatcacttgataaaagagttgggccgcatctcaggggccccctaaagaaaggatccaaagaggagaactcatggtgggagggggggagactatggtgggccgcttatgggtagaggtctgggcggagccatagaggagaagtaggggggcaaacaggcagagagccataccgacggaactatcctaggggaaactagagatttgcctcacacggggtcggatacagaagagtgaggtttgtggtggccgctccccggagctgcgagttggggccgtcttctctgtgccgaggatttggagtgggtgatccaatattggagagacgaaggtggtagtaaggtcgcttctctt

SEQ ID NO: 73229 - protein, 116 aa, Zea mays
  misc_feature: Ceres CLONE 1557490
  misc_feature (64)..(64): Xaa is any aa, unknown, or other
  misc_feature (70)..(70): Xaa is any aa, unknown, or other
  misc_feature (71)..(71): Xaa is any aa, unknown, or other
  misc_feature (72)..(72): Xaa is any aa, unknown, or other
  misc_feature (74)..(74): Xaa is any aa, unknown, or other
  misc_feature (76)..(76): Xaa is any aa, unknown, or other
  misc_feature (80)..(80): Xaa is any aa, unknown, or other
MAAPLFLLLLLLAMFTGSNAAFCVCKTGVPDQAMQGGDRLTPAFLMVSRNKAPPGFFFVRGRGXTPPQKXXXGXKXWGAXTTQSHGGGHPGGNLKRGGRLHIKRGRGNPLKVSGIT

SEQ ID NO: 73230 - DNA, 836 bp, Zea mays
  misc_feature: Ceres CLONE 1557497
  misc_feature: Encodes the peptide sequence at SEQ ID NO. 73231
ctccccgcggtggcggccgctctagaactagtggatcccccgggctgcaggaattcgtctcacccctagaaaaagctagtaccagtagtcgtcgcgttagcaggcagatctgagttagccggcggatccgatccgtgcgcgtgcagtgtacgtgtgtcggtggagatggccacagcttacgctcccatggcgagccaggtgatgaagagcagcctcgtcgtgcactcgaggccgaggggcctgtcaggcgctgctgcgctcacgaggcggccgcggttcaccgtcaaggccatccagcccgagaaggcaacgtaccaggtggtgcagcccatcaacggcgaccccttcatcggcagcctggagacgccggtcacctccagcccgctcgtcgcgtggtacctctccaacctcccggcctaccgcaccgccgtgagcccgctgctgcggggcgtcgaggtcggcctcgcgcacggctacctcctcgtggggcccttcgcgctcacgggcccgctccgcagcacgcccgtgcacggccaggccggcgcgctcggcgccgccggcctcgtcgccatcctcagcgtctgcctcaccatgtacggcggtcgccttctttcaacgaagggggacccgttccacgggggcccttgcttcaggcttcaccgggcaggaaaaaaggaagggccaacaagcttgcaaaccctccgaaagggttgtggcccaaatttcaccgggggggaatatctttctttctgggggcaatttcctccggggggggccttttgggggccccaaactttccctcccttaaaaggggggctccgaaaccttccccccct

SEQ ID NO: 73231 - protein, 216 aa, Zea mays
  misc_feature: Ceres CLONE 1557497
  misc_feature (43)..(209): Pfam Name: PsaL Pfam Description: Photosystem I reaction centre subunit XI
MASQVMKSSLVVHSRPRGLSGAAALTRRPRFTVKAIQPEKATYQVVQPINGDPFIGSLETPVTSSPLVAWYLSNLPAYRTAVSPLLRGVEVGLAHGYLLVGPFALTGPLRSTPVHGQAGALGAAGLVAILSVCLTMYGGRLLSTKGDPFHGGPCFRLHRAGKKEGPTSLQTLRKGCGPNFTGGEYLSFWGQFPPGGAFWGPQTFPPLKGGLRNLPP

SEQ ID NO: 73232 - DNA, 818 bp, Zea mays
  misc_feature: Ceres CLONE 1557498
  misc_feature: Encodes the peptide sequence at SEQ ID NO. 73233
ctccccgcggtggcggccgctctagaactagtggatcccccgggctgcaggaattcgtctcacccctagaaaaagaaccttgaagcgccccgtagtgcagtgcagtgcagcagtgtgctacctcctcagtcctctcactccatcacaaacgctagtcttcctctaaagctcggagcgagtctcagaagcgatggcgtccaagaggctgctgctggcggcgctgtgcgtggtggcggcggcgctgctcgccgtgcggtcggaggcccacggcctggaggacttcgcaagcagcgacgcgacgccggagatgcagaccttcttcaagcccgaggccgcggcgctcccggaggccctggacgcgtcctccatgcccgccgccaccatggccgcgaagccggaggccacgtcgatcccgaccaccaccaccggcaccacggcggcggcggcgggcacctccgccgcggcaggcactactgctgcgtcgccgccgcgcaggtccgtgtccgtggccgccggcgtggcctgcggcgtggctgccgtggccgtggtcggcatcgcggccgccgtggcgtacgtggtgcgcggcaggcgcagcagggaggtgcagctcggctcctccccgtgagcacgcgcccagcgccccggcccgctttacagacaggccgtcatcgccattaggatctggttaagcgcgtcgtctagctctgcgatttgtgtggcttttgggttagtgggttgattctttttttcgcgtggggttgttcggtgagatcacgctaccgggtacggaccagcagtggtgcatgtaacataaataa

SEQ ID NO: 73233 - protein, 144 aa, Zea mays
  misc_feature: Ceres CLONE 1557498
MASKRLLLAALCVVAAALLAVRSEAHGLEDFASSDATPEMQTFFKPEAAALPEALDASSMPAATMAAKPEATSIPTTTTGTTAAAAGTSAAAGTTAASPPRRSVSVAAGVACGVAAVAVVGIAAAVAYVVRGRRSREVQLGSSP

SEQ ID NO: 73234 - DNA, 988 bp, Zea mays
  misc_feature: Ceres CLONE 1557499
  misc_feature: Encodes the peptide sequence at SEQ ID NO. 73235
gctctagaactagtggatcccccgggctgcaggaattcgtctcacccctagaaaaaagactccagagtccaaccgcacacggcacagacccgtttcgcctcttcgaccgcgactccctccgaccgagctgcagtgcgcgtgctgcctgccttccactgttcctgcttccagacatggcggcgaggccggtcgctctggctctgccgctgctggccctcgtctgcaccctggcagcgtcggccgacgcgacgcatttcagggtgggcgggcagagtgggtggagcgtgccgggcgccggctccgagccctacaacacctgggcggggcgactccggttctagatcggcgaccagctgctgttcgtgtaccccatggtgacccccctccgtgctcctggtggacgccgccgcctagaacgcctgcgtgaccctcgtcctacgtctctcagtttccacaaacggcagcacagaagttcacgtttcgaccgcttcgggggcgcttctttcttcttaattagacaacaaagggcaccctgcctttggccgaacgaagaggcttcaccgacgtagttcctagtcactaccggactttaagaaagccgacaaccctcgagcgcctattttagacacgcccgcttgtggccaaatacggaacctttgttacttgcctggcgtaccttcggcccgcacaaacttggtcgaagagtgatcactctctcttgtgctgcccagctggtggatcagggctacttccgcatgaacgtcactctctccggtgggcataagaacgtccgagcgtagttgtgacggggttgcgaattgcactcaaggaaaattacactctggtgttgatcctcttgaattacctggttgcccgcttaaaaactcttgtaagtttactctttcgtgctaataatgtcggtcgaaaccacttagtcacgagaatgattatctcgacgcatcattcatcttcgcacgccaggtattct

SEQ ID NO: 73235 - protein, 55 aa, Zea mays
  misc_feature: Ceres CLONE 1557499
MAARPVALALPLLALVCTLAASADATHFRVGGQSGWSVPGAGSEPYNTWAGRLRF

SEQ ID NO: 73236 - DNA, 644 bp, Zea mays
  misc_feature: Ceres CLONE 1557500
ctccccgcggtggcggccgctctagaactagtggatcccccgggctgcaggaattcgtctcacccctagaaaaagatggttataggtttaaggacacaaggtgaccctgctttttcagggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaggaaaagctcgaacgaccttcaacgaaagggtaccctgtacccgaaacccgacaacaggtggggtaggggtagagaataccttagggggcgccgagacaacttctcctcttaagggaaactcgggcaaaataagccccccgtaaactttcggggaaaaaaggggtggcccccccctccccaaaaagggggggccccccaagtgaaacccaagccccccggggggaaaaattgtttttttcccccaaaaaaaacccccgggggtttccccccccccaaaaaaagccctttataaaaaaacacccccttttttttttgggggggggggggttttttaaaaaaaacccctctttgtggcccccccccagggggtt

SEQ ID NO: 73237 - DNA, 818 bp, Zea mays
  misc_feature: Ceres CLONE 1557503
  misc_feature: Encodes the peptide sequence at SEQ ID NO. 73238
  misc_feature (716)..(716): n is a, c, t, g, unknown, or other
  misc_feature (818)..(818): n is a, c, t, g, unknown, or other
ctccccgcggtggcggccgctctagaactagtggatcccccgggctgcaggaattcgtctcacccctagaaaaaaaaaaaccgccggcgccctagctagccaggtctttgtcccttcgccaggccttcatcggggactagcacactgcacacgcacccactagatgtctgcgccgaacggtccagcggcttgtccgatggtgtaccctgtctaccttaccggggcattcccccagcaagcaggggatgaccaggctcaaggtccggggatatatgccatacaacagaaccagttagcggctgcgatgggaatggggtgctatgctccaaccacactcattccactcgcttacaatatcccaacggaaagcgtcggagcttctgctggtgaagagaatgtacaggatgctaggcagcaaaatggacctcaaagacaagttgttgtgaggaggtttcactttgcttttcagcttgacttggccctgatcatcaaactagccgctgttgtgtttctctttagccaggaaggctcaaaacaaaggctgtttcttctgatactgtttgcctcatttatttacttatatcaaaccggagctattacaccttttctaagacggcttcagcgggcaagaggtgcagctgctcatccaccacaggctcctgctcgggtcgagaaaccgtgctcctctgcctgcccagaatgatggcaatgagcangccaatggccttggcaacccctgacaagctgcggaagaacaacgaacaagatcctgcagcttgggtaaccagatccccaagaaggccaaaggtagaaagcan

SEQ ID NO: 73238 - protein, 179 aa, Zea mays
  misc_feature: Ceres CLONE 1557503
MSAPNGPAACPMVYPVYLTGAFPQQAGDDQAQGPGIYAIQQNQLAAAMGMGCYAPTTLIPLAYNIPTESVGASAGEENVQDARQQNGPQRQVVVRRFHFAFQLDLALIIKLAAVVFLFSQEGSKQRLFLLILFASFIYLYQTGAITPFLRRLQRARGAAAHPPQAPARVEKPCSSACPE

SEQ ID NO: 73239 - DNA, 823 bp, Zea mays
  misc_feature: Ceres CLONE 1557509
  misc_feature: Translation starting site: 166
acccgcggtggcggccgctctagaactagtggatcccccgggctgcaggaattcgtctcacccctagaaaaactcatcatcagtcatcacataccaccaagaccacatcggcacatcgacgtgagctcgtgcgtgagtgccctggtcgacgaccgctcgcgcgccatggactcaacgacgacggcgccgctgctgcagccgtccgccgcctcgagcaaggaggggccggggccggcgccggctcagcacggtgagggcagccgggagctggaggcgatcctggccgacgcgtccaagccgtgggcttggcgggcctgggaaggcgcccgcctggagctgccgctgctgctgcgggtggcgctgccggcggtggccgtctacatgatcaacttcgtcatgtccatgtccacgcagatcttctgcggccagctcggcaacctcgagctcgccgcctcctcgctcggcaacaccggcatccagcccttggcctacggcctcatgctgggcatgggcagcgcggtggagacgctgtgcgggcaggcgtacggcgcgcacaagcaccgcatgctgggggtgtacctgcagcgctcgacggtgctgctcagtggcaccgacgtgccgctgaccgtcgtctaaccccttctcggaacgcattccctggtcctcccccggggaatccggaacgccatctcccgggggccgccggccgttctttgtctaagggggccccttcccccgaaaattttctcggggtaacggggggccaatatttcccccctttcccaaaaaatttccccgggcgggggcccccaaaaaaaaatcc

SEQ ID NO: 73240 - DNA, 662 bp, Zea mays
  misc_feature: Ceres CLONE 1557510
  misc_feature (170)..(170): n is a, c, t, g, unknown, or other
  misc_feature (173)..(173): n is a, c, t, g, unknown, or other
  misc_feature (349)..(349): n is a, c, t, g, unknown, or other
  misc_feature (350)..(350): n is a, c, t, g, unknown, or other
  misc_feature (355)..(355): n is a, c, t, g, unknown, or other
  misc_feature (356)..(356): n is a, c, t, g, unknown, or other
ctccccgcggtggcggccgctctagaactagtggatcccccgggctgcaggaattcgtctcacccctagaaaaatccagggcacaccgagctgtcgtttcgcggaccaatcgccccgctagggtttctctcccagggctcccgagctctccctcccccgtctcctctcgnccntcgagctctctgtccccttggtctctctcggccctcgaggttctcccaacccccgttttcccttattggccccttgaaagcctttttaactttccccccccgtttttttttttggtgtcccccccccccgaaaaatttttttttgtggaaaaccccctttcacaaattcccccccnnttttnntcccgggtggggggaaggaagagaaaatcttcgggggagaacccccccccccctccccgggggggggggggggcccccccccccccaaaaaaaaagagggggggggggtgttgtttttaaaaaaaatcttctttccccccccccgagattgtttttttataaaataatttgggggggggggggagagaacaacactgttggggggggggggttcccaaaaaaaatattttttttttgggggggcccccccccccccccaaaaaaaaaaaaaaaaaaaacgcgaggaggggtgggggcttcctctta

SEQ ID NO: 73241 - DNA, 1021 bp, Zea mays
  misc_feature: Ceres CLONE 1557511
  misc_feature: Encodes the peptide sequence at SEQ ID NO. 73242
ggcggccgctctagaactagtggatcccccgggctgcaggaattcgtctcacccctagaaaaaagctggctcttctttaattctgcagggaagttccagtttcaggtagagtgcaggcggagaaccaatgggggcggcgccgtcgtccgacgactcgtcacgcgccggagacggccgggctgtggcgagcagcgctgcctctggcactggcagcaacagccaccaggcccagtcgaagcgggcgccgccgcctcacaagttccacgagatagttgcgcaggaggcgacgacggccggcggcggcggcggcactgctgctgcagccgagctggaggatcaggcgtgcagcaccggggtgtacctggctgggaaaaccaagaagtaccccccccgacgagaagaccaggtgcaactgcttcgttgctgttcgcctagagcgctgtccatcacttgggggcgacgatccccagatactgggatctgggcgtcccgttcagaagaaacccgatgaacgcccgagaatctgtcgtaaggctgtcgttctcttgcacaaaccttgttgcttgggcttggaaggtgcaaccggggaaggcttggaagcttgttctgcaaccttctacgcccggcggggtgccagccttcccgaaagttgggccttatcccaggggtggattgtcttccaccgggagacccggggcgttaacagggagtggggtccgggtggcccgcggtggaaaaccttggtcgggttcaccggttttccccccgaaaagggaactggttgtccagggcgccccgaaaagggaacaaaccttgtcagggcggatgccccccccgaaaccaagtggtctgggagaacctcctgggcctgggtaaaggttacaagacctccccgcgccccctacagggtggggcacgagtacacccacccggtcagatctggaaaaatctctccttgtttgaagattcaaaaagcggggctctttagaaaaaagaggagtctcccttatcagagagggtt

SEQ ID NO: 73242 - protein, 127 aa, Zea mays
  misc_feature: Ceres CLONE 1557511
MGAAPSSDDSSRAGDGRAVASSAASGTGSNSHQAQSKRAPPPHKFHEIVAQEATTAGGGGGTAAAAELEDQACSTGVYLAGKTKKYPPRREDQVQLLRCCSPRALSITWGRRSPDTGIWASRSEETR

SEQ ID NO: 73243 - DNA, 1169 bp, Zea mays
  misc_feature: Ceres CLONE 1557513
  misc_feature (9)..(9): n is a, c, t, g, unknown, or other
  misc_feature (17)..(17): n is a, c, t, g, unknown, or other
  misc_feature (245)..(245): n is a, c, t, g, unknown, or other
  misc_feature (257)..(257): n is a, c, t, g, unknown, or other
  misc_feature (258)..(258): n is a, c, t, g, unknown, or other
  misc_feature (260)..(260): n is a, c, t, g, unknown, or other
  misc_feature (1017)..(1017): n is a, c, t, g, unknown, or other
tttttgttncgggtgtncccacaaacgaccgtctgttttgttggttattttttgatttggaaagaagggaactagagcaagcggcggattcggccgctctagaaccgaggatccccgggctgcccgaattcgtctcaccccgagaaaaacaaccgtagcctgtagcttcatccgttgcgctgcgcccggttccctcgcgcggtgcggaatttaacatggccttgccggaggtggtggtcgatagnatcaaaaacccnncngaagcaaacccaccaagctccgccggctcgcacttccccggaagcgcaggcatgctaggcaacgaattcgaagacgactcataaagagaaagggtatcggccgggtacctgtagggacccaatcctagccccccccaggtatagaaaaaggggtggatatataaaaaggaagaaagctcggtctttcggagggcaccgccctgcctacccaccctaaacataaaaactatataaagaagtaaaaaactctttcctgtggatcaaaatttacttataaataagagacgctgacgaactacatagttaatacaccttttccagggccagaaggaaaggagaggccgataacagttcattttcccctcgtccgtggaaactataattttgtttgtagtggggataataagaacctttcgccgctaggtcaagtttcgtcttattataccctacgttttaataaaggagggatctcttctcccaatctcacgcgtagtgtagttactattgctggtagttcttaatgctgttgcgataattataaaggatatattttacctcgtatttataatagtttgatgtcccgatcggttgacgtaagataacactctcaccatagtttactagctgttcgagaggcatctggatgtgcctctgtcatttaaacgttgtaatgagcttggctaagaatgattattttggttgttagacacagctagacgacggtgttgcctccatgagcacgataatacaagtattnaccagtaccagtgacattataacgcctcgtttctaataatgtggggttctcttctagggcgttaagcagcggtgcgggagggcagtgtcactgattattttactactacgaatcttcttagtaaattctcttagaacaccacaatctactta

SEQ ID NO: 73244 - DNA, 839 bp, Zea mays
  misc_feature: Ceres CLONE 1557514
  misc_feature: Encodes the peptide sequence at SEQ ID NO. 73245
ccccgcggtggcggccgctctagaactagtggatcccccgggctgcaggaattcgtctcacccctagaaaaagttgggcatcgccctcgctcgggccgctttgtccgcgtcgcctcccctctcaccgaccgcgtcgagtgtcgcccggattttctgtgttggaggggagtggacgcgtgactggagcctcttacgaagcgcgccatggacccttgcccgttcgtgcgggtgctgggccgcgacctcgcgctcataatgccggtggccccccccgccgccggggctggggcacgcgtccgcccttccacgtacccttgctactgccagatccgactggggaagatgccggtgaatagcgtcccggcgcctctcgtggtctccgacggtggcgagccgactccggcatccggggccctccccgccccgttacatctgtcagacgctgacctggagaggatattccggaagccgtcatgtcttctcctcgcgcggggaggccactctgaacgtgtcagtctccactggccggaatgagagtgcctgcggactcggctcgcggctgctgcttgggaagggtactggcgtgctcgacctcaagggcgcctagggcacgcccgccatgctgcacgtcggctggatctcagacggaaaactgtcctttaaggatgacgccgatgctacagaactcagcctcatcctccacgcggaggcccgacgcgtgatacgtattcgagtacaacggcgcatcatcagtgctcccgctgggtgctacaagtgcacggcatgctgaatcattccacgttcgcaagaacactccgatgcctcaagactgcaacgtg

SEQ ID NO: 73245 - protein, 109 aa, Zea mays
  misc_feature: Ceres CLONE 1557514
MDPCPFVRVLGRDLALIMPVAPPAAGAGARVRPSTYPCYCQIRLGKMPVNSVPAPLVVSDGGEPTPASGALPAPLHLSDADLERIFRKPSCLLLARGGHSERVSLHWPE

SEQ ID NO: 73246 - DNA, 781 bp, Zea mays
  misc_feature: Ceres CLONE 1557518
  misc_feature: Encodes the peptide sequence at SEQ ID NO. 73247
  misc_feature (393)..(393): n is a, c, t, g, unknown, or other
  misc_feature (632)..(632): n is a, c, t, g, unknown, or other
  misc_feature (737)..(737): n is a, c, t, g, unknown, or other
ccccgcggtggcggccgctctagaactagtggatcccccgggctgcaggaattcgtctcacccctagaaaaaaaagtgggagcgaggaggaagaaaagaagaagaagaagacgacgacgacacccaccaccagcagcaagcagcaatcagcagaacgaaatgtcgatcaagtactgcgaccagcacaaggactgcgagcggcagcgtctgtaccgtcgcttctgcgccgccctggtgggcgtcatcgtgctcgtcctcctcatcgtgctcatcgtctggctcgtcctccgccccaccaagcctcgcttcttcctcaacgacgtgagcatcgtgtgcatcaacgtcagctccgcctcctacctcaccgtcaccatgcaggccacgctggcgtcncgcaacaccaacgaccgcgtcggcatctactacgaccgcgccgacgtgtacgccgagtaccggggcgatgcagaataacgggggcccaaccggggttggccccccctttttttttaagcccccaaaaaacccccctttggggccctttttttctccccccaaaaaggggggggggcctaatttggcacggggtttaaaaaaaaaaaaaaagggggggaactatctttcaccaacccccnaaaaaggggggtatcccctggggggggggggggggtttttataaggggaaaaaaacacctgggggggggggggggccccccccttttttttttttttaaaaaaanaaagaaaaagaaaagaatcgggttctccccccccgggggggggg

SEQ ID NO: 73247 - protein, 103 aa, Zea mays
  misc_feature: Ceres CLONE 1557518
MSIKYCDQHKDCERQRLYRRFCAALVGVIVLVLLIVLIVWLVLRPTKPRFFLNDVSIVCINVSSASYLTVTMQATLASRNTNDRVGIYYDRADVYAEYRGDAE

SEQ ID NO: 73248 - DNA, 844 bp, Zea mays
  misc_feature: Ceres CLONE 1557519
  misc_feature: Encodes the peptide sequence at SEQ ID NO. 73249
gaaagctggagctccccgcggtggcggccgctctagaactagtggatcccccgggctgcaggaattcgtctcacccctagaaaaaactccctctctgtctctccactccactcgccgccgccgcccgaatctcaatggcgtccgcggccgccccgccaacctccctctccctcgcggcccgtgcggcaagcagggcggccgccgccccgctccgcaggggaggcctcgccgcggcgcgccagccggcgcggtcgctggcgttcgcggcgggcgacgcgcggctcgcggtccacgtcgcgtcgcggtgccggcaggcgtcctccgcgcgcggcacgcgggccatggccaccatggcgaagaagagcgtcggggacctcacggaggccgacctcaaggggaagcgcgtcttcgtgcgtgccgacctcaacgtgccgctcgacgagaaccagaacatcaccgacgacacccgcatccgggccgccatccccaccatccagtacctcctcggcaagggcgccaaagtcatcctctcaagccacttgggtcgccctaagggttttacacccaagtttagcttagccccccttgttgcacggttgtctgagcttcttggcattcaggtgcaaaaagccgacgatgttattggccctgaagttgagaagctggtggccgccttgcccaatggtggggttttgctccttgagaacgtaagattctacaaggaagaggagaagaatgacccagagtttgcgcagaagcttgcctccctagcagatctttacgttaatgacgcgtttggaacagccccaaaggcacatgcatcgactgaagggagttacaaaga

SEQ ID NO: 73249 - protein, 236 aa, Zea mays
  misc_feature: Ceres CLONE 1557519
  misc_feature (74)..(236): Pfam Name: PGK Pfam Description: Phosphoglycerate kinase
  misc_feature: SWISSPROT Homolog: EC 2.7.2.3 Phosphoglycerate kinase
MASAAAPPTSLSLAARAASRAAAAPLRRGGLAAARQPARSLAFAAGDARLAVHVASRCRQASSARGTRAMATMAKKSVGDLTEADLKGKRVFVRADLNVPLDENQNITDDTRIRAAIPTIQYLLGKGAKVILSSHLGRPKGFTPKFSLAPLVARLSELLGIQVQKADDVIGPEVEKLVAALPNGGVLLLENVRFYKEEEKNDPEFAQKLASLADLYVNDAFGTAPKAHASTEGSYK

SEQ ID NO: 73250 - DNA, 852 bp, Zea mays
  misc_feature: Ceres CLONE 1557521
  misc_feature: Encodes the peptide sequence at SEQ ID NO. 73251
  misc_feature (389)..(389): n is a, c, t, g, unknown, or other
  misc_feature (395)..(395): n is a, c, t, g, unknown, or other
  misc_feature (438)..(438): n is a, c, t, g, unknown, or other
ctccccgcggtggcggccgctctagaactagtggatcccccgggctgcaggaattcgtctcacccctagaaaaaaaaacatctcccctgcccttcccctcgcgcagccaaaaaaaaaccaaaacgcctcctccgcttcgtctcctccctccccctcgccgccgcgactcccgccaccagcccaccacactattaattctgcccctcccccctcgtcctcttccacgtccacaactcccatcccacgtcgcagagccgttcctgtctgcgcctcctccctagacacgcgacgcagagcatatatatagcagcaggggcaggggcaaggacgaagggacgaaagagccagagccgccgccgccgccgccatgtccgtccgcgtggcgtccncccccntacctgagcaaatggcgcggtgggagcggcaggtggagcggcngcagctgttcctccgcagctaccacttctcgcgcgacgccgaacgcgggcgggggggctccccccgcgcgcccgcgccaggggcgtcgtctggggcgggggatgcgccgcctggggcggcgcagccgccaaggggccttcggccgccttccggggggggcctccgccttttggtttcggctggggccggcccgccgcccgtttttttcttccggttacggggagcctttttccgggggccgggaggggcccgcgggggacccccccccaccgggggccccccaaaatctggaatggtttctgggaaggacttgaccctggccaaagggaatttcaaaagggtccttggcctcccctccccccttgggatgggggggccttaccccttgccctttgttgtgaaaaaaagaaaaaa

SEQ ID NO: 73251 - protein, 161 aa, Zea mays
  misc_feature: Ceres CLONE 1557521
  misc_feature (8)..(8): Xaa is any aa, unknown, or other
  misc_feature (10)..(10): Xaa is any aa, unknown, or other
  misc_feature (24)..(24): Xaa is any aa, unknown, or other
MSVRVASXPXPEQMARWERQVERXQLFLRSYHFSRDAERGRGGSPRAPAPGASSGAGDAPPGAAQPPRGLRPPSGGGLRLLVSAGAGPPPVFFFRLRGAFFRGPGGARGGPPPTGGPPKSGMVSGKDLTLAKGNFKRVLGLPSPLGMGGPYPLPFVVKKRK

SEQ ID NO: 73252 - DNA, 920 bp, Zea mays
  misc_feature: Ceres CLONE 1557523
  misc_feature: Encodes the peptide sequence at SEQ ID NO. 73253
  misc_feature (397)..(397): n is a, c, t, g, unknown, or other
ggagctccccgcggtggcggccgctctagaactagtggatcccccgggctgcaggaattcgtctcacccctagaaaaacttccagtctcgccgccaattagtactcaccccctcccttgcatccgctcccctcccccctcctctcttccccccccgacctcggcgccgaggcatgctgttgccgtgagtgagcaagggatctttccggcgatcttggaggcggcgagcctggtgccgcatgctggctgtccggccggccggaggctagctagctctcgcctctcgaccgagaagtgaagtgaagtgaagcgagatggacctggtgccgcacccggacagcccgcactccgacaacagcggcggcggcggcggctcggcgtccggggcgctgtcgccngccccctcctccgcgggcgcggcgtcggcgctggggtcgccgagctggtacgagtcccaaaagcggcgggactggaacacctttcgggcagtacctgggggaaccaccggccgcccgctgttcctgggggcgctgcaaccggcgcgcaacgtgctggagtttccggcgctaccttcaaaaagtttcgggaaagaccaaggtgggcaacccccggggcctggcccccttcttttgggcaaccccgggggccggccgggggcccctgggccggtggccgccttccccccagggggtggggggaacccctgtgaccccccctccttgggaaagggtttgttctcccccccttcaaagaagaaaacagggagggggggccccgaaaaaaaaccccctttgggggggcccgccccctataagggtttttactttttcggggggagccgggaaaaattagattcccccgcccccgggggggttacctctcaagaaaagaaaaccctccgaaagggcgcctcccgccccc

SEQ ID NO: 73253 - protein, 202 aa, Zea mays
  misc_feature: Ceres CLONE 1557523
MDLVPHPDSPHSDNSGGGGGSASGALSPAPSSAGAASALGSPSWYESQKRRDWNTFRAVPGGTTGRPLFLGALQPARNVLEFPALPSKSFGKDQGGQPPGPGPLLLGNPGGRPGAPGPVAAFPPGGGGNPCDPPSLGKGLFSPPSKKKTGRGGPEKKPPLGGPAPYKGFYFFGGSREKLDSPAPGGVTSQEKKTLRKGASRP

SEQ ID NO: 73254 - DNA, 819 bp, Zea mays
  misc_feature: Ceres CLONE 1557532
  misc_feature: Encodes the peptide sequence at SEQ ID NO. 73255
  misc_feature (818)..(818): n is a, c, t, g, unknown, or other
aaagctggagctccccgcggtggcggccgctctagaactagtggatcccccgggctgcaggaattcgtctcacccctagaaaaagacttccctagggtttagtcgcgccgccgccgccgccgaaacagcacatcgctctctcgatctcagccatggcggaggtggagcagccccaggacgcggtgaagctcttcaaccgctggaccttcgacgatgtccaggtgaacgatatctcgctgaacgactacctggctgtgactgcggcgaagcacgcgacattcctgccgcactccgcggggcgctactccaagaagcggttccgcaaggcgcagtgcgccatcgtcgagcgcctcaccaactcgctcatgatgcacgggcgcaacaacggcaagaaggtcatggccgtccgcatcatgaagcacaccctggagatcatccacctgctcactgacgccaatcccatccaggtggtcgtggacgccattatcaacagtggaccacgtgaggatgccacccgtattggttctgctggtgttgtgagaaggcaggctgtggatatctcacccctgagaagggtgaaccaggccatctacctcctcaccactggtgccagggagagcgctttcaggaacatcaaaaccattgctgagtgccttgcagatgagttgatcaacgctgccaagggctcttccaacagctacgccatcaagaagaaaggacgagattgagcgtgttgccaaggccaaccgttgagtggagcttgtatcctggtgcacttgctctagagctacgtttctggcagccgtgttttttcttgnt

SEQ ID NO: 73255 - protein, 191 aa, Zea mays
  misc_feature: Ceres CLONE 1557532
  misc_feature (44)..(190): Pfam Name: Ribosomal_S7 Pfam Description: Ribosomal protein S7p/S5e
MAEVEQPQDAVKLFNRWTFDDVQVNDISLNDYLAVTAAKHATFLPHSAGRYSKKRFRKAQCAIVERLTNSLMMHGRNNGKKVMAVRIMKHTLEIIHLLTDANPIQVVVDAIINSGPREDATRIGSAGVVRRQAVDISPLRRVNQAIYLLTTGARESAFRNIKTIAECLADELINAAKGSSNSYAIKKKGRD

SEQ ID NO: 73256 - DNA, 916 bp, Zea mays
  misc_feature: Ceres CLONE 1557534
  misc_feature: Encodes the peptide sequence at SEQ ID NO. 73257
  misc_feature (399)..(399): n is a, c, t, g, unknown, or other
  misc_feature (400)..(400): n is a, c, t, g, unknown, or other
ctccccgcggtggcggccgctctagaactagtggatcccccgggctgcaggaattcgtctcacccctagaaaaaacagccgatccggacgagaaggcccgcctcggggacctcgccgcgtcgcggtggctgcgcggcgacatcccgctcccctacgacccgtcccgccccgcgcgcccgccgcccgaccgccccgcccggagcgccgaggtgcggctgctcccgccgtcgcggatgccgaagctgggcaagggcggcagcgcgcagagccgtttggccatgctccactcgctggcgcacaccgagagctgggctgtcgacctttcctgggacatcgtcgcccggttcggggcggccatgcggatgccccgcgacttcttcgacgacttcgcgcgcctcnncgcagacgaggggaggcactacacggtgctctcagcgcggctgagggagctcgggtcgcactacggcgccctcccggcgcacgacgggctatgggactcgggcatgcgcacctcgcatagccttttcgcgcgcctcgccgtcaagcactgtggtcacgaggctagggggattagaggtctttccacaacccttttcaagatttcccagcaggtgggggatgaaccaaacgcggggactccctaaaaaaaatttttttttcctggaaagggggaaccccttgcccccctgggggttaaaagggttcaaaaaacctggggccctaggggcccccggggaatcccccccacccctaatcccgttccccgggaagggaacccccctttccttggggttcccggggggaaggcccctccttttggttaaaacaccctgggggggccgggagggggaacccccccccccaactgtggaaaaagaaatcggggggcgaaacaaaaagggggcccaccgggggg

SEQ ID NO: 73257 - protein, 213 aa, Zea mays
  misc_feature: Ceres CLONE 1557534
  misc_feature (24)..(214): Pfam Name: DUF455 Pfam Description: Protein of unknown function (DUF455)
  misc_feature (133)..(133): Xaa is any aa, unknown, or other
PRGGGRSRTSGSPGLQEFVSPLEKTADPDEKARLGDLAASRWLRGDIPLPYDPSRPARPPPDRPARSAEVRLLPPSRMPKLGKGGSAQSRLAMLHSLAHTESWAVDLSWDIVARFGAAMRMPRDFFDDFARLXADEGRHYTVLSARLRELGSHYGALPAHDGLWDSGMRTSHSLFARLAVKHCGHEARGIRGLSTTLFKISQQVGDEPNAGTP

SEQ ID NO: 73258 - DNA, 785 bp, Zea mays
  misc_feature: Ceres CLONE 1557535
  misc_feature: Encodes the peptide sequence at SEQ ID NO. 73259
  misc_feature (311)..(311): n is a, c, t, g, unknown, or other
  misc_feature (369)..(369): n is a, c, t, g, unknown, or other
  misc_feature (373)..(373): n is a, c, t, g, unknown, or other
  misc_feature (374)..(374): n is a, c, t, g, unknown, or other
  misc_feature (387)..(387): n is a, c, t, g, unknown, or other
  misc_feature (458)..(458): n is a, c, t, g, unknown, or other
  misc_feature (497)..(497): n is a, c, t, g, unknown, or other
ggagctccccgcggtggcggccgctctagaactagtggatcccccgggctgcaggaattcgtctcacccctagaaaaaaccccgcctttgccttggtgaagaaaagtcgccgcgttcctcttgcctgatgaaatcctcttctcgtctagatctgagcctccgcgtggcttccggatcagatgcttggtccgatcgaacaacggtgagtcttgctctgttacttgattgttcgaaacgcatggttttgttttgtgatgatgtgcaggttccgatctgtttcgtttgattgatgagttgacgacgcatcagcntcgaaagcgagacgaggctgcatggtttttgtgcctggaggtttctgatccgcgtggntaanngaactggtgctancatttgtttgctacagtgcccgatccgtcgaattgatgtctgccgaccttcagagctgcgacgttccgggnaatctggggggatctggatcttggccgactggacaattnggggagcgtctaaagcatggctggacattgtgaagatgggacaccttgaaaggcttggccaatgttgggtgcccctcccatggcaggcatcttaataaaaatgtttggtttttgggggccggggtggggaatcccccccgggggaattgtttttttcatccccgggggttccccccccccctttggttcccccgggccccgtggttttgggtgttttgggggtttccccgtttaaggctttaattcacccgggggctcgtcggaaaatttgaacggaaatcttctccc

SEQ ID NO: 73259 - protein, 52 aa, Zea mays
  misc_feature: Ceres CLONE 1557535
MKSSSRLDLSLRVASGSDAWSDRTTVSLALLLDCSKRMVLFCDDVQVPICFV

SEQ ID NO: 73260 - DNA, 874 bp, Zea mays
  misc_feature: Ceres CLONE 1557537
  misc_feature: Encodes the peptide sequence at SEQ ID NO. 73261
caaagctggagctccccgcggtggcggccgctctagaactagtggatcccccgggctgcaggaattcgtctcacccctagaaaaaaagtgccaccacgacgctactcgtcctcatccagtcacgaaaaatcggaatctctgaaaaatcctccgtaccatgaagctccggttgcgatctatgcaggcgcgcggcggctccgccgccgtggagacccaccgcgtggacctgccgcccacggccactctggccgacgtgaagaccctcctcgcgtcgaagctctctgcggcgcaacccgtccccgccgagtccgtccgcctctccctcaaccgtagcgaggagctcgtctcgccggaccctgccgctacgctcccgtccctcggcctcgcgtccggtgatctcgtatttttcaccctatcccccctcacggccctagcgccgccggctcaggccctgccacggaaccctagcccgagctctggcgctgcagcgtcgatcgctgaggctgccgaccgcgggaagggttcgaagcaatctggtactggagatttctcttcctcgtcactggcgcaggctgtggttgtgagccctagctttccggtcgcttccggtacgcgggatgtggtgatgggaggaagaagcccgtcgatgccacaaagggctggtcgagttttgtgcttagggatctcaagagggagatggacaacgtcggggccgcggagggaacccgcgccagtcgcctgggtgcggccttgcatgcagctctgcttgatgccggttttctcaccgctaaactgacgggctctcacctttcgctgcctcagggctgggcgtccagtgcttttaaagcatttgacccatcaagtatactatacc

SEQ ID NO: 73261 - protein, 212 aa, Zea mays
  misc_feature: Ceres CLONE 1557537
MKLRLRSMQARGGSAAVETHRVDLPPTATLADVKTLLASKLSAAQPVPAESVRLSLNRSEELVSPDPAATLPSLGLASGDLVFFTLSPLTALAPPAQALPRNPSPSSGAAASIAEAADRGKGSKQSGTGDFSSSSLAQAVVVSPSFPVASGTRDVVMGGRSPSMPQRAGRVLCLGISRGRWTTSGPRREPAPVAWVRPCMQLCLMPVFSPLN

SEQ ID NO: 73262 - DNA, 855 bp, Zea mays
  misc_feature: Ceres CLONE 1557543
  misc_feature: Encodes the peptide sequence at SEQ ID NO. 73263
  misc_feature (672)..(672): n is a, c, t, g, unknown, or other
agctccccgcggtggcggccgctctagaactagtggatcccccgggctgcaggaattcgtctcacccctagaaaaaacccatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacaccctcaactacttcggcaacagcatccccatcaacctggtggtggccgtgatcgncgaagtcatcctcgtcggcggcgccgagtactaccgggatcaccaacggactggaactagaggaccagctgcaccccggtgggccccttccaaccccttgggcctgggcaagcgaccccgaaccaggccgccaatccttcagggtgaaaggaaaatcaggaacgggccgggttggcccatgtt

SEQ ID NO: 73263 - protein, 240 aa, Zea mays
  misc_feature: Ceres CLONE 1557543
  misc_feature (83)..(217): Pfam Name: Chloroa_b-bind Pfam Description: Chlorophyll A-B binding protein
  misc_feature (180)..(180): Xaa is any aa, unknown, or other
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLDGNTLNYFGNSIPINLVVAVIXEVILVGGAEYYRDHQRTGTRGPAAPRWAPSNPLGLGKRPRTRPPILQGERKIRNGPGWPM

SEQ ID NO: 73264 - DNA, 825 bp, Zea mays
  misc_feature: Ceres CLONE 1557546
  misc_feature: Encodes the peptide sequence at SEQ ID NO. 73265
ctccccgcggtggcggccgctctagaactagtggatcccccgggctgcaggaattcgtctcacccctagaaaaaagcggcatctatagcaaccggtccaacactttcacgctcaggcgctcagctctagcaatggctgcctccaccatggcgatctcctccacacgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactaccttggcaaccccagcctgatccacgcgcagagcatcctcgccatctgggcctgccaggtcgtgctcatgggctccgtcgagggctaccgtattgccggcgggccgctcggcgaggtcgtcgacccgctgtaccctggcggcagcttcgaccccctcggcctgtccgacgacccccgagccttcgccgagctcaaagtgaaagagctcaagaacgggcgccctcgccatgtttttccatgtttcggcttcttccgtccaagccatcgtct

SEQ ID NO: 73265 - protein, 219 aa, Zea mays
  misc_feature: Ceres CLONE 1557546
  misc_feature (49)..(203): Pfam Name: Chloroa_b-bind Pfam Description: Chlorophyll A-B binding protein
MAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGSVEGYRIAGGPLGEVVDPLYPGGSFDPLGLSDDPRAFAELKVKELKNGRPRHVFPCFGFFRPSHR

SEQ ID NO: 73266 - DNA, 836 bp, Zea mays
  misc_feature: Ceres CLONE 1557547
  misc_feature: Encodes the peptide sequence at SEQ ID NO. 73267
  misc_feature (562)..(562): n is a, c, t, g, unknown, or other
  misc_feature (718)..(718): n is a, c, t, g, unknown, or other
ctccccgcggtggcggccgctctagaactagtggatcccccgggctgcaggaattcgtctcacccctagaaaaacttaccaggtccagacatagcaaggattgacagactgagagctctttcttgattctatgggtggtggtgcatggccgttcttagttggtggagcgatttgtctggttaattccgttaacgaacgagacctcagcctgctaactagctatgcggagccatccctccgtagttagcttcttagagggactatggccgtttaggccacggaagtttgaggcaataacaggtctgtgatgcccttagatgttctgggccgcacgcgcgctacactgatgtatccaacgagtatatagccttggccgacaggcccgggtaatcttgggaaatttcatcgtgatggggatagatcattgcaattgttggtcttcaacgaggaatgcctagtaagcgcgagtcatcagctcgcgttgactacgtccctgccctttgtacacaccgcccgtcgctcctaccgattgaatggtccggtgaagtgttcggatccggcnacacggggggcggttcgccgcccccgacgtcgcgagaagtccattgaaccttatcatttagaggaaggagaagtcgtaacaaggtttccgtaggtgaacctgcggaaggatctgtgtctattgtgtaagtacaattttgaaggtgaagaagagcangctaaaacctagtttggagcatttgccgaacccaaaaaaaatgtttggcaataacacgcccgcgatgttggtttagtatattatattatattcataagatgtactcatattcctgatc

SEQ ID NO: 73267 - protein, 52 aa, Zea mays
  misc_feature: Ceres CLONE 1557547
  misc_feature (38)..(38): Xaa is any aa, unknown, or other
MPSKRESSARVDYVPALCTHRPSLLPIEWSGEVFGSGXTGGGSPPPTSREVH

SEQ ID NO: 73268 - DNA, 828 bp, Zea mays
  misc_feature: Ceres CLONE 1557553
  misc_feature: Pfam Name: DRMBL Pfam Description: DNA repair metallo-beta-lactamase
  misc_feature (739)..(739): n is a, c, t, g, unknown, or other
  misc_feature (825)..(825): n is a, c, t, g, unknown, or other
ctggagctccccgcggtggcggccgctctagaactagtggatcccccgggctgcaggaattcgtctcacccctagaaaaaaaccactcgaagatatctaaagaaacaaccaaaaaccctcattgttgttggggcatatagcattgggaaagagaatgtgtatctagcaatttcccaagctttagaggcccatatatacactgatgcatcgagaaggcggattctctactcatttggctggccagatttgtccaaaaggctatgttcatgcaatcaaagttcatcacttcatgttctgccccttggatctataaatcatgagaacttgaagaagtacttggagactcttaatggaagattcctagctgtgctggcttttcggcctacaggttggactttctctgaggcaactggaaagcatcttgacctaataaaaccaagctctaatgccaatgtaacaatctatggtgtgccttatagcgagcattcaagtttcactgagcttagggattttgtgatgtttctgaaacctcaaaagataattcctactgttaatgttggcaatgcgacaagccgagataaaatgcaagcacatttccgggaatggctgaagagcccgtgataaatatatcctgatcatgttttttctatatcggcgtcaactcgactccactcaatgaggtacggctgtataccatccttacactcagttcactataacgcctcttttcttcactttnattgttggacttcaacgaatgttgattcttttatgccagtgacacagtcatggtacggaaaagaagtggatatattttttaaaggntgg

SEQ ID NO: 73269 - DNA, 842 bp, Zea mays
  misc_feature: Ceres CLONE 1557554
  misc_feature: Translation starting site: 262
tggagctccccgcggtggcggccgctctagaactagtggatcccccgggctgcaggaattcgtctcacccctagaaaaaccagttgagttccccccgcggccccgcccccggtccccttccaccgacccaccatgtcggcgatgaggtgaggttgaggccaggtctactctccgcgaccgtcgccgacgccatcgccaacgagcagtttgctccatcttcgccatctcgcacacgaatacaatacactagttttggtagagatggaggacggcggcaaggcgccggccggcctgggcaccctgcgcgcggtgctcgccatcctccagtggtggggcttcaacgtcaccgtcatcatcatgaacaagtggatcttccagaaactggatttcaagttccctctcaccgtgtcctgcgtccacttcatctgctcttccattggagcttacattgcaatccatgtcctcaaggcgaaaccccctgatcaagttgaaccgggaagaccgctggaaaaggatatttccaatgtccttcgtcttctgcataaacattgtgctgggaaatgtcagcttgcgctacatcccagtcttcttcatgcagacaatcaaatctttcactcctgcaacacccgttattcttgcagtgggttagtcttgaagcaagcatttcgagggggggcaaaatggggcttccccggggccccaaaaggttggggggaaaaactccttggaatttcggggggaagaaaccttaggcttccccaaaatttttccgggtttccgggggcgggccccggggtggggggggccccggggcaacctctcttacaaaaacacacattttt

SEQ ID NO: 73270 - DNA, 686 bp, Zea mays
  misc_feature: Ceres CLONE 1557557
  misc_feature: SWISSPROT Homolog: EC 1.11.1.15 Peroxiredoxin
  misc_feature (287)..(287): n is a, c, t, g, unknown, or other
  misc_feature (288)..(288): n is a, c, t, g, unknown, or other
ctggagctccccgcggtggcggccgctctagaactagtggatcccccgggctgcaggaattcgtctcacccctagaaaaaacccccacccattcactcgccttgcgcttcctcgccgccccagttccccaccccctgctcacccacccgtcccctcctgctcgcccatggctcccatcgctgtctggcgacgtccctccccgacggccagctcgggtggttcgacgagaacgaccagctgcagcaggtctccgtccacgcgctcgccgccggcaagaaggtcatccnntcttcggcgtcccccggcgcctttcacccccgacctgccagcaaaccagcattgtgcccaggccttcattccacacaaggcctggaaacaagcctccaaaagccaaaggggtgggaaaaaccaaaaatccccgggcttttattcaagccgttttaaacgaacccccccctttccgtcaattgaaaaagggcccgggggggcccaaaaaaaaacctttacccccccggaaagaaaaaaaaaggccccccggggaaaaaatttttcccccccccccccaaaaaaagggaaatgcttggggggaaagcggttaacaacccccaagaagggggggggcctcctcaaaaacccccccgcaagaaaaacccccccaaaaaattcctccccccccgggggaaaaa

SEQ ID NO: 73271 - DNA, 859 bp, Zea mays
  misc_feature: Ceres CLONE 1557560
  misc_feature: Encodes the peptide sequence at SEQ ID NO. 73272
  misc_feature (703)..(703): n is a, c, t, g, unknown, or other
  misc_feature (704)..(704): n is a, c, t, g, unknown, or other
  misc_feature (718)..(718): n is a, c, t, g, unknown, or other
ctccccgcggtggcggccgctctagaactagtggatcccccgggctgcaggaattcgtctcacccctagaaaaaaaaccggccaagccaccaaccagcgccccccaccgccgcctttttatttcatccacgctgctcgtgctcgctgcctgcttctcgcgcgatcgtctcggcctctcgggattctagagcggcggccggctctccgcctgttcttgtcgtcgctgctcctttcccaggatgtcggaacgttctgagagcgcaactgaaaagattatgagcagcatcatggataccattgctgacaaccttcctaagcagaagtctgggaaatttgatccaggttcagtctctgacaaagtgaagaataagctgtttggtcgtcagaagaccttgcatggagttctgggtggtggaaaacctgctgatgtgctgttatggaggaacaaaaagatatcatcgagtgttctggctcttgcaacagctatttgggttttctttgagtggctcgactaccacttactgacaattgtttcatttgcccttgttcttggaatggttgtccagtttgtttggtccaacttctcaaacatgctaagcagcggatcccgttctcaggtgccccgagttgaattgcctgatgagttatttgtgaacattgccgttgcaatcggtgcccaaataaacaagttcctgtgcttccnntcagatgtttcttngtgaagaaactttgagcatttggtagtggcgatcgcaggactgtgggctgctgcgggtgattggaagttggtgcaatttcctgactgtcatatatgtccggggtttgttgtgtttcccaccctttccgtggctctatgaga

SEQ ID NO: 73272 - protein, 159 aa, Zea mays
  misc_feature: Ceres CLONE 1557560
  misc_feature (61)..(161): Pfam Name: Reticulon Pfam Description: Reticulon
  misc_feature (155)..(155): Xaa is any aa, unknown, or other
MSERSESATEKIMSSIMDTIADNLPKQKSGKFDPGSVSDKVKNKLFGRQKTLHGVLGGGKPADVLLWRNKKISSSVLALATAIWVFFEWLDYHLLTIVSFALVLGMVVQFVWSNFSNMLSSGSRSQVPRVELPDELFVNIAVAIGAQINKFLCFXSDVS

SEQ ID NO: 73273 - DNA, 807 bp, Zea mays
  misc_feature: Ceres CLONE 1557562
  misc_feature: Encodes the peptide sequence at SEQ ID NO. 73274
ctccccgcggtggcggccgctctagaactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtcaccggtggcgtgctttctgctccgcttctcgacgggcgggcaggccacgggcacctttcggctgacggggcttgtcggtgtgggaaggcctggggccggaaaacctgaataaccttcgggctgggggaacccgggggacccccaccgggggggggaccccaaaaaaagggagaccctggggccccactccccccccaattgccaattgggttttaaccgggggggggccaaactccctctggtgggggggggggcctttttaaagagggggggtctataaaacacccccccccc

SEQ ID NO: 73274 - protein, 150 aa, Zea mays
  misc_feature: Ceres CLONE 1557562
  misc_feature (13)..(148): Pfam Name: MIP Pfam Description: Major intrinsic protein
MPINRIALGSHQEVYHPGALKAAFAEFISTLIFVFAGQGSGMAFSKLTGGGPTTPAGLIAAAVAHAFALFVAVSVGANISGGHVNPAVTFGAFVGGNITLFRGLLYWVAQLLGSPVACFLLRFSTGGQATGTFRLTGLVGVGRPGAGKPE

SEQ ID NO: 73275 - DNA, 840 bp, Zea mays
  misc_feature: Ceres CLONE 1557564
  misc_feature: Encodes the peptide sequence at SEQ ID NO. 73276
  misc_feature (626)..(626): n is a, c, t, g, unknown, or other
gcggtggcggccgctctagaactagtggatcccccgggctgcaggaattcgtctcacccctagaaaaagacaggtgactccgtgaccgtgagtgcctacccgccgaccgcacgaaccccactcggtcggtcactcccagtctccatctcccactacggcactaccccatccccggtgcggcgccaccttcccggcttccccttccggccttccccctctcgtcacttatggtgcccagccgctcgctgcgcaactactagcgcaccgtcccctcctcagccatggccgcggcgtcgttcgcccgcgccttatgtctccacatgctcctcctcttcctcgtggttggctcggcgcgctgcaagacggtgaagagagacgtgaaagcattcaatgagatcaaatcttcactaggctggagagttgtatactcatgggtcggtgatgatccttgtgggcatggtgatctacccccctggtctggtgtgacatgttctcagcaaggggattacagagttgtgacggaactggaagtctatgctgtatcaatagttggccctttcccaacagcagtaactaacctgttggatctaagaagattggatctccacaataacaagttgacaggnacaattcccccacagattggacggttgaaacatctcaggatattgaacctgaggtggaataagcttcaagatgtgcttccacctgaaattggtgaactgaaagaactgacacacttgtattttgagctttcacaacttcaaaggcgagattccaggtggagctttgaaaactgtgcaaaactccgttaaccttaatctttaacaagaaccgctt

SEQ ID NO: 73276 - protein, 177 aa, Zea mays
  misc_feature: Ceres CLONE 1557564
  misc_feature: SWISSPROT Homolog: EC 2.7.11.1 Non-specific serine/threonine protein kinase
MAAASFARALCLHMLLLFLVVGSARCKTVKRDVKAFNEIKSSLGWRVVYSWVGDDPCGHGDLPPWSGVTCSQQGDYRVVTELEVYAVSIVGPFPTAVTNLLDLRRLDLHNNKLTGTIPPQIGRLKHLRILNLRWNKLQDVLPPEIGELKELTHLYFELSQLQRRDSRWSFENCAKLR

SEQ ID NO: 73277 - DNA, 864 bp, Zea mays
  misc_feature: Ceres CLONE 1557566
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
ccccgcggtggcggccgctctagaactagtggatcccccgggctgcaggaattcgtctcacccctagaaaaaacgagcccttctcgtcctcagatctagcgcctccttcaccctgctgctggccggcgagctcctcagcgtggttttgagcagacccacatatctctgtatttcaattatctggtggcgcaccctcacattgctagagccttcaacaagttgccattcgaccacaagttaatctgggctcgcaatttcgtcagtgaaaagtttctaggagtgtgagggcagttggtaggtaggcttggagggttcttttgcttgaaccacattgaacaatgaactgtgatctatgtgtaaccaggagtgtgagggcagttagtagataggcttggacggttcttttgcttgaactacatcaaacaatgaaatgtggtctaagtatgtcaacggattttgcttgaacatgcagattttgtggaagccttnnnnnnnnnnnnnnnnnnnnnnnnnnnnnnnaagactgcaccccccatcccgcagcagccaaaacctacctagccgccgcccgcagggggccccccatcggcccccaaaaagcaaatctttgttaaagactcctgagggggaaaaaccatcccttttggaggggggagccctcggaacacctttggacaaggggaaagggcccaaaaccccggaaaaagggaggggtttcccccccggaaaaaaaaagggggtttaattttttcccgggaaaaaaaattttcagggaaaagggttccaccccctctcccccgaaataaaaaatttttaaagaggggggccccccccccctccccctggggggtgtcccccctcccc

SEQ ID NO: 73278 - DNA, 768 bp, Zea mays
  misc_feature: Ceres CLONE 1557567
  misc_feature: Encodes the peptide sequence at SEQ ID NO. 73279
  misc_feature (106)..(106): n is a, c, t, g, unknown, or other
  misc_feature (352)..(352): n is a, c, t, g, unknown, or other
ctggagctccccgcggtggcggccgctctagaactagtggatcccccgggctgcaggaattcgtctcacccctagaaaaaacaaccgtagcctgtagcttcatccngttgcgctgcgcccggttccctcgcgcggtgcggaatttaacatggccgtgccggaggtggtggtcgacggcgtcgtcttcccgccggtggcccgcccgccgggctccgccggctcgcacttcctcggcggcgcaggcgtgctaggcgtcgagatcggaggcaacttcatcaagttcacggccatcggcgtgtacctggaggacgcggccgtgcccgcgctggccaagaagtggggcggcaagacnggccgacgagctcgccctccgacgccggcctttctttccgcggacggtccgtcaccggggcgaaaccttccgaaagaagtttccccaaggggggggaaccaaataaatcccttccccccttaacggggcgaaaccatttcccccggaaataaagtgaccggaaaaaattgccgtggggctttttttggaaaaagggcccccccgggcccctttttaacccgggaaacccccccaaggggggggcccccccccccccgggggagaaaaataatttttccccggggggggggggggggtttttcctataacccccccccaaaaaaaaaaaatttttttttttttttcttccccccccccggggggggggggcgcgccccccacaaacaaatctttttttttttttataaaaaaaaagc

SEQ ID NO: 73279 - protein, 108 aa, Zea mays
  misc_feature: Ceres CLONE 1557567
  misc_feature (1)..(104): Pfam Name: Chalcone Pfam Description: Chalcone-flavanone isomerase
  misc_feature: SWISSPROT Homolog: EC 5.5.1.6 Chalcone isomerase
MAVPEVVVDGVVFPPVARPPGSAGSHFLGGAGVLGVEIGGNFIKFTAIGVYLEDAAVPALAKKWGGKTGRRARPPTPAFLSADGPSPGRNLPKEVSPRGGNQINPFPP

SEQ ID NO: 73280 - DNA, 901 bp, Zea mays
  misc_feature: Ceres CLONE 1557568
  misc_feature: Encodes the peptide sequence at SEQ ID NO. 73281
  misc_feature (537)..(537): n is a, c, t, g, unknown, or other
ctggagctccccgcggtggcggccgctctagaactagtggatcccccgggctgcaggaattcgtctcacccctagaaaaacccgacgaaataaaaagattctctctccttttctttttcttctctccacccgcttctctctgttgatttctggccggggttggctggcttggttctccttctggctgctcgctcgcctgcaaccgccaagggacaggaagcaagaaggattggaccgccgtccgccgggacacctcttcctgatccaaatccaagggacggacagctaaagtagctgtggaatatggaagtcgagcaggccgccgaagtaagcgctccagagacggctgatcttaacgtgcctgctaagacgccggcacacgatgatgataaagaaaaagtacccaatggtaatacaaatttgcaagtcaaggaaacacacaatgatgaagacgatggaactggatctgatggggtttgaactgatagatgtgaaggaaaactttgactcagcaaaagtgggggaagaaatcgctgnctcaagaagtactacggtttgatacatcttctggtacacgaacaagttgaaccccaggaagaaaaaattaccggcccctgaagaaacaatcagtttgcggcaaacacaaaaaatgtaaaagtccttaattgtttgaccaacaaaacaaaaccatttggaaaaacttaacaagggcttatttggggaccttttactccgaaaaaaaaaaaacccttaaagggttttttccaaaaaccaaaaaaaaaaagagaaagggggcccaaggtgtttcctaaaaagagaccaaaagcccttttttttaaaaaaaaaaaaagagggggggggggaaaaaaaacaaaactcttcaaaagaagagcgtggtttc

SEQ ID NO: 73281 - protein, 58 aa, Zea mays
  misc_feature: Ceres CLONE 1557568
MEVEQAAEVSAPETADLNVPAKTPAHDDDKEKVPNGNTNLQVKETHNDEDDGTGSDGV

SEQ ID NO: 73282 - DNA, 785 bp, Zea mays
  misc_feature: Ceres CLONE 1557570
  misc_feature: Encodes the peptide sequence at SEQ ID NO. 73283
ctccccgcggtggcggccgctctagaactagtggatcccccgggctgcaggaattcgtctcacccctagaaaaagtaacaaagtcatcactcatcacatgagcttgcttgtgactgccagctttgcccagtgttcatcgcccatggaagagcgggcactgttcccggtgtccgattccagcaccacctgcagcagctctggctgtaccggccccaactcccctgtctcgtcgtcgcagtatttggacgacaccagcgacggcgccggcagctcgagcagccggaagcggccgcgccgggagctgaagcatccaacgtaccgcggcgtgcgcatgcgtgcgtggggcaagtgggtgtccgagatccgggagccccgcaagaagtcgcgcatctggctgggcaccttcgacactcccgagatggccgcgcgcgcgcatgacgtcgccgcgctcgccatcaagggccgcgccgcgcacctcaacttcccggagatgtcccacgagctgccccgcgccgcatcggcggcccagactgccttttttggcgggggcggccctcgcggccgcgatggagatgggaaaagcgtggcgccgcccacttctagcgagtctcgcgacggcgcccgcaatgacgaaaatgaagggccggccgcatctagctcgtccggcaacgacgccgacaatgcccagaccgaagagcgggctgcgccgtccgagcattcgatgctggctgacgggcacatccttaatctcgcggtcttcgagctgccggacgtcctactcgagt

SEQ ID NO: 73283 - protein, 214 aa, Zea mays
  misc_feature: Ceres CLONE 1557570
  misc_feature (57)..(108): Pfam Name: AP2 Pfam Description: AP2 domain
MEERALFPVSDSSTTCSSSGCTGPNSPVSSSQYLDDTSDGAGSSSSRKRPRRELKHPTYRGVRMRAWGKWVSEIREPRKKSRIWLGTFDTPEMAARAHDVAALAIKGRAAHLNFPEMSHELPRAASAAQTAFFGGGGPRGRDGDGKSVAPPTSSESRDGARNDENEGPAASSSSGNDADNAQTEERAAPSEHSMLADGHILNLAVFELPDVLLE

SEQ ID NO: 73284 - DNA, 842 bp, Zea mays
  misc_feature: Ceres CLONE 1557571
  misc_feature: Encodes the peptide sequence at SEQ ID NO. 73285
  misc_feature (718)..(718): n is a, c, t, g, unknown, or other
  misc_feature (751)..(751): n is a, c, t, g, unknown, or other
ctccccgcggtggcggccgctctagaactagtggatcccccgggctgcaggaattcgtctcacccctagaaaaacactcgaatgtccctgtatttcaactgtccagttatcttgccttgccactcatgagtatacttaatatagccagagaatttgggttgcagcataccacaccctcgattgatgataatgatctatgttcagtttgtctagaaaggtcttgttctgttactgctgaaggttgcagtcatgaattctgcatcaaatgtgctctctacctctgctcaaccagcaacatccgtgtcgagttcacaggcccacctgggtccatcccgtgccctctttgtcggaacggcataatgtctttcaccaagttaccaagcacaccaacagaagggcttaaatcaggttcagcgctcacattctgcaacccatgcatactgaacgcccggtccatggactcgccagccactttctccaaagctgaaatcagacggaaccgtgtggcagctgtctcttcggagctggtctgtccaatcacctgcagcccattcccgtcgtccgccctcccaacctgcaggtgcagcgacgacgatccatgcggcgatacagacgtgcaggatggtcccgagttccagtctccccggccctcgcacagcgcaagcatggagctggacagagggggggaagggggatctagaccgggccagttgctcangcatgttctggagccgaagaagctgtcacaggnagcagcagtgtgatgcggagatcaacgctttgattcttatctgtggttctgaattaaatttggattcgtagcagctccaacgcgggagatg

SEQ ID NO: 73285 - protein, 253 aa, Zea mays
  misc_feature: Ceres CLONE 1557571
  misc_feature (239)..(239): Xaa is any aa, unknown, or other
  misc_feature (250)..(250): Xaa is any aa, unknown, or other
PRGGGRSRTSGSPGLQEFVSPLEKHSNVPVFQLSSYLALPLMSILNIAREFGLQHTTPSIDDNDLCSVCLERSCSVTAEGCSHEFCIKCALYLCSTSNIRVEFTGPPGSIPCPLCRNGIMSFTKLPSTPTEGLKSGSALTFCNPCILNARSMDSPATFSKAEIRRNRVAAVSSELVCPITCSPFPSSALPTCRCSDDDPCGDTDVQDGPEFQSPRPSHSASMELDRGGEGGSRPGQLLXHVLEPKKLSQXAAV

SEQ ID NO: 73286 - DNA, 848 bp, Zea mays
  misc_feature: Ceres CLONE 1557575
  misc_feature: Translation starting site: 172
  misc_feature (554)..(554): n is a, c, t, g, unknown, or other
  misc_feature (555)..(555): n is a, c, t, g, unknown, or other
  misc_feature (584)..(584): n is a, c, t, g, unknown, or other
  misc_feature (585)..(585): n is a, c, t, g, unknown, or other
  misc_feature (587)..(587): n is a, c, t, g, unknown, or other
  misc_feature (588)..(588): n is a, c, t, g, unknown, or other
  misc_feature (590)..(590): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (605)..(605): n is a, c, t, g, unknown, or other
  misc_feature (607)..(607): n is a, c, t, g, unknown, or other
  misc_feature (608)..(608): n is a, c, t, g, unknown, or other
  misc_feature (612)..(612): n is a, c, t, g, unknown, or other
  misc_feature (616)..(616): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (651)..(651): n is a, c, t, g, unknown, or other
  misc_feature (652)..(652): n is a, c, t, g, unknown, or other
  misc_feature (656)..(656): n is a, c, t, g, unknown, or other
  misc_feature (659)..(659): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (697)..(697): n is a, c, t, g, unknown, or other
  misc_feature (698)..(698): n is a, c, t, g, unknown, or other
  misc_feature (702)..(702): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (730)..(730): n is a, c, t, g, unknown, or other
  misc_feature (731)..(731): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (762)..(762): n is a, c, t, g, unknown, or other
  misc_feature (767)..(767): n is a, c, t, g, unknown, or other
  misc_feature (768)..(768): n is a, c, t, g, unknown, or other
  misc_feature (788)..(788): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (821)..(821): n is a, c, t, g, unknown, or other
  misc_feature (822)..(822): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (836)..(836): n is a, c, t, g, unknown, or other
aaagctggagctccccgcggtggcggccgctctagaactagtggatcccccgggctgcaggaattcgtctcacccctagaaaaagtcacccgctcgatcggcgggcgctggagcgcgcgcatctagctttgtgcaagtttcacgggatctctagttttgtcggcggcacatatgagcagctccaagcacgccgcgggcgccgtaggcggcaaggccgcgcgcgcctgcgacagctgcctgcggcggcgcgcgcggtggtactgcgctgccgacgacgccttcctgtgccagggctgcgacgcctcggtgcactcggcgaacccgctcgccaggcggcacgagcgcctgcgcctgcgcccgacggacccgcactcgacgacgctcgaggccggcgtggcgacggcgacgtggaagaagcgccagcagcaggtcgcgccggcgtggtccaagcgcaaggcgcgcactcggaggccgcacgtcaagagcgtcggggagctcctgtcgaggaagctcgtcgtcgtgcctgaggtgtccacatcgaatcgtctgaaggnnaaagcccaaggagaaaaagaagaaaaaannannanggnnnannnnnnngnanngggngggngaaannnggaagggggnnnggggaagaaannnggnngganaanggggnnngggggggaaggaacagaagggggnnnaaaanngggnggaaggggaagaaagnnnaaaagggggnngggggaaaaaaaaaaaaaaaagggannnaanggggnngggggggggggggaaaaaangccgggggagagaaaannnngggggaaaagggnnttggcggggnnnanggagccaaaggg

SEQ ID NO: 73287 - DNA, 773 bp, Zea mays
  misc_feature: Ceres CLONE 1557576
  misc_feature (284)..(284): n is a, c, t, g, unknown, or other
  misc_feature (638)..(638): n is a, c, t, g, unknown, or other
  misc_feature (639)..(639): n is a, c, t, g, unknown, or other
  misc_feature (738)..(738): n is a, c, t, g, unknown, or other
  misc_feature (744)..(744): n is a, c, t, g, unknown, or other
ggagctccccgcggtggcggccgctctagaactagtggatcccccgggctgcaggaattcgtctcacccctagaaaaagagcgccgccactccctgacatcgagaccggctgcccgaccccggtccggcgatccctctgcacccctttctttgcgctgccagccccaatctctcgcatccctgtcaaccatggcggcgtcagcaggcggaggcgcggtgcgcgcgctgtcccagaaggagcaggggacatacagaatgaatgctcgcgggcccgacgtccaccntcgggcacccaagaacctgcgatttccaggatgggagcgggtaatgttctttaaagcgttcggcaccgaccggcaatctaacattattcaaaccttgggcaaaaaaacatggggaaaaaagctccccagtttccggggggaaggggtttaattgccccccccctttggaaaaaacccctccaagaaaaaattttttgtttccaaattggggccccccccccctaaaggggccaaagggggggtttttctctcaaaaaaatttcccccgccaaaaaaaaaaaatggggggggccccccaaggggacaaaatttgggggggggggggggggcgaaacacccccccccctggggggnngcccccttttttttttttcccaaaaaaaaaaaaattatgtttcctcaaaaaaaaaaaatattttttttttttttttgagagagggggaggggcgccagngagccnacggcgggggggtggggggattagttctc

SEQ ID NO: 73288 - DNA, 845 bp, Zea mays
  misc_feature: Ceres CLONE 1557577
  misc_feature: Encodes the peptide sequence at SEQ ID NO. 73289
  misc_feature (836)..(836): n is a, c, t, g, unknown, or other
  misc_feature (837)..(837): n is a, c, t, g, unknown, or other
ctggagctccccgcggtggcggccgctctagaactagtggatcccccgggctgcaggaattcgtctcacccctagaaaaagtcagtccctcccaacctccattccttcctcccttgtcaatgcagctctgatctctcctacctgagaatgtcagtgtgagtggccattccatctgcacaacatcctcctccacgcacgcaaaacatacaaaaaggcagaagcggaggagatgaaggcaatggccgggccaaagctgctcgtcgtccacgcgtcgtcgaacaaggccctgaacgggatggcgcccacgtcgccggcgtcacccggctggtcccggtgcctgtggctggtggtgttcctggccttgttcacctgcgtgtccctcctgaccgtgctctccacggcgcgcgcctcggccggggcgccggcgtgccaggcggcgtcgctcacggacagcgctgccggcgccacggaggccggcctgccgcggcacgtgttcgacgcgctggtgcagtacgcggcggcggcagggaacttgtcgtcgagcatgccggagccggacgtgcgcgcgatcgcgtcggtgctccggcggcgcgcgccgtgcaacctgctggtgttcgggctgggcgcggagacgccgctgtggcgcgcgctcaaccacggcgggcgcacggtgttcctggacgagaacccgtactacgtggcccacctggagggcaagcacccggggctggaggcctacgacgtggcctacgccacggcggtgcgcgagctccccgaactcctcgacgcccgccgtgccgcgcgcgccgctgagtgccgcccccgtcagaaactgnnctctctcg

SEQ ID NO: 73289 - protein, 205 aa, Zea mays
  misc_feature: Ceres CLONE 1557577
  misc_feature (67)..(204): Pfam Name: DUF579 Pfam Description: Protein of unknown function (DUF579)
  misc_feature (203)..(203): Xaa is any aa, unknown, or other
MKAMAGPKLLVVHASSNKALNGMAPTSPASPGWSRCLWLVVFLALFTCVSLLTVLSTARASAGAPACQAASLTDSAAGATEAGLPRHVFDALVQYAAAAGNLSSSMPEPDVRAIASVLRRRAPCNLLVFGLGAETPLWRALNHGGRTVFLDENPYYVAHLEGKHPGLEAYDVAYATAVRELPELLDARRAARAAECRPRQKLXSL

SEQ ID NO: 73290 - DNA, 804 bp, Zea mays
  misc_feature: Ceres CLONE 1557579
  misc_feature: Encodes the peptide sequence at SEQ ID NO. 73291
ctggagctccccgcggtggcggccgctctagaactagtggatcccccgggctgcaggaattcgtctcacccctagaaaaaattcggcgactatggcggcggcaccggcaggcggcggccctcgggcattgtcccagcgggagcaggacatccagatgatgctcgccgccgatgtccacctcggcaccaagaactgcgacttccaggtggagcgctacgtgtacaagcgccgcactgatggtatctacattattaaccttggaaagacctgggacaagcttcagttggccgccagggtcatcgttgccattgagaatccgcaggacattatcgtgcagtctgctaggccctatggccagagggctgtcctcaagtttgcgcagtacactggtgcccatgccattgctggcaggcacactcctggtacattcaccaaccagttgcaaacctccttcagtgagccacgccttcttatcctgactgacccgaggactgatcatcagcccattaaggagtctgcccttggaaacattcccaccatcgccttctgtgatactgattcccctatgcgctatgttgatatcggcattcccgccaataacaaggggaaacagagcattggttgtctgttctggctgctcgcccgaatggtctccagatgcgcggtacattttctccaagacaccagtgggacatcatgggtagatcttttcttctacagaagacccaaaggagccaaaccacctggaggaaaaaaaaggctctggttgcacctgactatgggccggttggcaaaatccccggc

SEQ ID NO: 73291 - protein, 237 aa, Zea mays
  misc_feature: Ceres CLONE 1557579
  misc_feature (23)..(191): Pfam Name: Ribosomal_S2 Pfam Description: Ribosomal protein S2
MAAAPAGGGPRALSQREQDIQMMLAADVHLGTKNCDFQVERYVYKRRTDGIYIINLGKTWDKLQLAARVIVAIENPQDIIVQSARPYGQRAVLKFAQYTGAHAIAGRHTPGTFTNQLQTSFSEPRLLILTDPRTDHQPIKESALGNIPTIAFCDTDSPMRYVDIGIPANNKGKQSIGCLFWLLARMVSRCAVHFLQDTSGTSWVDLFFYRRPKGAKPPGGKKRLWLHLTMGRLAKSP

SEQ ID NO: 73292 - DNA, 804 bp, Zea mays
  misc_feature: Ceres CLONE 1557582
  misc_feature: Encodes the peptide sequence at SEQ ID NO. 73293
  misc_feature (797)..(797): n is a, c, t, g, unknown, or other
ctggagctccccgcggtggcggccgctctagaactagtggatcccccgggctgcaggaattcgtctcacccctagaaaaaaagcctgccgcctgcgagaaaagaaaccaaacagggccaagcatggctgcggcagccgtgcatggccgacgtcgtcgtctcctcctgctcctcgctgcgctcctacacctgctgctggtggtgccaccaccggtgcaggcagcgcgtgtgacggccctgatcgtgttcggtgactccacggtcgacgccggcaacaacaacgtcatcccgacggtggcgcggagcaacttcccgccgtacgggcggaacttcccgccggaggggcgcgcctcggggcggttcagcgacggccgcctggccaccgacttctactcggaggccctcggtctgggtcgcgcctttgtgccggcctaccttgatccgcactatggcatccgggatttcgcgatcggtgtctgcttcgcctctgccggttctggacttgatgttgccacctcacgtgttctgagagtgatcccgctatggaagcaactggacatgttccgggagtacatgtcccggctggacgaccacttgggcgccaccgaggcccacgcggtggtggccggcgccgtgtacgccgtgagcatcggcaccaacgacttcatcgagaactacttcgcgctgacgacaacgcggttcctcgagttcacgccgggcgagtacacggactacctagtgggcctcgcccggggcttcctggcggagctctacagcctgggtgcccgcaagatcggnttcacgg

SEQ ID NO: 73293 - protein, 227 aa, Zea mays
  misc_feature: Ceres CLONE 1557582
  misc_feature (39)..(224): Pfam Name: Lipase_GDSL Pfam Description: GDSL-like Lipase/Acylhydrolase
  misc_feature: SWISSPROT Homolog: EC 3.2.1.51 Alpha-L-fucosidase
MAAAAVHGRRRRLLLLLAALLHLLLVVPPPVQAARVTALIVFGDSTVDAGNNNVIPTVARSNFPPYGRNFPPEGRASGRFSDGRLATDFYSEALGLGRAFVPAYLDPHYGIRDFAIGVCFASAGSGLDVATSRVLRVIPLWKQLDMFREYMSRLDDHLGATEAHAVVAGAVYAVSIGTNDFIENYFALTTTRFLEFTPGEYTDYLVGLARGFLAELYSLGARKIGFT

SEQ ID NO: 73294 - DNA, 836 bp, Zea mays
  misc_feature: Ceres CLONE 1557583
  misc_feature: Encodes the peptide sequence at SEQ ID NO. 73295
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (704)..(704): n is a, c, t, g, unknown, or other
  misc_feature (705)..(705): n is a, c, t, g, unknown, or other
  misc_feature (753)..(753): n is a, c, t, g, unknown, or other
gagctccccgcggtggcggccgctctagaactagtggatcccccgggctgcaggaattcgtctcacccctagaaaaaagcacatgtgcatctcagcagcactagcagtgacaaactcgaagcttgccttcttgtttacaccctaaaactaaaactagagtcgtcggcggcaacaagcggtacgtacgtagaggatgaagagcaggagcagcactctgttggtgatcctagttctccaggcccttctgctctctgcggctgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtgtccacgggcaagggcgccaccaagtacaggtgccgcgacttcctccccgaaaactgcgggtgcaagatccactaaactcatccaattccaccatggccacagcagccgatggatccttcttccatatgcatgttctcctccgtccgtccgcctagctttgctacaagcaggcgctaataagcaagctgctgttgttgttttgcatgtttgattaggtgaccctttccactcgagatggaataaaataaacgtcaggcgcacgtactgacgtgttattacgatatttctcccctaaannnnnnnnannnnnnnnaannaaaagcgcccgtcgcctcccttttcccttccctccgtccctctcccgnggggcgccagaggcaatttcgccctcgattcgaccccaattcgtcccgccggcgacggggattccctccgccaagcgcgggat

SEQ ID NO: 73295 - protein, 89 aa, Zea mays
  misc_feature: Ceres CLONE 1557583
MKSRSSTLLVILVLQALLLSAAVAKGPAGPKKQCWCGECTSWSGVWTCDDLLTKCAATCKNCVPVSTGKGATKYRCRDFLPENCGCKIH

SEQ ID NO: 73296 - DNA, 854 bp, Zea mays
  misc_feature: Ceres CLONE 1557589
  misc_feature: Encodes the peptide sequence at SEQ ID NO. 73297
  misc_feature (709)..(709): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
ctccccgcggtggcggccgctctagaactagtggatcccccgggctgcaggaattcgtctcacccctagaaaaactctagtgcaatcgcggagctacctcagctgccgtgtcctgcacagccgccgcttccgacgcagcaaaggcgaacgcgaagcagcaagcaatcaagatcgatggggcggtcgccctgctgcgagaaggcgcacaccaacaggggcgcgtggaccaaggaggaggacgagcgcctggtggcctacatccgcgcgcacggcgaagggtgctggcggtcgctgcccaaggcggcgggcctgctgcggtgcggcaagagctgccggctgcggtggatcaactacctccggcccgacctgaagcgcggcaacttcaccgccgacgaggacgacctcatcgtcaagctgcacagcctcctcgggaacaagtggtcgctcatcgccgcgcggctcccggggcggacggacaacgagatcaagaactactggaacacgcacgtccggcggaagctgctgggcaggggcatcgaccccgtcacgcaccgccccatcgccgccgacgccgtgaccgtgaccaccgtctcgttccagcccagccccagcgccgccgccgcagcagcagcagaagccgaagcgacggcccgctaggcgcccagatgccccgacctcaacctcgacctctgcatcagcccgcgtgccnccnnnncaggagagaaggaggagttggaccctcagcccttcggccgccgtcgtcaagcgggaggtctgctgggcggccggcggcacggccacggcggggcgcttctgcttggctgcagcctgggcgttcagaagggcgcgcccgg

SEQ ID NO: 73297 - protein, 160 aa, Zea mays
  misc_feature: Ceres CLONE 1557589
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
MGRSPCCEKAHTNRGAWTKEEDERLVAYIRAHGEGCWRSLPKAAGLLRCGKSCRLRWINYLRPDLKRGNFTADEDDLIVKLHSLLGNKWSLIAARLPGRTDNEIKNYWNTHVRRKLLGRGIDPVTHRPIAADAVTVTTVSFQPSPSAAAAAAAEAEATAR

SEQ ID NO: 73298 - DNA, 996 bp, Zea mays
  misc_feature: Ceres CLONE 1557592
  misc_feature: Encodes the peptide sequence at SEQ ID NO. 73299
aatagccacacaccacaccaagtcaagcaaggagctcgatcgacagcaacagcggccttcaaaggagaccctcctcagccgctagtaccagtagtcgtcgcgttagcaggcagatctgagttagccggcggatccgatccgtgcgcgtgcagtgtacgtgtgtcggtggagatggccacagcttacgctcccatggcgagccaggtgatgaagagcagcctcgtcgtgcactcgaggccgaggggcctgtcaggcgctgctgcgctcacgaggcggccgcggttcaccgtcaaggccatccagcccgagaaggcaacgtaccaggtggtgcagcccatcaacggcgaccccttcatcggcagcctggagacgccggtcacctccagcccgctcgtcgcgtggtacctctccaacctcccggcctaccgcaccgccgtgagcccgctgctgcggggcgtcgaggtcggcctcgcgcacggctacctcctcgtggggcccttcgcgctcacgggcccgctccgcagcacgcccgtgcacggccaggccggcgcgctcggcgccgccggcctcgtcgccatcctcagcgtctgcctcaccatgtacggcgtcgcctccttcaacgagggggacccgtccacggcgccctcgctcacgctcaccggcaggaagaaggaggccgacaagctgcagacctccgacggctgggccaagttcaccgggggattcttcttcggcggcatctccggcgtgctctgggcctactttctcctctacgtgctcgacctcccctacttcttcaagtagatatcatcgaagatgcgtatacatagctccggccgatcctcctctctagctgcatggtatgtaggtggtgtggttcttgtttcatttcactccagcggtgatcagcaccgtgtataaatgtaattcctctgctctgcacatggatggattgggatgtaacctgttaaatttttttaaaaaaaaaaaaaaaaa

SEQ ID NO: 73299 - protein, 210 aa, Zea mays
  misc_feature: Ceres CLONE 1557592
  misc_feature (50)..(208): Pfam Name: PsaL Pfam Description: Photosystem I reaction centre subunit XI
MATAYAPMASQVMKSSLVVHSRPRGLSGAAALTRRPRFTVKAIQPEKATYQVVQPINGDPFIGSLETPVTSSPLVAWYLSNLPAYRTAVSPLLRGVEVGLAHGYLLVGPFALTGPLRSTPVHGQAGALGAAGLVAILSVCLTMYGVASFNEGDPSTAPSLTLTGRKKEADKLQTSDGWAKFTGGFFFGGISGVLWAYFLLYVLDLPYFFK

SEQ ID NO: 73300 - DNA, 845 bp, Zea mays
  misc_feature: Ceres CLONE 1557596
  misc_feature: Encodes the peptide sequence at SEQ ID NO. 73301
  misc_feature (630)..(630): n is a, c, t, g, unknown, or other
  misc_feature (764)..(764): n is a, c, t, g, unknown, or other
ctccccgcggtggcggccgctctagaactagtggatcccccgggctgcaggaattcgtctcacccctagaaaaagtccgcctctcatccctcccgttgcggccgaccatcaccaacggaagtcggcagagtgagccaaggccctgtgtgtgtgtgtgtctgccacattacctacccagatcgaaatggcgcggtgcccagctgctcatgccgctctctgctcccttgctctgctcctcctgcttccagctgcgcgggcggcgacgttcaccatgaccaacaactgcggctacacggtgtggccggggctgctgtcgggcgccggcacggcgccgctgcccacgacggggttcgcgctggcgcacggcgcgtcggcggcggtggacgcgcccgcgggctggtcgggccgcgtgtgggcgcgcacgctctgcgccgcggacgccgccaccggcaggttctcctgcgccacgggcgactgcggctcgggagccgtccagtgcaacggcggcggcgccgccccgcccgccacgctggcggagttcacgctcggcggatccggcggcctggacttcttcgacgtcagccttgtggacggctacaacgtcccgatgctcatcgtccccgcgcaggncgcgggcggtggtggcagcagcagcagcagcaacgggtccgcgggcggctcgagcaagtgcatggccaccggctgcctcgtggatctcaacgggcccgtgcccaacttgatctgagggtaaatggctgcgttcngcgttcggggtcccccgttccggcgcccggagggggcttttggctttgccccaaaccccctggcaaaaggggtttctgggg

SEQ ID NO: 73301 - protein, 186 aa, Zea mays
  misc_feature: Ceres CLONE 1557596
  misc_feature (32)..(181): Pfam Name: Thaumatin Pfam Description: Thaumatin family
  misc_feature (149)..(149): Xaa is any aa, unknown, or other
MARCPAAHAALCSLALLLLLPAARAATFTMTNNCGYTVWPGLLSGAGTAPLPTTGFALAHGASAAVDAPAGWSGRVWARTLCAADAATGRFSCATGDCGSGAVQCNGGGAAPPATLAEFTLGGSGGLDFFDVSLVDGYNVPMLIVPAQXAGGGGSSSSSNGSAGGSSKCMATGCLVDLNGPVPNLI

SEQ ID NO: 73302 - DNA, 1139 bp, Zea mays
  misc_feature: Ceres CLONE 1557597
  misc_feature: Translation starting site: 956
  misc_feature (23)..(23): n is a, c, t, g, unknown, or other
  misc_feature (57)..(57): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
tttttatttctgataaattaaantagtttttgtgtttggcggggttcggttgttttntttgtgcgattnnnnccaaactggaactcacgtcggtggcggccgctctagactagtggatcccccgggctgcaggaattcgtctcacccctagaaaaaaacatcaccagcgcacagctctcctcatcggcgcacccgagctcgccctctccatcctcatcgaggcccagaacctgctcagatggcgaccgacgtggctgagactcccgcgccgttggtggatgcggcccctgaagcgcccgcggacaccccggcggcgcctgctgttgacgcgaagccggccaaggccaagaaggccacagcgccgaagaagcgcgccagcccgacccatccgccgtacgccgagatggtctcggaggcgatcgcgtcgctcaaggagaggacagggtccaagcagctttgctattgccaagttcttggaggacaagcacaaggacaagctcccgcccaacttccgcaagcttctgaacgttcagctcaaaaagctcgtcgccagcggcaagcctgaccaaggcgaaagaaccacgtacaagactgtcgttcccgccaccaaagccaaagagccgccccccgaagtaaagaacaaagaacccgggcggtgggaaaaaaacccccaaggggcccgcctgcccaaaaacccgaaagagccgcaaaggaccccccccgcgcggaaaagcccccaagtcccccgggccccacaaaaagaacccccaaaaggggcgagggtcccggccggaaaagtcacaccaggctgttcccccaaaagcccgcaaaaaaaggctagcgccaaccccaaaaaaaaccacaaaggggggcaaccctaagcccaataggcccccccatagagggccaaaaggcccttggacttgggccccaaaggcgcgtaaaaaccacaccaatggggcttggcccgggggcggtccttaaataccctaaaaagaccccgggcctggtcacaataaaaaaggggcccggggccaggaccccccttgccataaggtggggagcccaaaaaaaaaaattcacgtgccaaaaggggccccaccccccacaggaataaataaatatggccgccccggaag

SEQ ID NO: 73303 - DNA, 907 bp, Zea mays
  misc_feature: Ceres CLONE 1557600
  misc_feature: Encodes the peptide sequence at SEQ ID NO. 73304
agctccccgcggtggcggccgctctagaactagtggatcccccgggctgcaggaattcgtctcacccctagaaaaaaccacccaccaacccaccatccccgatcgcccttggagatggagatggtcggcggcagcgccgacgccatccccggcctcttgtcatacggctgggccgggctctggtccacgctggcgagcctcctgttcctgtggtccatggtgcaggaccacctccctttccagctcgaggagcagctgtccgcactggcgcgccgcgccctcgccgccgtcaccccctacgtcaccatcaccatcgacgagcacgacgccgactccttcggccgcagcgaggcctacctcgccgcggaggcctacctgggcgccaccttcgccggccccgccagcaggctccgcgccgagctcccgggcggcagcgacccgcgtcagccttcgcccgtcgaccgaccaccgtccaaggtcacccgaacgcccttccgcggggccccgggatccgggtggcccaaaaaaccggacacctccccccccgggcaacgtgaatcccctggaaacccccccttgaagaaggaaaaccccccgccctaattggccttcactttttcaccggccgccacccgggggggtttttttaaaggcgccccttacctgggccaaaagttccctccccaagggggggcgcgcccacccaccgttccggaaaaacccccagggccccccctttttaaacaaaaaaaaatcccaaagggggaacaagggggggggcggggggaaaaaacaggggaccccccccccttggagacccccccataaaagtgtgggagccccaccccccccattttttacccacccctcccctccctttgaaacactccaaaacgagaaaagggtg

SEQ ID NO: 73304 - protein, 162 aa, Zea mays
  misc_feature: Ceres CLONE 1557600
MEMVGGSADAIPGLLSYGWAGLWSTLASLLFLWSMVQDHLPFQLEEQLSALARRALAAVTPYVTITIDEHDADSFGRSEAYLAAEAYLGATFAGPASRLRAELPGGSDPRQPSPVDRPPSKVTRTPFRGAPGSGWPKKPDTSPPGQRESPGNPPLKKENPPP

SEQ ID NO: 73305 - DNA, 873 bp, Zea mays
  misc_feature: Ceres CLONE 1557605
  misc_feature: Encodes the peptide sequence at SEQ ID NO. 73306
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (671)..(671): n is a, c, t, g, unknown, or other
  misc_feature (687)..(687): n is a, c, t, g, unknown, or other
acccgcggtggcggccgctctagaactagtggatcccccgggctgcaggaattcgtctcacccctagaaaaaatccaattcacaggctcaccacaccaaccagcaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgtcacctacaccgagcacgcgcgccgtaagaccgtcaccgccatggacgtcgtctacgcccttaagcgccagggccgcaccctctatggcttcggcggctaggtctgccgcggccgcgcctcgcctcgccgttggtgcggttctggtgttgctgcagttcgcaagttgtttgtgggggggtgaaaaaatgctagctactgtagaactgcagtgccgtacgcagcacatggtgtgtttgtctgaagaattgttgtcaatgctgggcttgctctggactcaaannnnnnnnnnnnnnnnnnnnnaaaaaacgccggccgnattaacaggccccggntccttttggttccaatcttggcctctttcattgcaagaattcagcggccatgggcggggggaaacgccccaaaaatccaaaaatggcccccgaaaaggaaacccccaaaaaaaacaaagggcggcaaagggcccccccttgggggggccaaaaaaaaaggcccttgaaaacttcccgtgcgaaaaa

SEQ ID NO: 73306 - protein, 103 aa, Zea mays; identical to SEQ ID NO: 6459
  misc_feature: Ceres CLONE 1557605
  misc_feature (25)..(94): Pfam Name: Histone Pfam Description: Core histone H2A/H2B/H3/H4

SEQ ID NO: 73307 - DNA, 827 bp, Zea mays
  misc_feature: Ceres CLONE 1557607
  misc_feature: Encodes the peptide sequence at SEQ ID NO. 73308
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (661)..(661): n is a, c, t, g, unknown, or other
  misc_feature (673)..(673): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (690)..(690): n is a, c, t, g, unknown, or other
  misc_feature (691)..(691): n is a, c, t, g, unknown, or other
ctggagctcaccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgtgcaattcaacggttatacatttcaaggaagacctctgagggtgaactgcgggccaccgccacctagagatggatccgcaccaagagcaccaagggggtgtggtttnnnggngtttttgttttntnnnnnnnnttttgttnntttgggggggaaaaaggggatacgtggggggaaaccttggaatgggggggggttgaacaaacccgaaccctgggaaggaaacctttttccagggtagcacaaggtaaagggtgcctgggaaatcctaaaaggtcat

SEQ ID NO: 73308 - protein, 214 aa, Zea mays
  misc_feature: Ceres CLONE 1557607
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (171)..(171): Xaa is any aa, unknown, or other
  misc_feature (172)..(172): Xaa is any aa, unknown, or other
  misc_feature (173)..(173): Xaa is any aa, unknown, or other
  misc_feature (177)..(177): Xaa is any aa, unknown, or other
  misc_feature (178)..(178): Xaa is any aa, unknown, or other
  misc_feature (179)..(179): Xaa is any aa, unknown, or other
  misc_feature (180)..(180): Xaa is any aa, unknown, or other
  misc_feature (183)..(183): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEEAGAAVVQFNGYTFQGRPLRVNCGPPPPRDGSAPRAPRGCGXXXFLFXXXXFVXLGGKKGIRGGKPWNGGGLNKPEPWEGNLFPG

SEQ ID NO: 73309 - DNA, 828 bp, Zea mays
  misc_feature: Ceres CLONE 1557611
  misc_feature: Encodes the peptide sequence at SEQ ID NO. 73310
  misc_feature (769)..(769): n is a, c, t, g, unknown, or other
  misc_feature (828)..(828): n is a, c, t, g, unknown, or other
ctccccgcggtggcggccgctctagaactagtggatcccccgggctgcaggaattcgtctcacccctagaaaaagtccaaaaaggaggcgccgcgctcctcttcttctacgccgttcactctctctagtctctcccttcccttctccacgcctccgcccccactcgtgagactctacctagccctagcgccagcaccacccgcccaacctcccggagagagagagagagaggaggaggccttcgccgccgccgttgccgtcggccgagacgccaggatgttcgggtaccagaagggcctcgatgtcgaggcggggacatcgggcgccgccgccacgggcggcgcgcgccagctctacccggggatgcaggagagccccgagctgcgctgggcgctcatccgcaagatctacgtcattctctccctccagctgctcctcaccgccgtcttcgccgcagtcgtcgtcaaggtccgcgccatcccgcacttcttcaccaccaccagcgccggcctcggcctctacatcttcctcatcatcctcccctttatcgtgctgtgcccgttgtacttctaccacgagaagcacccagtcaacctgatcctgctcggcctcttcaccgttgccatcagctttgctgtgggcatgacatgtgccttcaccagtggcaaggtcatttctggagtctgcaattctgacaacagtggtcgtgctcaggctttacgcatacactttctggggcgtgaatagggggcaaggacttcagcttccntggggtcttttcctggttcgccgccctccataatgcttgctggggttgcaactcatccn

SEQ ID NO: 73310 - protein, 156 aa, Zea mays
  misc_feature: Ceres CLONE 1557611
MFGYQKGLDVEAGTSGAAATGGARQLYPGMQESPELRWALIRKIYVILSLQLLLTAVFAAVVVKVRAIPHFFTTTSAGLGLYIFLIILPFIVLCPLYFYHEKHPVNLILLGLFTVAISFAVGMTCAFTSGKVISGVCNSDNSGRAQALRIHFLGRE

SEQ ID NO: 73311 - DNA, 887 bp, Zea mays
  misc_feature: Ceres CLONE 1557612
  misc_feature: Encodes the peptide sequence at SEQ ID NO. 73312
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnaaaaagctggagctccccgcggtggcggccgctctagaatagtggatcccccgggctgcaggaattcgtctcacccctagaaaaaattttttttctccgtctctcgttttcaccagtctctcttctcttctgtctgtcttcctccgtgcgtcccggcgcgaaccctagccgagattagattgaggcgagcgccatcaccggaggaagaggaagacacgatgctgcgggttgcgggaagaaggctctcgtcttccctctcctggcgccccgccgtggcggcggccaggggccccctcgccggcgctggcgcccccgatcgggacgaacggctcggctcgcggccgggagctcagacgcgggttctccccatcgactcccccccttcttttgttcgctgcccaggggggttttcttctttccgaactggaaaacacctttggtcccccagggaaaaaaccaaggaatggcttgggcccctaaaccctggaaaccttcccccaagcaaaaacttgggtgggccttggccttgttgaaaaaaaaaaaatcccttaaaaaccccccttaaaaggggggggggggttttttttttggaaatgggaaggttccccaaaagccccttttggaaaaaagaaaaaaatatccccccccccccccggggggggaaaaaattcccccccgcaaggccaaaaaaaaagggggggggggacaaattttttgggggccgcataaaaacacatttttttggggccccccccccccaaaaaaaaaaggggggggggggggggggagagaaaaatatttttctttttttttt

SEQ ID NO: 73312 - protein, 104 aa, Zea mays
  misc_feature: Ceres CLONE 1557612
  misc_feature: SWISSPROT Homolog: EC 1.10.2.2 Ubiquinol--cytochrome-c reductase
MLRVAGRRLSSSLSWRPAVAAARGPLAGAGAPDRDERLGSRPGAQTRVLPIDSPPSFVRCPGGFSSFRTGKHLWSPREKTKEWLGPLNPGNLPPSKNLGGPWPC

SEQ ID NO: 73313 - DNA, 817 bp, Zea mays
  misc_feature: Ceres CLONE 1557615
  misc_feature: Translation starting site: 278
  misc_feature: SWISSPROT Homolog: EC 1.1.1.1 Alcohol dehydrogenase
ctccccgcggtggcggccgctctagaactagtggatcccccgggctgcaggaattcgtctcacccctagaaaaaaccgggggaaagcccatctcttgctatgcggcggtggtgtgggggcccggcgagccgcttgtgatggaggaggtggaggtggccccgcccgggtccctgccatgtcccccttcatctgctcttcacttccttgtgcactctaatctcctcttcctcactgctgacgaactagctgaccaggcacttcctccacgtcctgggccatgacgaatgcctactggtgcttacctcccccgactgcctcggaggatctcctgcccggtgaccatgtcttccaccccttcggcctggagtacgacccgtacaacctctggtggtacgttcagacagacctggtcaacacctcccgggcgatcctgtccatagcacggatgcttatcccggaggtgctgaccttcgccgggctgatcaacgcgtcgcgctggtacgacgccggctagtcttactcttcgcgtcatcgttcacgctgttcctgatctagtacatcccgtttccctaccatggtaaacccggcagtggcaggacatcaagacccctgcctcatctaccaggtccccaccttatttaggtccgtctggcccccgccccaaatttgcctccccctgcaacgttttcaaacctcctccaatttcccccccccggtttagggctaaggaaaagggccccccccaacgggagggctgccccattcttggggtttctggcctttccccggtaaaaagctccccttcgccggggaaaag

SEQ ID NO: 73314 - DNA, 863 bp, Zea mays
  misc_feature: Ceres CLONE 1557616
  misc_feature: Encodes the peptide sequence at SEQ ID NO. 73315
  misc_feature (571)..(571): n is a, c, t, g, unknown, or other
ctccccgcggtggcggccgctctagaactagtggatcccccgggctgcaggaattcgtctcacccctagaaaaactcttcgcttctaactccgctgggccaccagctttgaccgccgcctcccttcccctccgctactgctcctccccaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctcttttggaggaggtggtggaagcagcangggaagaaggcaaggaggggagaagatgtagttcacccacttaagtttctctggaagatctttacaatgcaccctcaagaagctctctctttcgcgcaatgtcatctgctcaaagtgcaagggcaagggctcgaagtctggtgcctcaatgaagtgcccctgggtgccagggctcaggcatgaaagtcactattcgtcagctggggccctttcttggatcagcaaatggcgcaccctttgcaataattgcaggggacttgggaaaaccttcattgaaaaggcccctcttccc

SEQ ID NO: 73315 - protein, 120 aa, Zea mays
  misc_feature: Ceres CLONE 1557616
  misc_feature (13)..(71): Pfam Name: DnaJ Pfam Description: DnaJ domain
  misc_feature (111)..(111): Xaa is any aa, unknown, or other
MFGRAPKKSDNTKYYEILGVPKSASQDDLKKAYRKAAIKNHPDKGGDPEKFKELAQAYEVLSDPEKREIYDQYGEDALKEGMGGGGSHVDPFDIFSSFFGPSFGGGGGSSXGRRQGGEKM

SEQ ID NO: 73316 - DNA, 846 bp, Zea mays
  misc_feature: Ceres CLONE 1557618
  misc_feature: Encodes the peptide sequence at SEQ ID NO. 73317
  misc_feature (621)..(621): n is a, c, t, g, unknown, or other
  misc_feature (765)..(765): n is a, c, t, g, unknown, or other
ctccccgcggtggcggccgctctagaactagtggatcccccgggctgcaggaattcgtctcacccctagaaaaattgactcctagtcctaaaccagctcccacgccgccatgatgcagccgccgccgccacatcagcagcagcaatgggcaatggcgcccccgcccccgccgcagtactaccaggcggggcaccctccgccgccgcccccgcagttctaccaggcgggccctccgcctcccgctatgtggggccaaccgccaccgcaggcggcgccggcgccggcgccggccggcggcggggcgggggacgaggcgaggaccctctggatcggggacctgcagtactggatggatgagaactacctctatagctgcttctcccaggctggcgaggttatttccgtgaagataattcggaacaagcagactgggcaacctgagggttatggttttattgaattcagcaaccatgctgtagccgaacaagttctgcagaactataatggtcaaatgatgcccaatgttaatcaacctttcaaattgaattgggctaccagtggggctggtgagaaacgtggagacgatggttcagattatactatatttgttggggacttggnctcggatgttacagatttcattcttacagatacgttcaagagtccgtatccatcagttaaggttgcaaaagttgtctttgacagaactactgggcggtcgaaaggctatggtttttgtaaaagttgcaaaattcggaatgaacngacccggggcatgaactgaaatgaatggaacaaactgttctagcaagggcaatgcccctgggacagaatccaaaaagaaaa

SEQ ID NO: 73317 - protein, 179 aa, Zea mays
  misc_feature: Ceres CLONE 1557618
  misc_feature (27)..(98): Pfam Name: RRM_1 Pfam Description: RNA recognition motif. (a.k.a. RRM, RBD, or RNP domain)
  misc_feature (126)..(126): Xaa is any aa, unknown, or other
  misc_feature (174)..(174): Xaa is any aa, unknown, or other
MWGQPPPQAAPAPAPAGGGAGDEARTLWIGDLQYWMDENYLYSCFSQAGEVISVKIIRNKQTGQPEGYGFIEFSNHAVAEQVLQNYNGQMMPNVNQPFKLNWATSGAGEKRGDDGSDYTIFVGDLXSDVTDFILTDTFKSPYPSVKVAKVVFDRTTGRSKGYGFCKSCKIRNEXTRGMN

SEQ ID NO: 73318 - DNA, 824 bp, Zea mays
  misc_feature: Ceres CLONE 1557619
  misc_feature: Translation starting site: 149
  misc_feature: SWISSPROT Homolog: EC 5.2.1.8 Peptidylprolyl isomerase
  misc_feature (669)..(669): n is a, c, t, g, unknown, or other
  misc_feature (672)..(672): n is a, c, t, g, unknown, or other
  misc_feature (676)..(676): n is a, c, t, g, unknown, or other
  misc_feature (679)..(679): n is a, c, t, g, unknown, or other
caaagctggagctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccacctagagatggatccgcaccaagagcaccaagggtggtgggtgggtggcggcngcngcancanctttgtcgattcagggaacaaagtatacgtggggaaacttgcatggggcgttgacaactcgactctggagaaactattcagtgagcaaagacaagtgctggatgctaaggtcatctacgacagggatagcggcaggtcaagggga

SEQ ID NO: 73319 - DNA, 832 bp, Zea mays
  misc_feature: Ceres CLONE 1557620
  misc_feature: Translation starting site: 335
  misc_feature: Pfam Name: Glyco_hydro_42 Pfam Description: Beta-galactosidase
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaaggagccgagcagctactcctcccagtcccaggctcactgtcgctcctcccaagaacccgcccaaagaatcctagaaatccaagaaagggagcaaccaaaacaggaggaggtctgcaggaggaggagcaggaggaggtggtgctgaaggggaagatctcacaagtgtgtgaagaccacacagtctcgcgcactcgcaaacccagtgcgcgctgcggtcttcctcttcgcccaccttcttggagcggggaggttggccatgaggaggtggtggccggctgccctgctgggctgcgcagtggcggtgtccgttctggtggccgccgtggaatgcgctgtgacttacgacaagaaggcggtgctgattgatgggcagaggcggattctcttctccggatccatacactaccccaggagcacccctgatatgtgggaagggctgattcagaaagctaaagacggaggcttggatgtcattcagacctatgtcttttggaacggacatgagcctacgcctggaaattactatttcgaggagaggtacgatttagtcaggttcataaagacggtccagaaggctggcctgtttgtacatctccgcatcggtccctacatttgtggcgagtggaacttcggcggcttcccagttttggttgaagtatgtaccgggcatcagcttcaggacagacaacgaaccttttcagacggccatgcaggggttcactgagaaaattgtgggaatgatgaagagcgaaac

SEQ ID NO: 73320 - DNA, 862 bp, Zea mays
  misc_feature: Ceres CLONE 1557622
caaagctggagctccccgcggtggcggccgctctagaactagtggatcccccgggctgcaggaattcgtctcacccctagaaaaacttttgccttgcctgactgccttccttctcgtagaggatgactaaggacggccaccgttgtcgttgtctctgttcctccgcttcctgctctcttggcttgctgcttgccctcagagcaatgccttccgccaccgccacccccccctgttgtcagaaagacacgccagcgctagtaggagatgaccgtgacccaattcatcaaacgcgtatccctgcggcacctcccgctgggcaaaacctgaatgctcatgtcctaccccaccaacaagttcccctcgtattacatccacaccgtgttctacaacttcagcatctacatctacacgcacctgcacgatcccccacctgtctctctcgaacactgcatgacaaaacgactagcgcatgattgcgcgccactgtacctacaacgagcagcagacagccttcgtgctcggcctatctcctaatatcagcgtgcacaagctagtcacaacatccttctacatactgagtgccgagaccttctcatcattcatcgcacctacgtccaccgtcgcctcttgtgctcgaacatccttagatctgcgtgtaccactggagcctacacttgctgaccatccttccaatgtcgataatcacaactgcacatggagaagaactgaggagcgacatcggtcctgcaccttacatctagtgcatgtacgagacgcacataatgtacagtccgtcttctaccagccatcaaagtggtcctccatccacgccgacgaagcagcaacccctgcacgaataaaa

SEQ ID NO: 73321 - DNA, 763 bp, Zea mays
  misc_feature: Ceres CLONE 1557624
  misc_feature (276)..(276): n is a, c, t, g, unknown, or other
  misc_feature (396)..(396): n is a, c, t, g, unknown, or other
  misc_feature (408)..(408): n is a, c, t, g, unknown, or other
  misc_feature (461)..(461): n is a, c, t, g, unknown, or other
  misc_feature (466)..(466): n is a, c, t, g, unknown, or other
  misc_feature (479)..(479): n is a, c, t, g, unknown, or other
  misc_feature (483)..(483): n is a, c, t, g, unknown, or other
  misc_feature (484)..(484): n is a, c, t, g, unknown, or other
  misc_feature (491)..(491): n is a, c, t, g, unknown, or other
ctggagctccccgcggtggcggccgctctagaactagtggatcccccgggctgcaggaattcgtctcacccctagaaaaactcctcctcctcctcctcctccatgtccacggccatcgtggcgagggcaaccaagctgagcgctactcgcagtcgcagttgttgcctgcccagcatgcagctctaactcaccccgtgcagcagacgccgagtcgtggcaggtagctaggaaggagagccggagggaagggcaggccatggcgctggaagcggtggntgttcccgaaggacacctagcgggcactgccaggcgcgctcggcgtcgtcactggcctgcggcttcgcaccgaggaggtcgagacaacggcggtgtggttctgcaaggagaggccggcgncgccaccacgtnggagtactggggacgcgcgctctgcccgtgctccactgcacctgctggtgccntgaangagtgctgggacntgcnngcacggntctccgcgtccccaacggcggcggggcccttcggccgcgttccagcgccatcgtccgggcacggaaaggaactgccgcggcccggcgaaaaggggggaaaccccaaagggcgggaaaaacccgaaggaggtggaaacccagggggcaaccacattgccggggaaggcaaaccgggggggggaaaaaaaaaaaaaacctttccggggcccccctccccccttggccgcccccccaaccccgagaggggggattttttttttcccccaccaaat

SEQ ID NO: 73322 - DNA, 841 bp, Zea mays
  misc_feature: Ceres CLONE 1557627
  misc_feature: Encodes the peptide sequence at SEQ ID NO. 73323
ggagctccccgcggtggcggccgctctagaactagtggatcccccgggctgcaggaattcgtctcacccctagaaaaacctcactcttcagtcttcacttcagcacgggctctcttccctccgcttcctcccgtctcctctcctctctcgcacaatgccattgcgcggtgcgtgagagggagacagccacacagacgaggaggaagagggggtagacagccagccaaaggcgaaagcgagaagaagaaaaaaaggacattgcgcccgtgcaaggcgtgcgggcaggccggcgatgctgcggaggactgtgcccgaccgggccgcggactcgtccggctccgccgggggcggggacgcccggccccgcgccgacggctccggagccgcgctcttcgccgtgccgcgcctcttcgtcggattcgccgccaagcgcgcgccggacgcggagtcgtcgaggagcccgacgtcgccgctagaccccaaggcgctgttgctccggtcgccgaggagggcctggggcgcgccggggctcgtcgacgccctcgccgccgacaccgccgccgccaactgcctgctcagcccgcgcctgcggctcgtcaggcagcacagctccccgcccaaggaatgcggcggcggcggaggagggcactcgcagccggagctcggcaagacgatgtcctgccccgcgccggacaccgcggccgccgccaccgccatgtcggtgccgtgcagcaggttccagttccgccgcggggatctgaagtctggtcctgaggaggccactaggtcggacaccggcgcgtacctcgtcagcaacggcaatgcaaagcgcaactcgttc

SEQ ID NO: 73323 - protein, 183 aa, Zea mays
  misc_feature: Ceres CLONE 1557627
MLRRTVPDRAADSSGSAGGGDARPRADGSGAALFAVPRLFVGFAAKRAPDAESSRSPTSPLDPKALLLRSPRRAWGAPGLVDALAADTAAANCLLSPRLRLVRQHSSPPKECGGGGGGHSQPELGKTMSCPAPDTAAAATAMSVPCSRFQFRRGDLKSGPEEATRSDTGAYLVSNGNAKRNSF

SEQ ID NO: 73324 - DNA, 797 bp, Zea mays
  misc_feature: Ceres CLONE 1557629
  misc_feature: Encodes the peptide sequence at SEQ ID NO. 73325
ctccccgcggtggcggccgctctagaactagtggatcccccgggctgcaggaattcgtctcacccctagaaaaaaaaaaatggagaaaaaccatcccactccaatcttcgaagggtcgaactaagcccgtcagagaatcagagctctgaggctgctcacatcaggccaccaccaacccctcacgtcggcggtggcgtcttcggcgaaggcagagatggcgtccgtggccgcggcggaagtcgcggcggcggcgctccggtcggtgctgtcgcgcgcgcatcaagcagcggcacgggcggggcgcgcgccagggtccgtgcgcgtggtggcggtgagcaagaccaagccggtgcctgtcatccggggcgtctacgacgcgagccaccgctgcttcagggagaactacgtccaggagctcatcgacaaagcgcctcagcttcctgaggatattgagtggcacttcattgggaatctgcaaagcaacaaagccagagccctacttgctggcgtgccaaaccttgatatggttgacagtgtcaatgatgagaagattgctaaccgtcttgatcgagtggtagctgacttggggagaaaacctcttaaggttttggtccaagtcaacactagtggagaagaatcgaaatttggagtagatccctcacgatgcatggaactagcaaagcatgtcaaactgaactgcccgaaccttgtgttctctggtctgatgacaattgggatgcttgattactcctcaacccctgagtatttcaaggcgctggctaactgacgaggaagag

SEQ ID NO: 73325 - protein, 190 aa, Zea mays
  misc_feature: Ceres CLONE 1557629
  misc_feature (4)..(183): Pfam Name: Ala_racemase_N Pfam Description: Alanine racemase, N-terminal domain
MASVAAAEVAAAALRSVLSRAHQAAARAGRAPGSVRVVAVSKTKPVPVIRGVYDASHRCFRENYVQELIDKAPQLPEDIEWHFIGNLQSNKARALLAGVPNLDMVDSVNDEKIANRLDRVVADLGRKPLKVLVQVNTSGEESKFGVDPSRCMELAKHVKLNCPNLVFSGLMTIGMLDYSSTPEYFKALAN

SEQ ID NO: 73326 - DNA, 803 bp, Zea mays
  misc_feature: Ceres CLONE 1557630
  misc_feature: Encodes the peptide sequence at SEQ ID NO. 73327
  misc_feature (760)..(760): n is a, c, t, g, unknown, or other
ctggagctcaccgcggtggcggccgctctagaactagtggatcccccgggctgcaggaattcgtctcacccctagaaaaagaagcagccaccactctctccactgtgactccgtgacctgcctgccctgctgcacaagcacagcacacacaccccgcacaccgcaccagctcagctcagctcaccaagacaatcaatcatggctcgtccgcgcagtgtcgctgccgctgcccccctcctcctgctgctcgccgccgccgcagcggggctcgtgtccgccgcgtcgccggcagccagcgacttcgtccgcaagtcgtgccgcacgacgcagtacccttcggtgtgcgagcagaacctggcgtcgtacggagggtcgccgccgccacggagaccgcgggagctggcgcgcgccgcgctgtcggtgagcgcggaccgcgcgcgcgccgacgtcggcgtacgtgggccgcctgtgcggcgccagcaacggcaaaggcgcgaacaaggggtcgggatccgcgtcggcgtcggcaggtaccgagcgcgactgcctggacaatctggcggacagcgtgggccacctccgcgacgcggcgcaggagatgggcggcgcctggatgggccacgcggggacgccagcgttcacgtggaacctcatcaacgtgcagacctggtgcagcgccgcgatcagcgacgaggacacctgcctcgacagtctctcgtgccgcgtcgtctaactcagcacgcgcgccgccatccggggnaagatgctcgaagtcgcaacagtcaccagcaacgcggctgcga

SEQ ID NO: 73327 - protein, 44 aa, Zea mays
  misc_feature: Ceres CLONE 1557630
MGGAWMGHAGTPAFTWNLINVQTWCSAAISDEDTCLDSLSCRVV

SEQ ID NO: 73328 - DNA, 834 bp, Zea mays
  misc_feature: Ceres CLONE 1557634
  misc_feature: Encodes the peptide sequence at SEQ ID NO. 73329
  misc_feature (644)..(644): n is a, c, t, g, unknown, or other
  misc_feature (645)..(645): n is a, c, t, g, unknown, or other
ctccccgcggtggcggccgctctagaactagtggatcccccgggctgcaggaattcgtctcacccctagaaaaatcctcccccgtgcctcacggtcgacagctacctggacgagccaccatacaaagcgccagtacaccattacctatgcattgctagcaactagctcgagtccgcatcccaccgatacccactgccagtgccacaccacgagtacgccatgacgccgtcgacagcagcggtcgcgacacggcgagggcgcgagcgccggcggcgccgtgtgctgcatgtgcggcgaccgcggcctgccgggcgagctgatccggagcacgtgctgccgctcccggctacagcacaggtactgcagcgacctgtacccgagggcggacgcgtaccggcggtgcaactggtgcctgcgggagccggggccgggggtcggccaagcgggcctgggacatgcccatgccgcggcggtatttgcggctaacaacaagcagcccgaggatgataaacggatgaccactgcggcagcgacagacgaggagctgcggcagcatcacgaccacgatgggagctcctctagaaagtgtcgctgcagcagccgcctgacgagctcgggacaccggtgaaagacaagcacagggnnctagtagaagacgctgccgccatcggcgagcggaggcggctaacaacaggccccgaggatggtaaaaccgaagatcactgacgggtgcgtctagaccaggaaatcgtcaccggcaaaccccacgaagggtgcttccccccaaccccgggaaagaaaacgtcccccccccccccttcgggaagcttttag

SEQ ID NO: 73329 - protein, 113 aa, Zea mays
  misc_feature: Ceres CLONE 1557634
MCGDRGLPGELIRSTCCRSRLQHRYCSDLYPRADAYRRCNWCLREPGPGVGQAGLGHAHAAAVFAANNKQPEDDKRMTTAAATDEELRQHHDHDGSSSRKCRCSSRLTSSGHR

SEQ ID NO: 73330 - DNA, 763 bp, Zea mays
  misc_feature: Ceres CLONE 1557636
  misc_feature: Encodes the peptide sequence at SEQ ID NO. 73331
ggagctccccgcggtggcggccgctctagaactagtggatcccccgggctgcaggaattcgtctcacccctagaaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcattggcaaggaggatgcagccaacaacttcgctcgtggtcactacaccattggcaaggagatttgttgactgtgccttgaccgcatcaggaagcttgcagataattgcactggtctccagggcttcctcgtcttcaacgctgtttgtgggaggaaacggctctgggcttggtttctctcctcctggagccgctggtctgttgactatggcaagaagtcccagctcgggtttccacgtgtacccatccccccccagtggtcaaaatcccggggtttgaaccc

SEQ ID NO: 73331 - protein, 115 aa, Zea mays
  misc_feature: Ceres CLONE 1557636
MRECISIHIGQAGIQVGNACWELYCLEHGIQADGQMPGDKTIGGGDDAFNTFFSETGAGKHVPRAVFVDLEPTVIDEVRTGTYRQLFHPEQLIIGKEDAANNFARGHYTIGKEIC

SEQ ID NO: 73332 - DNA, 891 bp, Zea mays
  misc_feature: Ceres CLONE 1557637
  misc_feature: Encodes the peptide sequence at SEQ ID NO. 73333
  misc_feature (504)..(504): n is a, c, t, g, unknown, or other
  misc_feature (506)..(506): n is a, c, t, g, unknown, or other
  misc_feature (510)..(510): n is a, c, t, g, unknown, or other
  misc_feature (512)..(512): n is a, c, t, g, unknown, or other
  misc_feature (516)..(516): n is a, c, t, g, unknown, or other
agctccccgcggtggcggccgctctagaactagtggatcccccgggctgcaggaattcgtctcacccctagaaaaaatttctcctctcctctcccctcgctagttcgtcgcgtcctcctcagatcaacaaaccgtgtcctgctgctgcctctggaaaccaccgggggatcgccccgcccttttcttcccgcaccccagatcctccgtcccaaaacggcagcttccggaggtctcccgtctccctgctccttccggcgcgacgggtggcccggctcgcggatccggcggtcttcggtcgacggcgaggcggcgctcgtcttggatcgggagtggttgctgaggcgcggagatggtggccgaggcggaagtcatgcatcagtcccccgttccggcgctggaggtgcagtaccaccggcgcgcgacgaccaagggggttgacgacgtcgtcgggatgtccgcgcccgcccccgcggaggttggggttggggtttggggttgaggtcnangtcnangtcnaggtctccgtggaggtgcctcgcagggggtttggagcatcctgtagtctcaccagtttatctacggacgtgatacagcagtttgcgcccacactccgtttctggtagcatctccgaatttggaccacataagaaaatagaagacgatctcctcctaatagagtgactttctcgaaccgctacgcttctatgtttggtcctcccttctgcctaaaacctttttatagggtactatgatgggcctgaggctgatctggaatactgcacacctatattgaatagtgcgtgggctttatggctcccatttgttgcggaaaaaactgaactccgccccttggagttttctcagtagcgataaaggggatcctcacctgaa

SEQ ID NO: 73333 - protein, 49 aa, Zea mays
  misc_feature: Ceres CLONE 1557637
MVAEAEVMHQSPVPALEVQYHRRATTKGVDDVVGMSAPAPAEVGVGVWG

SEQ ID NO: 73334 - DNA, 874 bp, Zea mays
  misc_feature: Ceres CLONE 1557641
  misc_feature: Encodes the peptide sequence at SEQ ID NO. 73335
tccccgcggtggcggccgctctagaactagtggatcccccgggctgcaggaattcgtctcacccctagaaaaaaagttcaggcagtttcgtgcccttttcttctccaccagctcaaagctgaacgcggcatccttcctttcctcccctcttctgcccccatttcgttcctttcacaccggggaccggcgagcagagccgcgcacagcagaacgcggaagcaagaggaggcgatcgactactcgaccagccctctccgtgtctccgatggcggctcgcgtcctcgcggccctcgcccttgccctcgccctcgccctcgtcgccgtacccgctcccacgcgggcgtccaacgacgagggggacgcgctctacgcgctgcggcagcggctgtcggaccccaacggcgtgctgcagagctgggatcccacgctcgtcaccccctgcacctggttccacatctcctgcgaccaggtcggccgcgtcgtccgcctggacttgggcaactccaacgtctccggctccatcggccctgagctcggccgccttgtcaacctcaagtacctggagctgtacaggaacaaccttgacggcgagatccccaaggaattgggcaacctcaagaacctgatcagcttggatctgtatgccaacaagctcacgggaggaaatcccaagtcactctccaagctcgactcactcagattcttgcgcttggaacacaacaggcttacgggatcaattcaagggagtttgccaagctctccaacctgaaagtcttcgatttggcaaacaagaatcccgggggaacaaatcctggtggaggggccatttcccaacctttcctctcccaggtttgaaaacaacggcagggttcaa

SEQ ID NO: 73335 - protein, 167 aa, Zea mays
  misc_feature: Ceres CLONE 1557641
  misc_feature (27)..(67): Pfam Name: LRRNT_2 Pfam Description: Leucine rich repeat N-terminal domain
  misc_feature: SWISSPROT Homolog: EC 2.7.11.1 Non-specific serine/threonine protein kinase
MAARVLAALALALALALVAVPAPTRASNDEGDALYALRQRLSDPNGVLQSWDPTLVTPCTWFHISCDQVGRVVRLDLGNSNVSGSIGPELGRLVNLKYLELYRNNLDGEIPKELGNLKNLISLDLYANKLTGGNPKSLSKLDSLRFLRLEHNRLTGSIQGSLPSSPT

SEQ ID NO: 73336 - DNA, 739 bp, Zea mays
  misc_feature: Ceres CLONE 1557646
  misc_feature (607)..(607): n is a, c, t, g, unknown, or other
tggagctccccgcgtggcggccgctctagaactagtggatcccccgggctgcagaattcgtctcacccctagaaaaactgaccttatcccttgcggaaaacttgcgcgcaaaatggccgcctccctcccgaacacgccgcgcgcctcgggggcccccggcccttcgctaaccggtcgccccagggttcccttcggcaaccgcctttccgggtggccgccccccttttcctgaaaattcccctttccgggggggggcccccctggccccccggcccccggggcccaaaaaggcccggggggggggcccccggggcccgggggggccaaaaaaaaaacgggaaaaaaaaaaaaaatttttttccccccccggggggggggggaaaaaaaaaaaaaaaaccaggggggggggaaaaaaattccccccggggggggggggttttcccccccccaaaaaagaaaaaacccccccgggtcccccccccccccccgcgcgggggggaaccaaaaaaaaaaaaagggtttttggaaaatccctttttttctttttaaaaaaaaaaaaaaaagctttttcccccccccaccccgcttctttttttttttggtgggnggtggttttttttggggggggggggaaccccccccccccccccaaaaaaaaaaaaaagaaagaatgttgtgggtcccctctttctttttttgttggggtgagagagcaacacaaccccccctctctttgtgg

SEQ ID NO: 73337 - DNA, 867 bp, Zea mays
  misc_feature: Ceres CLONE 1557648
  misc_feature: Encodes the peptide sequence at SEQ ID NO. 73338
  misc_feature (664)..(664): n is a, c, t, g, unknown, or other
  misc_feature (666)..(666): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (677)..(677): n is a, c, t, g, unknown, or other
ctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctccccttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccacctagagatggatccgcaccaagagcaccaaggggtggtggtggttgggggggtggttncntnnnntttttntttattttggggaaataggtatatgttggggagactttgattgggggggtgtgaaaactggattgttgggaagagtttttttgggggagaaggagaatgtgttagagtgtgtgagggtaaaatatggagagaggggatgtgggaagataaaaggggatttgagtgatagatgacgtgagggggggtgatg

SEQ ID NO: 73338 - protein, 185 aa, Zea mays
  misc_feature: Ceres CLONE 1557648
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (176)..(176): Xaa is any aa, unknown, or other
  misc_feature (177)..(177): Xaa is any aa, unknown, or other
  misc_feature (178)..(178): Xaa is any aa, unknown, or other
  misc_feature (180)..(180): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEEAGAAVEQFNGYTFQGRPLRVNCGPPPPRDGSAPRAPRGGGGWGGGXXXFXFILGK

SEQ ID NO: 73339 - DNA, 796 bp, Zea mays
  misc_feature: Ceres CLONE 1557650
  misc_feature: Encodes the peptide sequence at SEQ ID NO. 73340
ctggagctccccgcggtggcggccgctctagaactagtggatcccccgggctgcaggaattcgtctcacccctagaaaaaatcatttagaggaaggagaagtcgtaacaaggtttccgtaggtgaacctgcggaaggatcattgaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctatagctcctgcgtgagctagtagctagctagtgccatgcgtcgtc

SEQ ID NO: 73340 - protein, 170 aa, Zea mays
  misc_feature: Ceres CLONE 1557650
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSTASLPIARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 73341 - DNA, 846 bp, Zea mays
  misc_feature: Ceres CLONE 1557651
  misc_feature: Encodes the peptide sequence at SEQ ID NO. 73342
ctccccgcggtggcggccgctctagaactagtggatcccccgggctgcaggaattcgtctcacccctagaaaaaactgccaaactctcgtctgcagtctccacccacacacacgcgtaaccttctacaccaccttgcgcaaggatcagctctcagctccaattgacatggaaggagacacaggctgccgatctgagaaagaggtcgctgtggtcacaggaggcaacaggggaattgggctagagatatgcaggcaactggcttccagtggagtcaccgtagtgttgacagcaagggacgcggagaggggcgcggaggcagccagcacgcttgggctacccaacgtcgtcttccatcagctggatgtcggcgatccgtcgagcgctgcacgcttagctggttttatcgaggagaagtttggcaagctggatatattggtcaacaatgcagcaattactggaacgacaagtaacgtcgtcgatccagaagcttttcgtcaagaggttggttaaccagtaactactactcggaatgcagtggtttcgcttgaagggagcaatatcattttattattagaaaaaaaatgtctagtagtctagcagtaaaagagatacatgtatatttttctcgtgtggaaacagctcgcgggcttggatgtcatgcagatgatcgaaagcatcaacaagcacaacacagaaccgtacgagcaagcacagaagtgcttgcggacgaactaccacgggatcaaggctgtcacaaaagcgctgctccctctttctgcatcctcgtcccatggacgggatgttaacctgtcatcctcctatgggatactcaggtttttcagcgc

SEQ ID NO: 73342 - protein, 114 aa, Zea mays
  misc_feature: Ceres CLONE 1557651
  misc_feature (12)..(114): Pfam Name: adh_short Pfam Description: short chain dehydrogenase
  misc_feature: SWISSPROT Homolog: EC 1.1.1.184 Carbonyl reductase (NADPH)
MEGDTGCRSEKEVAVVTGGNRGIGLEICRQLASSGVTVVLTARDAERGAEAASTLGLPNVVFHQLDVGDPSSAARLAGFIEEKFGKLDILVNNAAITGTTSNVVDPEAFRQEVG

SEQ ID NO: 73343 - DNA, 1453 bp, Zea mays
  misc_feature: Ceres CLONE 1557654
  misc_feature: Encodes the peptide sequence at SEQ ID NO. 73344
acgtcgcgtcgcgcacgccgtactgcccgcccgcccgacccttttcacacccccgacgcaaccgcatcgccgtcgccgtcctgcccgcctccggcctccctccctctatatccttccctcccccaccaccccctctctctcctcatcagctcacccacagcctgatcagcctcccagtcccagcccagatgttcctcgccgacaagtacaggtcgctgctgccctcctcccaccagcagccccactccaagcccagccgccgccgccagcagcagcagcagctgctgcagcaggagggggaggcggaccggttcggcgcggcgctggcggcgcgcctcgggagcctgcttcctctgccggcctccccgctcgcggcgctcgcgcgggtggccgacctcctcgcgctcacgctcgccgacgcgggccccgcgctcgccgccgccgacccggccgtcgccgcccacctcgacgcgggcgtcgcgctcctcgacgcctgcaacgccatctccgcgggcctcgaccgcctccgcaggcgcctcctcctcgcgcgcctcgcgctccacctcgtcctctccccctccccctccggggggcgagcacgcgcgcgcgcggcgctcgcggaccgcggcgaccacccggcgccgtccccgctcccttcgctcccgttcgagcagccccgcgggcggctctcggccgccgcgcgcgtcctcgccgccgtggacgccatctcctcgctcgcggcagcggccgcggccgccgtcctcgtcggaggacccgtcactttcccccgcgtgtccggcggcgacctcccgtgggcggagccgttcaacgcggtgtccggccagctcgcggcgctcggcgccggcgaggtggcatcgttagacgaggccgtccggaggctcgcgtcggcgctggacgcctccggcgagggtgctgccgacggcgagacggccgtgcgcgctgcggcgcaggaggcggagaggcgcgccgaggaggtcgcgccgctgctggaccacctgtctgacgccgtcggcggcgtgttccgcgccgcgctgggcctccgcaacgccgaggtggactccttcatggtgggacccgcggggaaagccgtctagcacataaccgtcgcttcgtgtggactcgtagctgtgtgtatagtgtatacagtagtgtactgggataggggtactgctacagctcagtggagagttgagtcgtgcagtggatcagtggaaatcatgtatgttagtgtcaacgacgaggatgaggccacagatcatacatacactagttgcatcatcttgggtacgtggcatcctgtgctgtacgggaaggggagaacgttgctatctggccgtgtagtttcgcggcacataacaacaacagtatgtgtgtataatttgggaaaagtgagttgcacttcccttttcctctccaaaaaaaaaaaaaaaaa

SEQ ID NO: 73344 - protein, 308 aa, Zea mays
  misc_feature: Ceres CLONE 1557654
MFLADKYRSLLPSSHQQPHSKPSRRRQQQQQLLQQEGEADRFGAALAARLGSLLPLPASPLAALARVADLLALTLADAGPALAAADPAVAAHLDAGVALLDACNAISAGLDRLRRRLLLARLALHLVLSPSPSGGRARARAALADRGDHPAPSPLPSLPFEQPRGRLSAAARVLAAVDAISSLAAAAAAAVLVGGPVTFPRVSGGDLPWAEPFNAVSGQLAALGAGEVASLDEAVRRLASALDASGEGAADGETAVRAAAQEAERRAEEVAPLLDHLSDAVGGVFRAALGLRNAEVDSFMVGPAGKAV

SEQ ID NO: 73345 - DNA, 1190 bp, Zea mays
  misc_feature: Ceres CLONE 1557655
  misc_feature: Translation starting site: 246
  misc_feature: SWISSPROT Homolog: EC 6.3.1.2 Glutamate--ammonia ligase
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (71)..(71): n is a, c, t, g, unknown, or other
cacgaggatgtgtctaacatatcacccagtagataaaacaaccaccccaacttgcccnnncccccannnanccaaaatggagctcaccgcggtggcggccgctctagaactagtggatcccccgggctgcaggaattcgtctcacccctagaaaaactcaatcccacgccacatcctcccctccttcctccttgggttcccagcccgtgcgcccgcctgtcgcaatcgcaccgcagccgccggccatggcctgcctcaccgacctcgtcaacctcaacctctcggacaccacagagaagatcatcgccgagtacatatggatcggtggatctggcatggatctcaagagcaaagccaggaccctcccgggcccggtgaccgatcccagacaagctgcccaagtggaactacgacggctccagcaccggccagccccccggccaagacagtgaggtaatcctgtacccgcaggtcatcgttccaccacccacccaggagggggaaacaacgtccccggcaatgtggcgattgagtacacccccagcctggcgaacccaattcccccccaacaagaaggtaccgccgccccgccctaagaaccttcaacaagccctttaaagaccccctggcccaagggaaccccctgaataatggggattcgcaagccagggaagtaccactccctccctttccaagaaaagggacaaccctaaccttggtccccccctccgggagtgggggcacctaatatttggtcgcgcccctttccaccatgtggaaccacatcaaaagggtggcacctcatacacataacccgagtcgcggaaaattcccgcacgccccggcgagaaaaaaaactctatttctcggcggacggctagaacacaaatgaatgcgcgaggatccacctaccttaacaagagagtcatcggtcactctaagtatacgccccggggcccattcccaaacgtctactcaaggagggactaataactccacagaggcgaacgaggtctaactgtcaccaagagcataataaattggagagaagaattcctctcagtgagttcgaggaaatccacggccccgcgtagcgggctctatactctcctctgatcagtgacggcatcataccacggaatgaaggggtatatatcacatccacgatctatacctacaccctgtcagga

SEQ ID NO: 73346 - DNA, 860 bp, Zea mays
  misc_feature: Ceres CLONE 1557656
  misc_feature (506)..(506): n is a, c, t, g, unknown, or other
  misc_feature (524)..(524): n is a, c, t, g, unknown, or other
tggagctccccgcggtggcggccgctctagaactagtggatcccccgggctgcaggaattcgtctcacccctagaaaaaagtatccccgttaccatgcaaactctgagtcatccctgcggatccgatccgtgcacatggaatgcacatgggtcagcagcagatgtggacctctcatcctccgatgtcgagcgaaatgacgaaaaccagcctcctcctgcctccatgccgaagggcctcgtgacgactgctagactcacggagaagccaaggctcaccgtgaggccatcaacccctagaacggaacctaccacgtggtgcacctgatcccactgtaccgcttaatcacccagcctgcagacgcgcgacttctccggcccactcggctggtgatacctctggaatgtccgcggataccgagacgttgtcaacacactgcagctggacgtcgatgactgcctctggcacatgctgctcgtcctgggctgcttcttcctcaaggtgctgntccgcaacagcctcaagntacggccaggccggtgtgctcaaggcccgctgcccatatcttcatccatgagcgtctgcactaccatgtagggcctcagcctcatcaacgaagggaaatccttcactatctgcgtctgtcaaggtcctgctcttgaacgaccgaggaggaattacctgtttacctgcgaaccgtttgggcaatgtcacggagggaattttcctcggggggaaatttcagaccggttgggggcccacataaacccctaaggcctcccccaaccccaagttccgaaattaaataaccggccaaaccgctttttttcccccggggggaatccctcctcaagaaaaagaa

SEQ ID NO: 73347 - DNA, 881 bp, Zea mays
  misc_feature: Ceres CLONE 1557658
  misc_feature (292)..(292): n is a, c, t, g, unknown, or other
  misc_feature (293)..(293): n is a, c, t, g, unknown, or other
  misc_feature (297)..(297): n is a, c, t, g, unknown, or other
  misc_feature (299)..(299): n is a, c, t, g, unknown, or other
  misc_feature (301)..(301): n is a, c, t, g, unknown, or other
  misc_feature (311)..(311): n is a, c, t, g, unknown, or other
  misc_feature (329)..(329): n is a, c, t, g, unknown, or other
tggagctccccgcggtggcggccgctctagaactagtggatcccccgggctgcaggaattcgtctcacccctagaaaaaccccaccccgctcgggctctccagtccacctccaccgctttcacacgctccgctccgctccgtttccgtcgctcccgtcccaaggagccgcgccacgcgagaggggggcacggtcgcacggacggtagcagttttctgtttcggtgggcggggacgtcgtcgacgaccgaccggagcggaaggacggagatagggtaggaagggggccccccnntctncnanaactcctgcncctgcccgatagttctcntggtatgctcatctactggatggacagatgaaaaacacccccccctatcccccattattgggaggaaaaatccccgcaccaacttacattgaaaaaaggttgcatttttttaagggactggttttaattgcccccccccgaaatattggtggccaattaaaaatcctctaaaccaaattgtttagttacaattaccccccgccccaaggggaggggccactaacttaaaggggagggggggagcaaaaaaaaccccccgtccttggagacagggcccagggggtgggcacccccccccctctccgtgtgtggggggaaaacccccccagaaaaaaaaaaaaattctccccccccccccaaaaataaaaaagattacccccctacaagcggccgtgaaaaaaaaaaccctctctccccgtctataggggaagggatagcccgtgacaaaaaatattcttcccccggggtgttttttttggtaaggaaaaaaaaaaatatatttctctctcttccaaaaaaaaaaaaaaaaggagggggggggagagtaaaatt

SEQ ID NO: 73348 - DNA, 743 bp, Zea mays
  misc_feature: Ceres CLONE 1557659
  misc_feature (625)..(625): n is a, c, t, g, unknown, or other
  misc_feature (653)..(653): n is a, c, t, g, unknown, or other
  misc_feature (664)..(664): n is a, c, t, g, unknown, or other
  misc_feature (708)..(708): n is a, c, t, g, unknown, or other
ctccccgcggtggcggccgctctagaactagtggatcccccgggctgcaggaattcgtctcacccctagaaaaaatcctcttccctcccaccgattcgcccgctggctcgccgcccgcccgtatcctgcgcccgctcgagatctagaccagacgccgcagccgcggccgcgggctgacaggatctctgtcctccctacgcggcgaaccgctaggacggcgccgaagacgacgagggagacggggtcatggaggcgtcttcctgggacgcccttcgcaagcaggcacggagggttggaagctcagttagatgaacccaaatggatcgccctaaccggcaaaaattggggtttttctttaaaaaaaacaaaaggggtttccaaaaaaaagaggaaattttgggggcgcctccgggtttttataaaaaaaaatcccctccccgaaaaaaccgttttttttttttccccccccaaaaaaaaaatattttttcccccaaaaaaaaaaaaaaaaaaaaaaagggggggggggggggcccccccccccccgggggggggggggggggggctaaaaaaaaaaaaaaaattttatttttttttttttttttttaaataaacaaaaccccaacancagacgaggggacccgtggttttttatnttcctaggttngagaggggggggggagagaaggattttttttattttttttttancaactacaccaagaaaaaaggcacaccttttcttt

SEQ ID NO: 73349 - DNA, 1072 bp, Zea mays
  misc_feature: Ceres CLONE 1557663
  misc_feature: Encodes the peptide sequence at SEQ ID NO. 73350
agctccggtcactccttgtccctgagtcctgttcaagaatcaagacaaactggcaacgagaaactagcggatttcctgaatcctgagttcctcaccggcgaggcgagcacggaaaaaatcgcatggccttgcagcacgcaggtccagctagctctacgctgaccaccggccgtcatggcaggagcgccgcagccgtcctccgtaggccaccgacgggttctagcagccgtttgagggcgcatgcgcagaaacccgtcgccggatcccgttcccgtggcgcgggagccgagaccgcgacgtccccctcatcctcccgctcggagaacgccgtcctcaaggccgcctggtacggctccgagctcctcggcatcgccgcgtcgcttctccggcccgcgccgtcgtcgcctcaggagggggatgctggcggtggcggtgacgcagagggcgaagcggcggcggtggcgggggccctggacctggaccacgcgggagtggccgaggccattaaggcggacttcgcgcggtcgtacttcgtcacagggaatctcacgctgagagcttacgaggaggactgcgagttcgccgacccggcgggctcgttcagaggcctgcggcggttcaaacggaactgcactaattttgggtctctgctcgagaaatcgaacatgaagctcactaaatgggaggacctggaggacaagtcgatcgggcactggcgtttcagctgtgtcatgtcgttcccctggaggcctattctgtcagcaaccgggtacacggaatactatttcgatgctgaatcggggaaggtgtgcaggcacgtcgaaaattggaacgttccaaagatggcgctccttcggcagattttcaggccgagccgatgggtctgggagaagcgttaaagcctgcagtggccgttgttttatgttccaaaccaaaatgcatgtgcgtgtacgtactagatatgtaaaagtacactcagaagaataactcgtatatatactagcagtatataaaatgtggatttacaaaaaaacaaaaaataagagttatcgtataaaaaaaaaaaaaaaaa

SEQ ID NO: 73350 - protein, 258 aa, Zea mays
  misc_feature: Ceres CLONE 1557663
MALQHAGPASSTLTTGRHGRSAAAVLRRPPTGSSSRLRAHAQKPVAGSRSRGAGAETATSPSSSRSENAVLKAAWYGSELLGIAASLLRPAPSSPQEGDAGGGGDAEGEAAAVAGALDLDHAGVAEAIKADFARSYFVTGNLTLRAYEEDCEFADPAGSFRGLRRFKRNCTNFGSLLEKSNMKLTKWEDLEDKSIGHWRFSCVMSFPWRPILSATGYTEYYFDAESGKVCRHVENWNVPKMALLRQIFRPSRWVWEKR

SEQ ID NO: 73351 - DNA, 892 bp, Zea mays
  misc_feature: Ceres CLONE 1557665
  misc_feature: Encodes the peptide sequence at SEQ ID NO. 73352
  misc_feature (247)..(247): n is a, c, t, g, unknown, or other
  misc_feature (321)..(321): n is a, c, t, g, unknown, or other
ctccccgcggtggcggccgctctagaactagtggatcccccgggctgcaggaattcgtctcacccctagaaaaaaagagaggcgggacgagcgtcagtgcagtgcgcgtgtggtcgggtagcgatccgaggagcgcgcagcgatggcggcggcggccgtggcgactgtggccaccccatcccccgcttccaggcggctgttcccctccgccggcccgtctcttctccggctcccaaggccgaccacngcggctcaggggcgcgcccctgcgggtttcgcccgccgggcggggggatgaaggcgggacgtgcctgccctggnccccgggggccccaggggggaaggccggtggttgccccggggaggccttggagggaacaacccgggaacaagcccaacttgggggcggaagccccaccttcgaaaattcgggagggggcttccgccctttcccaggggggaaaacttgggggccgggggggtttttttcccccggggggggggggaaaacgggggcttcccggggggggtttttcccggggggggggggcggggcggggggaaaaaaaaaaaaaatttttttgggaacacacggggggggcataataaaaaaaaaagggggggccctattttttttttttttccttggggggggggacaaaaaaaacacatatataaaggggccgcctttcaccaaaaaaaagaggggggggtttctttccccccccccggtggaagacccccccggggggggtaaacatcctcttttttggtatacatggggggggggggggaggaagaaaaaacaatattcttttcttttaaagaaaaaaaaaaaccccccctggcccggcgcttctttatttatatttacccgcgcgtgcgcacaggg

SEQ ID NO: 73352 - protein, 51 aa, Zea mays
  misc_feature: Ceres CLONE 1557665
MAAAAVATVATPSPASRRLFPSAGPSLLRLPRPTTAAQGRAPAGFARRAGG

SEQ ID NO: 73353 - DNA, 871 bp, Zea mays
  misc_feature: Ceres CLONE 1557671
  misc_feature: Encodes the peptide sequence at SEQ ID NO. 73354
ctggagctccccgcggtggcggccgctctagaactagtggatcccccgggctgcaggaattcgtctcacccctagaaaaactctctctctctctctctctctctctctctctctctctctctctctctcgtggaagccagccacacaaggcagaaagagagagagagagagtgacgttgtgttccatcccgttccgctgaagcaaccgctctcctacaccaaaccaccccacaccactctagccgatgcgatggatgtggatccagcagcggagcagcggaggaagaacaagggcgggctggagtcagagctggagcgccactacgacgacctgcagcgggagatgatgctgatggccgccgatcggccgcacaagcaactgcaacagcatcgaccccaccggcaccgctccgatctgctccagaactgcgacctgcccccaccggccaagctcttcggccccgtgcccactctgcagaggctggagaccgccgctgccaaggaccacaaggccgacgacggcctgctgcgggcgctgcgcctgtcgcaatcgcgcgcgcgggaggcggaggacaagctggcggccgcgggcgccaccaacgtcgacctcgcggcgctgctcgtgcgggactccgtcgcgctctccgcccaccgccgctgggtcatgatgctggaggccgagaattccctgcttccgaggaccacgaccagatgggggatggttcggaatcccggaccacggagccggcggggggggcccaccttggtggggtggccgtccccccttcttgcgtccagggtttccccggggattaggtctttcgcggctcgggcagggttccttcttgcttgaagaacctggtgtatgggg

SEQ ID NO: 73354 - protein, 200 aa, Zea mays
  misc_feature: Ceres CLONE 1557671
MDVDPAAEQRRKNKGGLESELERHYDDLQREMMLMAADRPHKQLQQHRPHRHRSDLLQNCDLPPPAKLFGPVPTLQRLETAAAKDHKADDGLLRALRLSQSRAREAEDKLAAAGATNVDLAALLVRDSVALSAHRRWVMMLEAENSLLPRTTTRWGMVRNPGPRSRRGGPTLVGWPSPLLASRVSPGIRSFAARAGFLLA

SEQ ID NO: 73355 - DNA, 814 bp, Zea mays
  misc_feature: Ceres CLONE 1557672
  misc_feature: Encodes the peptide sequence at SEQ ID NO. 73356
  misc_feature (777)..(777): n is a, c, t, g, unknown, or other
  misc_feature (784)..(784): n is a, c, t, g, unknown, or other
ctggagctccccgcggtggcggccgctctagaactagtggatcccccgggctgcaggaattcgtctcacccctagaaaaaactctctctccccatccgcgccagtccaaccaagtcagcacccgcgcgcggcaaggagttcacgcccatggcgagcaccaacatggcgtcggccacctcgcggttcatgctggccgcgggcgtgcccactgccagtagcggcagcggccgcgtcagcttcgcctcggcgcccaaccggcttggcaggaggcttgtggtccgggccgatgaggagttcccggcagagccggcgcccacggcggaaggggagggcgccgtggccaccaagcccaaggccgagaagccgccgccgatcgggcccaagaggggcgccaaggtgaagatcctgaggcgggagtcctactggtacaacgggatcggcaacgtcgtcaccgtcgatcaggatcctaacacccgttacccggtggtggtgcggttcaacaaggtgaactacgccggcgtgtctaccaacaactacgccttggacgagatcctcgaggtgaaatgagtgaggccagtctgctaaagaccccatgctcctgtgtgatttgtagttgtgaagtgaggctgctgcctagctgctagcgtcacaacatcaatcttgtaatagcttaatctccacaatcatcatgtaatttattgcatgcttcattcaccgtggactcaataatctctcttgctctaaaaaaaaaaacggcacaacccattcgcaccgcancgcgtcncggcgagcgggcgggcgggcgacacgacac

SEQ ID NO: 73356 - protein, 139 aa, Zea mays
  misc_feature: Ceres CLONE 1557672
  misc_feature (78)..(139): Pfam Name: PSI_PsaE Pfam Description: Photosystem I reaction centre subunit IV / PsaE
MASTNMASATSRFMLAAGVPTASSGSGRVSFASAPNRLGRRLVVRADEEFPAEPAPTAEGEGAVATKPKAEKPPPIGPKRGAKVKILRRESYWYNGIGNVVTVDQDPNTRYPVVVRFNKVNYAGVSTNNYALDEILEVK

SEQ ID NO: 73357 - DNA, 802 bp, Zea mays
  misc_feature: Ceres CLONE 1557675
  misc_feature: Encodes the peptide sequence at SEQ ID NO. 73358
ctggagctccccgcggtggcggccgctctagaactagtggatcccccgggctgcaggaattcgtctcacccctagaaaaagagaaattgcgtgaactctttgctgagtatggcaatattacttcctgcaaggttatgcgggattcgaatggtgtcagcagaggttctggatttgttgctttcaaatctgctgaagatgctaaccgagctcttacggagatgaatggcaaaatggttggaagcaagcccctttatgtagctcttgcgcagcgtaaagaagacagaaaggcaaagctacaggcacaattttcacaaatgcgtcctgttgcaatggcgccttcagtaggtcctcgcatgcccatgtttccacctggtgtccctggagttggtcagcagctgttctatggtcagccaccaccagccttcatcaaccctcaggctggatttgctttccagcaacctctgatgcctggtatgaggcctggtggtccaatgccgaactttatgatgcctatggttcagcaaggacagcaaccacagcgtcctgctggtagacgtgctggtggaatgcagcagcccatgccaatgggtggtcagcaacaggtgttccctagaggtggtcgtggctatcgctatcctactggacgtggaatgcctgatcctggcatgcacagtgttggtgctgtgatgccaccttcatatgagatgggagggatgccaatgagagaagctgccccccaacctgttccaattggggcgctagccactgcacttgctaacgccccaccagatcagcagagacc

SEQ ID NO: 73358 - protein, 266 aa, Zea mays
  misc_feature: Ceres CLONE 1557675
  misc_feature (20)..(85): Pfam Name: RRM_1 Pfam Description: RNA recognition motif. (a.k.a. RRM, RBD, or RNP domain)
GAPRGGGRSRTSGSPGLQEFVSPLEKEKLRELFAEYGNITSCKVMRDSNGVSRGSGFVAFKSAEDANRALTEMNGKMVGSKPLYVALAQRKEDRKAKLQAQFSQMRPVAMAPSVGPRMPMFPPGVPGVGQQLFYGQPPPAFINPQAGFAFQQPLMPGMRPGGPMPNFMMPMVQQGQQPQRPAGRRAGGMQQPMPMGGQQQVFPRGGRGYRYPTGRGMPDPGMHSVGAVMPPSYEMGGMPMREAAPQPVPIGALATALANAPPDQQR

SEQ ID NO: 73359 - DNA, 810 bp, Zea mays
  misc_feature: Ceres CLONE 1557677
  misc_feature: Translation starting site: 159
  misc_feature: SWISSPROT Homolog: EC 3.4.22.16 Cathepsin H
  misc_feature: SWISSPROT Homolog: EC 3.4.22.15 Cathepsin L
ctccccgcggtggcggccgctctagaactagtggatcccccgggctgcaggaattcgtctcacccctagaaaaagctcgtgccagcgcccagcaggccattctgctcgccttactccctcacagaacccagtaaaatattgccagtcccgccgtcgagatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttcgccgtcaggtacggcaagagctacgagagcgcggcggaggtccataagcggttcaggatcttctccgagagcctccagctggtccgctccaccaaccgcaaaggcctctcctaccgcctcggcatcaaccgcttcgcggacatgagctgggaggagttccgtgcgacccggctcggcgcagcccagaactgctccgccacgcttaccggcaaccaccggatgcgcgccgccgccgttgcgctgccggagacgaaagactggagggaggatggggattgtgagcccagtgaaaaaccagggccactgtggatcatgctggaacttcagcactactggtgcacttgaggctgcatatacccaggcaactggcaagcccatctctctctctgagcacagcttggttgactgtggttttgcattcaacaatttcggaagcaacggaaggcttcccatccaaggccctttt

SEQ ID NO: 73360 - DNA, 918 bp, Zea mays
  misc_feature: Ceres CLONE 1557678
  misc_feature: Encodes the peptide sequence at SEQ ID NO. 73361
aaagctggagctccccgcggtggcggccgcactcaactagtggatcccccgggctgcatgattcgtctcacccctagaaaaagtcatcatcccgattcccgacacgcttgtgttgtcgcgattggcaagctcggcggctcgtggcagcgggaacttacgaggcgaaggagagcgagggcgaccgcgcggatcgcatcgcagctctgggcggaggtggggccttgcgcggagatgctagcggtgttcgatcgggcggtggcgccgagcccggaggggctgcggcagccgggcgccgcggggggcggctgcgcggcgggcctcgcggaccggttcagagaggcgcggcccgatgcggtcaccgtcaaccttggcgggtccggcgccctggcgtactcctcgagcaaccagaccccctccttccccagtttgtttggcgcggtgggacggcttattctgcatgtttcaggggaacaaatggcaaaactttgctggtgctgaagcaaccaatttggggtttagccaaaggggccaaatgagggtcgggcttcatcattcaagggttttcaggggacctttgggggggaaggggggccccttattcccggcaaaaatggggtttggggggggaaaaatagggggaaaaatttgccattttgcccccggggaaagaggcccccccaaaagagggggtttttttggggggggggaccccccgagggaaaatgtttcctctttttttgtgggggggggggaacaccacaaggggggtttttgtggggttcttttcacacccccccaacctctggaaaaggcgggcggggggagaaaaatatgtgtgccccctccccccaaagggggtttttttttttaaaacccccgggggggggggggggaggagcacacaccaccccctcccgc

SEQ ID NO: 73361 - protein, 88 aa, Zea mays
  misc_feature: Ceres CLONE 1557678
MLAVFDRAVAPSPEGLRQPGAAGGGCAAGLADRFREARPDAVTVNLGGSGALAYSSSNQTPSFPSLFGAVGRLILHVSGEQMAKLCWC

SEQ ID NO: 73362 - DNA, 787 bp, Zea mays
  misc_feature: Ceres CLONE 1557680
  misc_feature: Encodes the peptide sequence at SEQ ID NO. 73363
  misc_feature (299)..(299): n is a, c, t, g, unknown, or other
  misc_feature (300)..(300): n is a, c, t, g, unknown, or other
  misc_feature (303)..(303): n is a, c, t, g, unknown, or other
  misc_feature (640)..(640): n is a, c, t, g, unknown, or other
  misc_feature (641)..(641): n is a, c, t, g, unknown, or other
  misc_feature (643)..(643): n is a, c, t, g, unknown, or other
  misc_feature (696)..(696): n is a, c, t, g, unknown, or other
  misc_feature (724)..(724): n is a, c, t, g, unknown, or other
  misc_feature (740)..(740): n is a, c, t, g, unknown, or other
gagctccccgcggtggcggccgctctagaactagtggatcccccggggctgcaggaattcgtctcacccctagaaaaagttagagtacgggacgggaaagcgaaaccctcacggcgccggaaccccaccagtcctccaccaccacctcccaattccggaagcgaataaacgccactagattccggccgcggtccctcctccagcgccggcgtcccctcgattggctgcgaaccttgcggcttcgttcgcgccatcgcagatcggggctggtttgtctagatagagggtgctctgttgcnntanggaaaaaggggtggggggggcgcttcaaaaaccttcccccgggggttttttattttttggggggccctttttttacccccccgggggaaaaaatccgccggggttttttttccgcaaaaaaaaaaaaaacgggggggggggggggggggaaaaaaaaaaataaatggggggggggggggcaaaaaaaaaaaataggggggggattatttccctggggggggggggggaaaaaaaaaaaggggggggcggcccccccccccgggtgggggggccgccccctatattaaaaaaaaacccccccccccccccccccccaaaaaaaaaaaaaaaaaaaaanngnggggggggggggttgtgtttttttttttttttttttcccccccaccccgaacnagggggggggggggggggggggggtcgnaaaaaaaaaaaaaaanaaacacccccccccccccgccctcttttgtggtggtgtggggggggg

SEQ ID NO: 73363 - protein, 55 aa, Zea mays
  misc_feature: Ceres CLONE 1557680
ELPAVAAALELVDPPGLQEFVSPLEKVRVRDGKAKPSRRRNPTSPPPPPPNSGSE

SEQ ID NO: 73364 - DNA, 837 bp, Zea mays
  misc_feature: Ceres CLONE 1557682
  misc_feature: Encodes the peptide sequence at SEQ ID NO. 73365
ctggagctcaccgcggtggcggccgctctagaactagtggatcccccgggctgcaggaattcgtctcacccctagaaaaaacaaccatcgcaccacccaagaaatggagctgagtgtgccccttctcctcctcgcggctccccaagctcctgctccgcgcgcgtagccgcgcggcacctcccagtcccaacacgcccgcaagctccgctcaccgcgaggtgctgtttgaaccgtgaagatggcggcgatgactgcttacaagtatcaagctcaggccttgatgagggactatctgctagctgatccactagttccgtacacctctgtgctcattggcattgtcctctgcaagatggcttacgatttcactcgaatattgagctccttttatttcaagggctacactttactgacaaaaatacagcgcatcgaatggaacaataggggtatgtccagcgctcatgcaatttttatcacggctgtatcattatatcttgtcatgtcaactgatcttttctccgaccgcgtcaagggacctattacattccgttattcgataatatccacctctgcgttgggggtttctgtcggctacttcatcactgatcttgcaatgatcttctggctgtatctttcccttggtggaaatgaatatgtcctccaccatactgttttcctggttgcaatagctacacaatgttgtctgggggagggcagttttacacatacatgggttctcattttcagagacaaccacccctgaaaatcacttgcgatggtttcttgaaccctgctggactgaagaaatcaagggcttacttgggtaaagggaatcta

SEQ ID NO: 73365 - protein, 174 aa, Zea mays
  misc_feature: Ceres CLONE 1557682
  misc_feature (26)..(172): Pfam Name: DUF887 Pfam Description: Eukaryotic protein of unknown function (DUF887)
MAAMTAYKYQAQALMRDYLLADPLVPYTSVLIGIVLCKMAYDFTRILSSFYFKGYTLLTKIQRIEWNNRGMSSAHAIFITAVSLYLVMSTDLFSDRVKGPITFRYSIISTSALGVSVGYFITDLAMIFWLYLSLGGNEYVLHHTVFLVAIATQCCLGEGSFTHTWVLIFRDNHP

SEQ ID NO: 73366 - DNA, 878 bp, Zea mays
  misc_feature: Ceres CLONE 1557684
  misc_feature: Translation starting site: 149
  misc_feature: Pfam Name: Methyltransf_12 Pfam Description: Methyltransferase domain
  misc_feature: Pfam Name: PrmA Pfam Description: Ribosomal protein L11 methyltransferase (PrmA)
  misc_feature: SWISSPROT Homolog: EC 2.1.1.125 Histone-arginine N-methyltransferase
  misc_feature (470)..(470): n is a, c, t, g, unknown, or other
ctccccgcggtggcggccgctctagaactagtggatcccccgggctgcaggaattcgtctcacccctagaaaaactcacaaaaccctagctttccctcctcccctgttttgcggcgcgccacgaactcgcgacgctctcgagagatccatggatcggcgcaagggcggcaaccgcgacgccaacggcagcctggtcgaggccacggcgtcgcggctgagggtcgaatccgacgaggaggcggaagaggtggggatggaggtggaagagagcttcgacgcgggggtggaagacgagcaggcggcggcggaggtgattggaagcgaaaagaccagcgccgactactacttcgactcctactcccacttcggtattcatgaagaaatgctaaaagatgtcgttcggacaaaaacatatcaaaatgttatcacccagagtagctttcttatcaagaacaaagtagtccttgatngtggtgctggaactggaattctttctcttttctgtgcaaagcaggagctaaacatgtctatgcgaatgaaatgtcccagatggcagaatggcacaagaaattgtaaaatccaatggaaattcaaagtgcctaactggaataaaagggaaaggggagaaaataaacctcccgtcccaaaagggaaggccccccctccaaagggaagggggtttccccccgtttcagaaaaattttaaacccttccctaagcccccaaaaaaaggtcttccaaaggggggggggcccccccaaaagaaattttttgtggtttctggggggtgggccccccaatatggggaaacaaaatttttttttgaaaaaagttgggttttttttagccgcgccaaaaaaaacggggtgagggggccc

SEQ ID NO: 73367 - DNA, 755 bp, Zea mays
  misc_feature: Ceres CLONE 1557685
  misc_feature: Encodes the peptide sequence at SEQ ID NO. 73368
  misc_feature (82)..(82): n is a, c, t, g, unknown, or other
  misc_feature (94)..(94): n is a, c, t, g, unknown, or other
  misc_feature (155)..(155): n is a, c, t, g, unknown, or other
  misc_feature (382)..(382): n is a, c, t, g, unknown, or other
  misc_feature (397)..(397): n is a, c, t, g, unknown, or other
  misc_feature (457)..(457): n is a, c, t, g, unknown, or other
  misc_feature (688)..(688): n is a, c, t, g, unknown, or other
ggagctccccgcggtggcggccgctctgaactagtggatcccccgggctgcaggaattcgtctcacccctagaaaaagtcanctaccggagccngccactcccacgaacgcgggcggcggagcggaagcgaaccagttatctagtggagttgccntccttcaagctactctaatgtcctttctattcaagtctagcaatggcggcaccactgaaaaaatcccatccccagaagaacagcgagaaaaaataaatgaattacgcaaggagcttggtgaacactcatcagaagccattaaagacttcctttcagatgcctcgttagtgcgatttcttcgagcaaggaactggaatgtgcagaaagctagtaaaatgatgaaaacngctgtgaaagtggcnggcttgcattcaaaccctgaaaaacatcctgttggggattgaatttgcaaagggaaaccnaaaactggaaagaattttaaggggcgggatttataagggcaaaccttgggcgaaaacctggtccttggtttttgaagccccgggcctttaaaaaaaaaccccccccccccccccatttgggcacaaaaaccaaaatttccctaggggccccaacccccccgggggaaaaaaaaagcaattttttttgaaacaccccccccccgggggggaaatcctccccaaaaaaaaaanaagggggtgttttggggggccccaaaaaaaaatattttttttctcccccgggcgggcggggggaggg

SEQ ID NO: 73368 - protein, 88 aa, Zea mays
  misc_feature: Ceres CLONE 1557685
  misc_feature (14)..(77): Pfam Name: CRAL_TRIO_N Pfam Description: CRAL/TRIO, N-terminus
MSFLFKSSNGGTTEKIPSPEEQREKINELRKELGEHSSEAIKDFLSDASLVRFLRARNWNVQKASKMMKTAVKVAGLHSNPEKHPVGD

SEQ ID NO: 73369 - DNA, 905 bp, Zea mays
  misc_feature: Ceres CLONE 1557686
  misc_feature: Encodes the peptide sequence at SEQ ID NO. 73370
ggagctccccgcggtggcggccgctctagaactagtggatcccccgggctgcaggaattcgtctcacccctagaaaaaatatatccacacctgagtcccctccgccgcctgccgcactctcccgcgacgccaccaccacacgttcacggtagcgagagcttatcgtcgtcggcggcgaagatggtgtcgctgaagctgcagaagcggctcgccgcgagcgtcctcaagtgtgggaaaggcaaagtctggcttgaccccaatgaagtcagcgagatctccatggctaactcccgccagaacatccggaagttggttaaggatgggtttatcatcaggaagcctcagaaggttcactctaggtcccgtgcaagaagggcacatgaggccaagcagaagggaaggcactctggatatggcaagcgcaggggtaccagggaggctaggctccccaccaagattctgtggatgaggaggatgcgtgttctgaggcgcctgctctgcaagtaccgtgagggccagaagatcgacaagcacatgtatcatgacatgtacatgaaggtcaagggtatattgtttaaaacaagaggggcttatgggaaatattcacaaagtcaaggctgaaaaggccaaaaaaaaaacctttcttaataatttgggggccaagggtcaaaaacaagggaaaccctggaaaggaaaatttctaaagggggggaagggggggccccgggcccaaaaaaaaaaaaaaacccttgtgtcacccccccctcctcttttggggggggcccaaaaaaccaaaaatatggatgttgagaaaacaaggggcgcttttttttggaaaaaaaaaaaaaatgtttttggccccccaaaaattttttgggttataaaaaggcgcggccccacaaaat

SEQ ID NO: 73370 - protein, 146 aa, Zea mays
  misc_feature: Ceres CLONE 1557686
  misc_feature (2)..(147): Pfam Name: Ribosomal_L19e Pfam Description: Ribosomal protein L19e
MVSLKLQKRLAASVLKCGKGKVWLDPNEVSEISMANSRQNIRKLVKDGFIIRKPQKVHSRSRARRAHEAKQKGRHSGYGKRRGTREARLPTKILWMRRMRVLRRLLCKYREGQKIDKHMYHDMYMKVKGILFKTRGAYGKYSQSQG

SEQ ID NO: 73371 - DNA, 840 bp, Zea mays
  misc_feature: Ceres CLONE 1557691
  misc_feature: Translation starting site: 121
  misc_feature (593)..(593): n is a, c, t, g, unknown, or other
  misc_feature (602)..(602): n is a, c, t, g, unknown, or other
  misc_feature (603)..(603): n is a, c, t, g, unknown, or other
  misc_feature (607)..(607): n is a, c, t, g, unknown, or other
  misc_feature (610)..(610): n is a, c, t, g, unknown, or other
  misc_feature (613)..(613): n is a, c, t, g, unknown, or other
  misc_feature (614)..(614): n is a, c, t, g, unknown, or other
  misc_feature (621)..(621): n is a, c, t, g, unknown, or other
  misc_feature (625)..(625): n is a, c, t, g, unknown, or other
  misc_feature (626)..(626): n is a, c, t, g, unknown, or other
ctggagctcaccgcggtggcggccgctctagaactagtggatcccccgggctgcaggaattcgtctcacccctagaaaaagtcctggactcgtagttcatccacgacgcaccgaccagcaatggccacgttcctgggaagctcaccggcgctcctcgcccgtcccatcgccaagccccacatctcctgcgcgcagacaccgcgcccgccaagcgcccagaaccagccgccgtccagcgagcaaccgcaagcacaaacacagcagcagtccgtgcaagcgcagccacagcaggcggcggcgaggccgaagcgcgcgggcggcgcggactccacggactgggtggcctcgtcgctgacgcggcggttcgggatcggcgcggggctggcgtgggccggctttctggccgtcggcgtcgtgtccgagcagctcaagacccgcttcgaggtcgcgcagcagcaggccaacaccaaggacgtggaacaggagcaggaggtcgtcctgcccaacggggtccggtactacgagatgcgcgtcggcggcggcgacgtcccgcggccgggcgacctggtggtgatcgacctgcagggcccggntgcgggcanntgcngcngcnnggaagcnttcnntgacacgttcggcgacggcaagcggccgctggcgctggtgatgggctcccgggcgtacacaggggcatgtgcgagggcgtcaagtacgcgctgcgctccatgagggcggcggcaaacggcggggttgtcttcccgccgggcctcgggttctgggaaaaacggggccaaatttcggggagggagccgttccaggtcccaaccggggcgaagcttt

SEQ ID NO: 73372 - DNA, 827 bp, Zea mays
  misc_feature: Ceres CLONE 1557692
  misc_feature: Encodes the peptide sequence at SEQ ID NO. 73373
  misc_feature (631)..(631): n is a, c, t, g, unknown, or other
  misc_feature (816)..(816): n is a, c, t, g, unknown, or other
ctccccgcggtggcggccgctctagaactagtggatcccccgggctgcaggaattcgtctcacccctagaaaaaacatctcatcttcgtctgtgttcttgggcgtacgcggacacagccccgatccgaatcgtcctcctcgcgagcctcgtcgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggccgcacacttgctgactacaacatccagaaggagtcaacccttcatttggtgctgcgccttaggggaggcatgcagatctttgtcaagaccttgactggcaagacaatcacccttgaggtggagtcttcagacaccattgataatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttangggaggcatgcagatctttgtcaagaccttgactggcaagacaatcaccctttgaagtggagtcctcagacaccattgacaatgtcaaggcaaagatccaggacaaggagggcatcccacctgaccagcaacgtctcatctttgccggcaagcagtggggaggatgggaggaccccttgctgacntacacatccaa

SEQ ID NO: 73373 - protein, 167 aa, Zea mays
  misc_feature: Ceres CLONE 1557692
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (150)..(150): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLXGGMQIFVKTLTGKTITL

SEQ ID NO: 73374 - DNA, 826 bp, Zea mays
  misc_feature: Ceres CLONE 1557693
  misc_feature: Encodes the peptide sequence at SEQ ID NO. 73375
  misc_feature (620)..(620): n is a, c, t, g, unknown, or other
  misc_feature (716)..(716): n is a, c, t, g, unknown, or other
ctccccgcggtggcggccgctctagaactagtggatcccccgggctgcaggaattcgtctcacccctagaaaaaaccgcaaagggcgccaccgatgctaaagccacagacgtcgtggacagcttccctccctctccttctcatccgccgctgctcgagaaccgcggccagtccatctcctgccggtgaccggccgctctcctttgtcccggtctgcaagcggcggatgagcacgctggcgcatcccaggtttgcccctctccctacggagcaaactgaatcccaaacagatggcggggctgcacggtaccagttccggctggtctcttacaacatcttggcccaggtttatgttaagagtacgctttttcctcattccccatctgcgtgcctcaagtggaaatctcgatcgggagctattcttacagaactaaagagctttgatgctgacttcatgtgcatacaggagttggatgaatatgataccttctataagaaaaacatggaaaactctggatattcaagtatttacattcagcgatctggagacaaacgagatggctgtggtatattctataaacctaaaagtgcagaactggtgcagaaagaagtaattgtacnatgatttagtagaaaaatatgttcctagtgataatgtaaatagtgctcttggaaaataatctttcagcgaaagagaacagaatgcaaagccagatnatagcaagcggtggagatccaaatgatccacgcgttagattgaaagccggactgtgttgggttaactcgcgggctttcaagctaaggggatccttggggatcaattttta

SEQ ID NO: 73375 - protein, 131 aa, Zea mays
  misc_feature: Ceres CLONE 1557693
  misc_feature: SWISSPROT Homolog: EC 3.1.13.4 Poly(A)-specific ribonuclease
MSTLAHPRFAPLPTEQTESQTDGGAARYQFRLVSYNILAQVYVKSTLFPHSPSACLKWKSRSGAILTELKSFDADFMCIQELDEYDTFYKKNMENSGYSSIYIQRSGDKRDGCGIFYKPKSAELVQKEVIV

SEQ ID NO: 73376 - DNA, 821 bp, Zea mays
  misc_feature: Ceres CLONE 1557694
  misc_feature: Encodes the peptide sequence at SEQ ID NO. 73377
  misc_feature (651)..(651): n is a, c, t, g, unknown, or other
  misc_feature (785)..(785): n is a, c, t, g, unknown, or other
ctccccgcggtggcggccgctctagaactagtggatcccccgggctgcaggaattcgtctcacccctagaaaaaatcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacatttgcaaacagctgtttgccttacactgggctgtatttgcttgggaactctctctttgggtggaactgccttgccccatggttctctcatcccactcgtactgctattcgacaacgctacaatcttgagggtagctttgaggctttcaccagncaatgtgggtgctgcggcgatctggtcgaggacgaagagaggcgtgagcacctagaggccgcctgtgaccttgcaacccactacctctgccacccctgcgccctctgccaggaaggtcgcgagctggcgcgcangggttccccaccctggatcaacaatgggcactccgt

SEQ ID NO: 73377 - protein, 217 aa, Zea mays
  misc_feature: Ceres CLONE 1557694
  misc_feature (64)..(203): Pfam Name: PLAC8 Pfam Description: PLAC8 family
  misc_feature (161)..(161): Xaa is any aa, unknown, or other
  misc_feature (206)..(206): Xaa is any aa, unknown, or other
MGAGANNHEESSPLIPAAVAAPADEKPPQAPAPEAANYYADGVPVVMGEPVSAHAFGGVPRESWNSGILSCLGRNDEFCSSDVEVCLLGTVAPCVLYGSNVERLAAGQGTFANSCLPYTGLYLLGNSLFGWNCLAPWFSHPTRTAIRQRYNLEGSFEAFTXQCGCCGDLVEDEERREHLEAACDLATHYLCHPCALCQEGRELARXGSPPWINNGHS

SEQ ID NO: 73378 - DNA, 871 bp, Zea mays
  misc_feature: Ceres CLONE 1557699
  misc_feature: Encodes the peptide sequence at SEQ ID NO. 73379
  misc_feature (618)..(618): n is a, c, t, g, unknown, or other
ctccccgcggtggcggccgctctagaactagtggatcccccgggctgcaggaattcgtctcacccctagaaaaaaaactccgtttcgaattctagggttttgctgctctccgaccccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactantgaatttctgccaagagcaactacaactttgagaaacctttcctgtacttcgcaaggaagctgggctggtgatccgaaccttcactttggtgaagctgttgctcttaaagcctcccgaaggttacattcaacatggctatgcagcagccgcattgaacttgagctttgctgcaacagctgcccaaccttcttctgaatgacaatgaagatacttgattggagtagaaagggtcatggaggtcttgaactttga

SEQ ID NO: 73379 - protein, 149 aa, Zea mays
  misc_feature: Ceres CLONE 1557699
  misc_feature (15)..(148): Pfam Name: Ras Pfam Description: Ras family
  misc_feature (15)..(128): Pfam Name: Miro Pfam Description: Miro-like protein
  misc_feature: SWISSPROT Homolog: EC 2.7.11.1 Non-specific serine/threonine protein kinase
MALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQY

SEQ ID NO: 73380 - DNA, 919 bp, Zea mays
  misc_feature: Ceres CLONE 1557702
  misc_feature (96)..(96): n is a, c, t, g, unknown, or other
  misc_feature (111)..(111): n is a, c, t, g, unknown, or other
ggagctccccgcggtggcggccgctctagaactagtggatcccccgggctgcaggaattcgtctcacccctagaaaaaagcaagaccaacaaaccncacttctgactgacncactgtgccgcgccgtggtcaccggacggacacacagaacgacgatggccgcgtcggcgctgcaccagaccaccagcttcctcgggcaggccctggtctcccgcgccgcccgcgtcgatgcccgcgggcgcctcaccatgcgcccgcacgtcaagagcgttccccagagcatatggtaccgccctgatcgcccccagtatcttggcccgttcttccagcagacgccgtcctacctgacccgcgaatttccccggccaacaccgggtggggaacacccggggcctctggccgaacccggagaaattccgccgcaacccgggaagctgggagggattcactccccccgggggggaaaatctgggggccccctgggtttcttggttttcccggaaaccttgggcccaaaaaaaagaggggttttttttttttttaaaaaaaaaaggggtggtgtttttaaggatggggggccccaaacaattttttttttataaactcagatgtggcggaggcgggctggatacctactgggggagaaccccacctggttgtgcacgcacaaagaaaaaacatctggccatcgtggggttggcccacggggggggctcccatgggccttccttccaaaaggggggttaacccgcggttggggggggggggccccccttcttgggggaaagggggtctccccacacaaagggtgtttttcccccccgcgggggggggcctttttaataacccccccttggggggttctctcccccccaaaaaaacccccggagaaacccccccccccacaaaaaataaaaag

SEQ ID NO: 73381 - DNA, 812 bp, Zea mays
  misc_feature: Ceres CLONE 1557705
  misc_feature: Encodes the peptide sequence at SEQ ID NO. 73382
  misc_feature (746)..(746): n is a, c, t, g, unknown, or other
  misc_feature (789)..(789): n is a, c, t, g, unknown, or other
ctccccgcggtggcggccgctctagaactagtggatcccccgggctgcaggaattcgtctcacccctagaaaaaacgcggaaaccctagcagctcaacaccctcgaggtacctccattcgcagtcggccgtgtcctcggagccgcgggagatggcggatcaggagacagtagctgtggttgaggcacctaccccggttctaggggaaccgatggacctgatgactgccctgcagctcgtcatgaagaagtcaggtgctcacgatggccttgtgaagggtcttcgtgaggctgccaaagccatcgagaagcatgccgctcagctctgcgtgcttgccgaggactgcgaccagcctgattatgtcaagctggtgaaggctctctgcgctgagcacaatgtccacctggttactgtgcctagcgccaaaactcttggagagtgggctgggctttgcaagatcgactctgagggcaaggcgaggaaggttgtaggctgctcctgtgttgttgtcaaggactacggcgaagaatctgaaggccttaacatagtgcaggagtacgtcaaatcgcactagatacagtctgtcagtatctgggagttgtgttcaacactacattttgcacctgagtttaaatatgtgtttggttcttgggctttgctaggagattagaacagtttttcagtgagcctaggatccatgtgaacgattttgatatctcgcctcttttgcagtgtctcatctgctgntatacaaaatcagcagagctagtattttggtctttcctgtccntgccatagcatggtggttcgtgc

SEQ ID NO: 73382 - protein, 140 aa, Zea mays
  misc_feature: Ceres CLONE 1557705
  misc_feature (25)..(120): Pfam Name: Ribosomal_L7Ae Pfam Description: Ribosomal protein L7Ae/L30e/S12e/Gadd45 family
MADQETVAVVEAPTPVLGEPMDLMTALQLVMKKSGAHDGLVKGLREAAKAIEKHAAQLCVLAEDCDQPDYVKLVKALCAEHNVHLVTVPSAKTLGEWAGLCKIDSEGKARKVVGCSCVVVKDYGEESEGLNIVQEYVKSH

SEQ ID NO: 73383 - DNA, 819 bp, Zea mays
  misc_feature: Ceres CLONE 1557706
  misc_feature: Translation starting site: 584
ctccccgcggtggcggccgctctagaactagtggatcccccgggctgcaggaattcgtctcacccctagaaaaagaccaccgccgcgccgactaaaccttagacgtcgccgccgcctccgccgctatggtcgacatctaccgccaccctcgtctccgtgaacgccctagagggcaacttggtaaccgacgcctccggcatcgccttaccgcccgtcttcggggcgccgatccggcccgacgtggtcatgttcacccactagctgctgtcctgcaacaagcgtcagcccttctcagtctcccgcctcgctcggccaccatacttccgccgactcctgtggtaccggccgcgccgtgtctcgtatccaccgcgtccccggcggcggcacccaccgcgccggtcatagagcgttcggccacatgtgccgcagctcggcgcatgttcgcacacgactatatatggcgactttggcaactccgagtcaacatcaacctacgacgacgtgccatcgcctcgcgaatgcggcgacccgcagtccaggacctcttctcagcggaggccacaggattgagtctgtcaccgagatgcacgttgtcatttacgactccacggagaccactgcgaaggattcccaagcacatcaaactctcaagcacgatcggaacaacacctacggcgagaacggcaggactcttgcggcatacgcccccgtcagggtaagatgctaacaggtgctacatcaactggctgggaccgttcatcgtctcgaggacgcaggtctcgaatgtcacaacgacttccgcagacttccggtgtgaat

SEQ ID NO: 73384 - DNA, 777 bp, Zea mays
  misc_feature: Ceres CLONE 1557708
  misc_feature: Encodes the peptide sequence at SEQ ID NO. 73385
agctccccgcggtggcggccgctctagaactagtggatcccccgggctgcaggaattcgtctcacccctagaaaaaatatcgggttctcccttcctcttcctgtttccgcgcgcgagatcgccgccccgggtgggctctagatcccgatggcctcgcgccgccgcaccctgctcaaggtcatcatcctcggcgacagcggggttgggaagacgtctttgatgaaccaatatgtgaacaagaagttcagcaaccagtacaaggctacgattggggcggatttcctcaccaaggaggtgcagttcgaggacaggctcttcactctgcaaatatgggacactgctggtcaggaaaggtttcagagtcttggcgttgcattctaccggggagcagattgttgtgtcctagtctatgatgttaattctatgaaatcgtttgataatcttcacaactggcgtgaagagtttctaattcaggcgagcccatcagatcctgacaatttcccttttgttctgttgggtaacaaagttgatgtagatggtgggaacagcccgtgtgggggtcggagaaaaaggcaaaaggcttggtggcccctctaaaggggaacatccccgtacctttgaaaacctccggcctaaaggatgggaacccaaaaccgggaaaaaataaccctttcccccgggggtttttggtaaaaaaaaaaacccccccctctaaaaaaaaaaacccccgggagaaaaaaatatttttttttgcccccaaataccccgggggggttg

SEQ ID NO: 73385 - protein, 149 aa, Zea mays
  misc_feature: Ceres CLONE 1557708
  misc_feature (10)..(145): Pfam Name: Ras Pfam Description: Ras family
  misc_feature (10)..(128): Pfam Name: Miro Pfam Description: Miro-like protein
  misc_feature: SWISSPROT Homolog: EC 2.7.11.1 Non-specific serine/threonine protein kinase
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLHNWREEFLIQASPSDPDNFPFVLLGNKVDVDGGNSPCGGRRKRQKAWWPL

SEQ ID NO: 73386 - DNA, 728 bp, Zea mays
  misc_feature: Ceres CLONE 1557709
  misc_feature (273)..(273): n is a, c, t, g, unknown, or other
  misc_feature (456)..(456): n is a, c, t, g, unknown, or other
  misc_feature (540)..(540): n is a, c, t, g, unknown, or other
  misc_feature (541)..(541): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
gctcccgcggtggcggccgctctgaactagtggatcccccgggctgcaggaattcgtctcacccctagaaaaaatcgcttatcatccgcgcctctacatttcttctctctctgctcctccgcctccgcctccgcctgatccatccaagacagggatcgccatgtcggactcggaggagcccacttcgatcgaggccgacctggggcgtccagactaccgcagcggctggcaccgtccgtagacggctcatcgtcatcagaccgtcctgcaggntgttgaggttctacttccagactggtaagcatggcccccccaatgggcccttttttcgcccttgaacctttttaaagggggaaaaaaacctttttaaaaaaaattttttttccctccccaccccccccaaaaaagggggggggaaaaattctccccccggggtgggggggacacccccccccngggggggggggggaatccccccccccgcggggggggaggatttttttttttctgggttggggagggaggggggggggggggggnnannnnnngggggggggggggggccggttcttttctttttttttgggggggccgcccccgcggggggggtgttttttttccccccccccccccccaaaaaaaattttttttggttgcccccaccccccaaaaaaaaaggggggggggccacaccgaaagagggggaagtttttttttttttttttttt

SEQ ID NO: 73387 - DNA, 900 bp, Zea mays
  misc_feature: Ceres CLONE 1557710
  misc_feature: Encodes the peptide sequence at SEQ ID NO. 73388
  misc_feature (348)..(348): n is a, c, t, g, unknown, or other
  misc_feature (577)..(577): n is a, c, t, g, unknown, or other
  misc_feature (578)..(578): n is a, c, t, g, unknown, or other
  misc_feature (619)..(619): n is a, c, t, g, unknown, or other
ctggagctccccgcggtggcggccgctctagaactagtggatcccccgggctgcaggaattcgtctcacccctagaaaaaaacgacacggccgtgccgcctctctgcacgcgcacccactccgtcccgggcttcctcttctccagcggcgggttcgcgggcaacctgtaccacgactacgccgacgtgctggtgccgctcttcgcaagcaccaaccacctgggcggggaggtccagttcctgctggccgacatcaaggactggtgggccgacaagttccgcccggtcttccgccagctctcccgctacgacgtcatcgacgtgaacaacgaccgcgaggtgcactgcnttcccgcggatcatcatcggctccaccttccaccgcgccatgggcatcgacccctcgcgctcgcccggcggcgtcacggtggccgacttcaagcgcctgctccgccgcgcgttccggctggagcgcgccgtttcgcgtcgcggtcggggggcgcccccgccgcccggaaccggccccccgctcctcatcatctcgcgcaagagctcgcggccgcttcgtcacgaggcgnnccccatggcgccggggccgccggcgggcgccccccgttccnaacgtggcggaatcgcccgaagcccaaaaaccacaccgaaaatgccccactttcgcgaggggtggtgaactccgcggaacgtgataaataaagggcggggcaccggggcccggttcaacccaaaccatggtgttcctggccaaacccccgcgtgtcttgggtgcccaagtgggggcccctttccccccggcctgggaaggggtttaaacccgggttccctttaaaggacccccccaaggggacaatggaacctccccctactgggggagaaacaccgggtt

SEQ ID NO: 73388 - protein, 235 aa, Zea mays
  misc_feature: Ceres CLONE 1557710
  misc_feature (1)..(174): Pfam Name: DUF563 Pfam Description: Protein of unknown function (DUF563)
  misc_feature (116)..(116): Xaa is any aa, unknown, or other
  misc_feature (192)..(192): Xaa is any aa, unknown, or other
  misc_feature (206)..(206): Xaa is any aa, unknown, or other
GAPRGGGRSRTSGSPGLQEFVSPLEKNDTAVPPLCTRTHSVPGFLFSSGGFAGNLYHDYADVLVPLFASTNHLGGEVQFLLADIKDWWADKFRPVFRQLSRYDVIDVNNDREVHCXPADHHRLHLPPRHGHRPLALARRRHGGRLQAPAPPRVPAGARRFASRSGGAPAARNRPPAPHHLAQELAAASSRGXPHGAGAAGGRPPFXTWRNRPKPKNHTENAPLSRGVVNSAERDK

SEQ ID NO: 73389 - DNA, 778 bp, Zea mays
  misc_feature: Ceres CLONE 1557713
  misc_feature: Encodes the peptide sequence at SEQ ID NO. 73390
ctccccgcggtggcggccgctctagaactagtggatcccccgggctgcaggaattcgtctcacccctagaaaaaaacacctcgctttttgtactcttccgtctttgccctcgcgttaacgcgctcgtctcgcctggcctagctagctgcctgccttggcttgcttgctacgtcgtgtactatacacagcgagaggaaggaggagcaagaataaagaaaagagagagagtcgcttcctttcctccaacttattccatggagacctcttctcacaagcgggcgcgggaggcggtcgacctcgccgccgccgccggagaggccgtgtggccggaggccgacgccaagaggctgcggccgcaggacctgctcgacatgctcgacgacgacaccgaagcggcggccgccggcgacctggcgtccgtcatgcggagcctggaggaggagatagccagcttcgacgaggccgcggaggcggcgccgtcgcagcagccggagctggggttcctgctcgaggcctcggacgacgagctggggctgccgccggcgggatccgccgccgccgcctcttcggaggaggccggcctcgccggcccgccggagcccgccgccgcgctctacggccagatctggggcttcgacgacgagatcgacggaggcttcggtggctactcgcccgaggctgccgccgcggccgccgccgccgccgcgtgggacgacgacgtcttcggcgccggcctgttcgcgttcggcgacgacgcgtgcgcgccgtcggatctcgg

SEQ ID NO: 73390 - protein, 174 aa, Zea mays
  misc_feature: Ceres CLONE 1557713
METSSHKRAREAVDLAAAAGEAVWPEADAKRLRPQDLLDMLDDDTEAAAAGDLASVMRSLEEEIASFDEAAEAAPSQQPELGFLLEASDDELGLPPAGSAAAASSEEAGLAGPPEPAAALYGQIWGFDDEIDGGFGGYSPEAAAAAAAAAAWDDDVFGAGLFAFGDDACAPSDL

SEQ ID NO: 73391 - DNA, 820 bp, Zea mays
  misc_feature: Ceres CLONE 1557716
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (101)..(101): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnaaaggctgggactccccncggtggcggccgctctagaactagtggatcccccgggctgcaggaattcgtctcacccctagaaaaaactcaccacgcacgcacaaagcagagcaggcaacggtacagcccagcacaggtagagagagagagagagagaagcgcggagccaagaagcggagcaacaacagcaggccgaggaagagaagagaaggccaggaggcagcagcctagaggcagcagccaggagcaagatgctgcgcgggggctcgagcgtgctggggatcatcaacttcatcaccttcctgatctcgatcccgatcctgggcgcggcatctggctggcgtcgcggggccacttcaccgactggatcggcttcctgcagtgggccatcatcattcggggggctcgccccccggggcaatccccctaaaggggtttttccgggggcctggtaaccccccgaaactgggggggtcccccccttaaccttttttcccaaatgtttttttggggggccccgcgggctttttctttttttaaaagggtttttcccctttgcccgggaccccaaaaaccccggggaaaaagcgccagaggttctccaaatagaaaaggcccggctttttttcccgaaaaaaaaaaaaaatttcctccccaaaaaaaaaaggaggagggggggggtgttttctccaaaaaaacccgtttttttcccacaaaaccaccccccaaagtgtggg

SEQ ID NO: 73392 - DNA, 954 bp, Zea mays
  misc_feature: Ceres CLONE 1557724
  misc_feature: Encodes the peptide sequence at SEQ ID NO. 73393
  misc_feature (51)..(51): n is a, c, t, g, unknown, or other
aagctggagctccccgcggtggcggccgcactacaactagtggatcccccngggctgcttgaattcgtctcacccctagaaaaactcgtccaaaaccctagccctcgcgccgccgccgccgtgcccagcgctcgagctcctcgcctgccgcgagctcgcgccgcaacgccaccatgaagttcaacatcgcgaacccgtctaccgggtgccagaagaagctggaaatcgatgacgaccagaaactacgtgccttttatgaccgaaggatctcccaggaggtcagtggtgatgctctgggtgaggagtttaagggttatgtcttcagatcatggggtgggaggtgaaaaaaaagcttccccaagaagcaggaggttcggactttttgggcgggggcccccttcccccccccaaagggaccccctgctttcccgggttatggcggggcgaaaggggaacccccgggagaaagtctgtccccggggttgtttttgggaggcaaaaaacctttctggttttaaaccttgggaaattgtttaagaaaggggtggaggaaaaaacttcccccggggttttaacggaccctccaaaaaacccaaggggttgaggggggggcccccacaaaggggcgccccccaaaaaaaggagaaagctgttttcaaatctctttccaagaggaataaacaaaacttggcgcaaaaattctttaaaaaccgtttcccccggggggagattttcctttcccaaaaaagagggcacaaaaggggagacaagagggccccttaaaaatcacaccggggttgttgagacgccctccttaaccccccccgaagaaaagcggggctgtaataattttgcacaaaaaaaaaaagagagcttctctcaaaaaaaaattttgggggtgttgtgatataaaaaaaaaatttctttcccctcggaggggtaaaaaaaaaaggg

SEQ ID NO: 73393 - protein, 56 aa, Zea mays
  misc_feature: Ceres CLONE 1557724
  misc_feature (1)..(57): Pfam Name: Ribosomal_S6e Pfam Description: Ribosomal protein S6e
MKFNIANPSTGCQKKLEIDDDQKLRAFYDRRISQEVSGDALGEEFKGYVFRSWGGR

SEQ ID NO: 73394 - DNA, 860 bp, Zea mays
  misc_feature: Ceres CLONE 1557727
  misc_feature: Translation starting site: 155
  misc_feature (535)..(535): n is a, c, t, g, unknown, or other
  misc_feature (538)..(538): n is a, c, t, g, unknown, or other
  misc_feature (590)..(590): n is a, c, t, g, unknown, or other
  misc_feature (591)..(591): n is a, c, t, g, unknown, or other
ctccccgcggtggcggccgctctagaactagtggatcccccgggctgcaggaattcgtctcacccctagaaaaaatcagaaactagtcctctacttgctaggaggtgcttacacacccgaaaacctgcccccgccgccttggcctcacgtcacgatgtcttgcacggtgaccatcccgaactcgccagtcttctcgccttcacgccgcccgctgtcctgcaaggccgctcccgcgtcgccggagcccgccgtcgccgtctccgcctcttccgcggcgcccgcgcccgccgccgccggctcgccgctccgccccttcgcgctccgcgcgctgctccgggaggaggtattcccgtctccatcgccccagctggcctctgccgcagcggtggcctcggtaccaagcggggccgtgctgaagcggcggcgacctgcgccgctccttgtgccggcgtccggcgcggctgctgctgctgcggtggctgccgtggaggcagatccgacgaacgaggtggagaggaaggggggaaggagttcncancgtactgccagagggggaaggggaggagaagggtggaaaatggaggaacggnntgtgggcgagggcgctctcggcggaaatccccaagtggcgctctttggtggattcgatggtcacggggggcaaaaatgcggcacagttcgctgcggaaaacatgcccaagtttttgggcgaagaattcaaaaaagtgaacggcggaaggaaagaacaaaggagctgtcaaaaggggttccctcaggacgtgcgaagagttccttaaaagggaaaaaaactggggcgcgggccgcggcaacacaattctccaaaagggggggtggggcaa

SEQ ID NO: 73395 - DNA, 837 bp, Zea mays
  misc_feature: Ceres CLONE 1557728
  misc_feature: Encodes the peptide sequence at SEQ ID NO. 73396
  misc_feature (84)..(84): n is a, c, t, g, unknown, or other
ggagctcaccgcggtggcggccgctctagaactagtggatcccccgggctgcaggaattcgtctcacccctagaaaaagtcccncttcgtcctctactctcggctcctcgcagtcgctcactgcgtgcgccaaaagcagcagcagctccagccgtcgccgtctccactctccagtctccagcactgctccgcgcgcgccggatcgagggagggcaggcggacgaggaggagagatgagtctcttcgggcttggacgaaaccagaagacattccgccccaagaagagcgctccatcaggtagcaagggagcacagctccgaaagcacatagatgccactctcggcagtggaaaccttagggaagctgtgaggttgcctcctggagaggatatcaatgaatggcttgcggtgaatactgtggatttctttaaccaagttaatatgctgtatggcacactcacagaattttgcacacctgagagctgtccgacaatgacagctgggcccaaagtacgagtacagatgggctgaaggtgtgcaaataaaaaaacccataaaggtatcagcacccaaaatttggtggagatcccggatggattgggattgaaggcccacctggaagatgaaatccatattttcccccaaaacttggggaaggccattttcccaccgaaatttcagggaaagggggtaaataaaaaattttcacaccgaattggttccgggggcctttggccccaaaaccttcacacttccccattttttccaaaaaaaaattgttttacccccttaaaaaaagagaaggcccaccctcccaaaaacccggggttataaaaaa

SEQ ID NO: 73396 - protein, 98 aa, Zea mays
  misc_feature: Ceres CLONE 1557728
  misc_feature (29)..(96): Pfam Name: Mob1_phocein Pfam Description: Mob1/phocein family
MSLFGLGRNQKTFRPKKSAPSGSKGAQLRKHIDATLGSGNLREAVRLPPGEDINEWLAVNTVDFFNQVNMLYGTLTEFCTPESCPTMTAGPKVRVQMG

SEQ ID NO: 73397 - DNA, 576 bp, Zea mays
  misc_feature: Ceres CLONE 1557733
  misc_feature (470)..(470): n is a, c, t, g, unknown, or other
ctggactccccgcgtggcggccgctctgaactgtggatcccccgggctgcaggaattcgtctcacccctagaaaaaatccccgccccgggcaccgcgagctagctagctactgacacccggcgccggcgccgagtacaatacaaggaaagcagcatggtgttcgagcagcatgaggaggagcggtggcgccgggcgcggtgcacgggcaccggctctccacggtggtgccgagctcggtgacgggggaggtggactacgcgcctggccggacgccggaccctggcctttcaaaggctggcccttacccttggccccgggggggtggtaacttaaacttccccggggttccccggggggaaaaggggccctttttgcccccacccccaaaaggggggggcccccccaaaagggggggacccccccccccttgtttttttcccccccccctggggggccccttggggggggnaaaaaaaacccccccccttttttttttcccccccccccccttggtgggggggcccccccggggggggccccccccccccgctttttttccccccccccgccccccc

SEQ ID NO: 73398 - DNA, 840 bp, Zea mays
  misc_feature: Ceres CLONE 1557734
  misc_feature: Encodes the peptide sequence at SEQ ID NO. 73399
ctccccgcggtggcggccgctctagaactagtggatcccccgggctgcaggaattcgtctcacccctagaaaaagacgcccccaccactctctcgacccaaagccagatcggcacgacgagcagaggcccccccccggagcggcgcggagcaatggcggcgggataccgggcggaggacgactacgactacctcttcaaggtggtactgatcggcgactccggcgtcggcaagtccaatctgctctcacgcttcacgcgcaacgagttcagccttgagtccaagtccaccatcggcgtcgagttcgccacccgctctctccaggtcgacggcaaggttgtcaaggcccagatttgggacactgccggccaggaacgatatcgtgctattactagtgcatattatcgaggtgctgttggggcgttgcttgtatatgacgtcactcgtcactcaacctttgagaacgttgagcgttggctgaaggagttgagggaccacacagatcccaatatagttgttatgctggttggcaacaaatctgatctccgccatcttgtagcagttcaaactgatgaaggaaaagcattcgcagagagggagtcattgtatttcatggagacctctgcactcgagtcgactaacgttgaaaatgcattcgcagaggtcttaactcagatctaccgtattgtgagcaagagagcagttgaagcaggcgaagatgcagcatctggggctggcaggggcgagaagattacataaagggatgatgttcggcggtggagaaaggtggctgctgctctagctgagctgccctgctgtatttttttgaggttggggggag

SEQ ID NO: 73399 - protein, 201 aa, Zea mays
  misc_feature: Ceres CLONE 1557734
  misc_feature (16)..(177): Pfam Name: Ras Pfam Description: Ras family
  misc_feature (16)..(130): Pfam Name: Miro Pfam Description: Miro-like protein
  misc_feature: SWISSPROT Homolog: EC 2.7.11.1 Non-specific serine/threonine protein kinase
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHSTFENVERWLKELRDHTDPNIVVMLVGNKSDLRHLVAVQTDEGKAFAERESLYFMETSALESTNVENAFAEVLTQIYRIVSKRAVEAGEDAASGAGRGEKIT

SEQ ID NO: 73400 - DNA, 779 bp, Zea mays
  misc_feature: Ceres CLONE 1557736
  misc_feature: Translation starting site: 123
ctccccgcggtggcggccgctctagaactagtggatcccccgggctgcaggaattcgtctcacccctagaaaaagctccctccaacggacttgaccactaaaagctaagcacacccccggccatggggctcgcgtccacctccgccaccgcgcccgctgccgtgctcaagaccccattcctcggtgccaggggcgcgctcgccaatgccgccgcgcccaagcccgcgccgcgccacgcgctcctcgccgtcgccgcggccgccgccaagaagtcgtggatccacgacttcaagagcgacgccgagttcatcaacccgccctgactcgaaggatcactccctggcgacttcgggttcgatccgctggggctgggcaaggacccggagttcctcaagtggtatcgggaagcggagctgatccacgggcggtgggcgatggctgccgtgctgggcatcttcgtggggcaggcctggagcggacatcccgtggttcgaggccggcgccgacccgggcgccatcgcgcccttctccttcagctcgctgctgggcacgcagctgctgctcatggggctgggtagagtcaaagcggtgggtggacttcttcaaccaggactcgcagtccgtcgagtgggccacgccatggtcccgcactgccgaagacttcgacaacttcaacggcgaccagcgctacccgggcggcaagttcttcgacccgctcggcctcgacggcaacggcaaggacagcgtctacgtccccgacgtcgagaagctcgagcggc

SEQ ID NO: 73401 - DNA, 815 bp, Zea mays
  misc_feature: Ceres CLONE 1557738
  misc_feature: Translation starting site: 161
  misc_feature (655)..(655): n is a, c, t, g, unknown, or other
  misc_feature (760)..(760): n is a, c, t, g, unknown, or other
ctggagctccccgcggtggcggccgctctagaactagtggatcccccgggctgcaggaattcgtctcacccctagaaaaaaaagctcccgcacaccctgcctgatccctcccaataagctccccagctccacgccggacgcagcagcagcagcagtagagatggccgccctcgccgcctcctccacggccgccttcgccgccaagccgcgcctcccacgcgcgcgcctcaccgtggcctgctccgccaccggcggcgacggcaacggcagcagcagcagtgtgtcgctcgcatcctccgtgaagacgttctcggccgcgctggctctgtcgtcggtgcttctctcctcggccgccacctcccctccccccgcggccgctgacatcgcggggctgaccccgtgcaaggagtccaaggcgttcgccaagcgcgagaagaactcgatcaagaagctcaccgcgtcgctcaagaagtacgcgcccgacagcgccccggccctcgccatcaacgccaccatcgagaagacaaagcggcggttcgacaactacggcaagttcggcctgctctgcggcgccgacggcctgccgcacctcatcgtcagcggcgaccagcggcactgggggcgagttcgtcaccccgggcctgctcttcctctncatcgccggggtggatcggggtggggtcggcaggagctacctcatcgccatcagcggcgagaagagcccgcccttgagggagatcatcatcgacgtcgagctcgncacccgccctcttcccagggggttcatctggccccgtcgcggcgctacgcgagca

SEQ ID NO: 73402 - DNA, 837 bp, Zea mays
  misc_feature: Ceres CLONE 1557741
  misc_feature: Encodes the peptide sequence at SEQ ID NO. 73403
ctccccgcggtggcggccgctctagaactagtggatcccccgggctgcaggaattcgtctcacccctagaaaaacttcccttcccctcccttttttcctccgaatcccgctcgcgaaccctagccagcctccgcgagatggacgacgactgggagctcctcctcgcgtcccccaaggcggcctcggcggccgagccgttcgctggaggcggggaggacgacgccggcgccatcaagcacgactacttcgacctcggctccgacgccaagtatccccggagggcgtcgctgtcgacgggggacgaggaggagggcgtggaggaggggcttctcagggcgtcggacaacgcgagctgggtggagccggaccctgacgaccttctcttccccggccgcgaccgcgcggcgctgtggtcggactcgtcctccgacggggagaggcccgaggtcgaggccaccgatcccgtggggcgggccagggaggagggcggggtgatggcggccgcggctgatggggtggagggggccgtggcgaagggaggagaacacgtccggtggtggaagctgccgctcgacgcgctgcgtgtttgggcgatgcgcgcggcgaggagcgcctggtcggtgccgttcgccgtcgcgctgctcggattcgctgtgctcgggcgccggctgtacaggatgcgccgccagagcaaggccgccgcgcgcgtccgcctcgtattcgacgaaaagaaggcctcccaattcaggggcaatcgtcacgtctggatgaatctccgaccatgatgcgcccaaactctttcataaaacccatgcttcctggccatggagtgactcc

SEQ ID NO: 73403 - protein, 215 aa, Zea mays
  misc_feature: Ceres CLONE 1557741
MDDDWELLLASPKAASAAEPFAGGGEDDAGAIKHDYFDLGSDAKYPRRASLSTGDEEEGVEEGLLRASDNASWVEPDPDDLLFPGRDRAALWSDSSSDGERPEVEATDPVGRAREEGGVMAAAADGVEGAVAKGGEHVRWWKLPLDALRVWAMRAARSAWSVPFAVALLGFAVLGRRLYRMRRQSKAAARVRLVFDEKKASQFRGNRHVWMNLRP

SEQ ID NO: 73404 - DNA, 731 bp, Zea mays
  misc_feature: Ceres CLONE 1557743
  misc_feature (384)..(384): n is a, c, t, g, unknown, or other
  misc_feature (731)..(731): n is a, c, t, g, unknown, or other
ctccccgcggtggcggccgctctagaactagtggatcccccgggctgcaggaattcgtctcacccctagaaaaagttctcccggggctcctccgtccgtaaggctaaggcaccgccgccgcgtctcggctggaccgacaggccggccgatccgtctcctcctcctcctcctcctgcggctgtgcaggtcggcttcagggacgatggcggcgagggcggctgatgagaacagaagggccggggggtgggggaggccccccgccatgccttaaaaaatgggggaagcccgggggccccccctctcccgggggaatttttttaaaaaaccccccccccggggggggttttcccccccaaaaacaccccctgggggggtttgtgattngcccaaaaaaaaaaaacccccccgggtgggttggtttttaaaaaaaaaaaaaaaggtatttttgaaagaaggggggggggggggcaccccccaacatatagatgttagagggatggcgtctttgggttttgttttttttttgctcccccccaccaacaaagaaaatattccgctggggggggggggtgtttgttattatattaaaacatattgggggaggggggggggaaaaaaaaaataaaatttttaggttgtgggggtggggaacacccccccccccctccttttttttttgggggggggggggctccggagcaaaagtggtgaggggggggtggggcgtctcn

SEQ ID NO: 73405 - DNA, 728 bp, Zea mays
  misc_feature: Ceres CLONE 1557745
  misc_feature: Encodes the peptide sequence at SEQ ID NO. 73406
  misc_feature (474)..(474): n is a, c, t, g, unknown, or other
ctccccgcggtggcggccgctctagaactagtggatcccccgggctgcaggaattcgtctcacccctagaaaaaaccggtcccgagggctatcgaacgtaactaccgtcctctgtctcggcgtcggcgagcaacagaacagacagaggaggggaggcgaggcgaggcggaaatggggctccgcgtccgcgcttcctcgcttctgctatccctcgccatcgagctcgcggccgtgctcgtctcagtgtcggcgcagcagaagttcgggatcaactacgggcagatcgcgaacaatctcccggacccgacgcaggtggcgaccctcctccgatcgatgaacgtgaacaaggtgaagctctacgacgcggacccccgggtgctgacggcgttcgcgaacacgggcgtggagttcatcatcgccgtgggcaacgagaacctgcagaccatggccggcagccccgccccggcgcggcantgggtgggcgcgaacgtgcggccctacatcccggccacgcgcatcacctgcgtcccgtggggcaaagaagttcttcttcgggaaacaaacacgggccacaatggcccagccctccttccccggcttttgaagggccgtcccccccgcgggcccttccggggaccttggggccccccggggggggccagggcccccccgttttttttgtggggggccccatctctcgcggggaaaaatgtgttttctcccccccc

SEQ ID NO: 73406 - protein, 185 aa, Zea mays
  misc_feature: Ceres CLONE 1557745
  misc_feature: SWISSPROT Homolog: EC 3.2.1.39 Glucan endo-1,3-beta-D-glucosidase
  misc_feature (101)..(101): Xaa is any aa, unknown, or other
MGLRVRASSLLLSLAIELAAVLVSVSAQQKFGINYGQIANNLPDPTQVATLLRSMNVNKVKLYDADPRVLTAFANTGVEFIIAVGNENLQTMAGSPAPARXWVGANVRPYIPATRITCVPWGKEVLLRETNTGHNGPALLPRLLKGRPPRGPFRGPWGPPGGARAPPFFLWGAPSLAGKNVFSPP

SEQ ID NO: 73407 - DNA, 849 bp, Zea mays
  misc_feature: Ceres CLONE 1557747
  misc_feature: Encodes the peptide sequence at SEQ ID NO. 73408
  misc_feature (577)..(577): n is a, c, t, g, unknown, or other
  misc_feature (797)..(797): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
ctccccgcggtggcggccgctctagaactagtggatcccccgggctgcaggaattcgtctcacccctagaaaaaacagatctctctcggccccgtgcccagcgctccgaaaccctagcgccgccgcgggtgccaggccgcgagcgtcgccatgggcatcgtgtttacgcggctcttctcgtcggtcttcggcaaccgcgaggctcgcatcctcgtcctcggcctggacaatgctggcaagaccaccatactctatagactgcaaatgggagaggtcgtctccacgatcccgacaattggattcaacgtcgagacggtgcagtacaacaacatcaagttccaagtatgggatcttggtggtcaaacaagcatcaggccatactggcggtgctactttccaaacactcaggctatcatatatgttgttgattcaagcgatacagataggcttgtaacagcaaaagaagaattccatgccatccttgaggaggatgaacttaaaggtgcagttgttccttgtgtatgcaaataagcaggatcttccaggtgcactcgatgatgctgccattacagagtcnttagaactacacaaaattaggagccgtcaatgggcgattttcaaacatcctgccattaaagggagaggggctcctttcgaaggtttggactggctcaataaccacgctcaaatctggaagccgcctaggagcctcccgcctcgtcatggaatcatttggctggaggctaaaaaataaaccaaaatttttgaaaattacgccccaaaaatctccatttttnttcnnnnnnttttttttttaaccccaagtttaccccnnnnncgcgcctaatc

SEQ ID NO: 73408 - protein, 126 aa, Zea mays
  misc_feature: Ceres CLONE 1557747
  misc_feature (5)..(126): Pfam Name: Arf Pfam Description: ADP-ribosylation factor family
MGIVFTRLFSSVFGNREARILVLGLDNAGKTTILYRLQMGEVVSTIPTIGFNVETVQYNNIKFQVWDLGGQTSIRPYWRCYFPNTQAIIYVVDSSDTDRLVTAKEEFHAILEEDELKGAVVPCVCK

SEQ ID NO: 73409 - DNA, 837 bp, Zea mays
  misc_feature: Ceres CLONE 1557749
  misc_feature: Encodes the peptide sequence at SEQ ID NO. 73410
agctccccgcggtggcggccgctctagaactagtggatcccccgggctgcaggaattcgtctcacccctagaaaaaaagacggatcgagactacgacgccgatcctagctagctctcccgtttctgctcgcaagtcacacacagctccggtagatccgcccctcgcctctgggctccaggaagagattagcttcagacggcagggatcgatactagcaagcaagcatggcgcacgacttgtgcgaggacttggagctcgtcgccgacgacggcggcttcgatgactactactgggacgacgacttccatttccacgacgacgacggcttctccgcctcccctacgacccccgccagcgttggtgcgccccgccagcagcagcagcagcagcagatgggtgatatttcagcctcggactacaaagaaggcgaagacatgcaggggataccctgggaaaggctcaactacaccagggaccagtatcgtcggatgaggctcaaagagtacaagagctaccagaacctcacgaggtcgcacagcggcctacaacaacaggaacgcaaacaggtggagaggaaggacacattctacgattttcatctgagcacgagagcccgtcagtcaacgatagtgcattttccggtcaaccacaagcagtggcaggacgtttgggtgtgcgctatctgcagtagtcttgagtgaactagctgcattttatccgatcgatcagtggatgggctcctccccaccgggaggatgactcccgcagggggttgaaggcttcatattgtatggaggactttcgaaaggacaaacctttgaacgggaccccttgat

SEQ ID NO: 73410 - protein, 158 aa, Zea mays
  misc_feature: Ceres CLONE 1557749
MAHDLCEDLELVADDGGFDDYYWDDDFHFHDDDGFSASPTTPASVGAPRQQQQQQQMGDISASDYKEGEDMQGIPWERLNYTRDQYRRMRLKEYKSYQNLTRSHSGLQQQERKQVERKDTFYDFHLSTRARQSTIVHFPVNHKQWQDVWVCAICSSLE

SEQ ID NO: 73411 - DNA, 863 bp, Zea mays
  misc_feature: Ceres CLONE 1557751
  misc_feature: Encodes the peptide sequence at SEQ ID NO. 73412
  misc_feature (627)..(627): n is a, c, t, g, unknown, or other
  misc_feature (664)..(664): n is a, c, t, g, unknown, or other
  misc_feature (714)..(714): n is a, c, t, g, unknown, or other
  misc_feature (728)..(728): n is a, c, t, g, unknown, or other
  misc_feature (744)..(744): n is a, c, t, g, unknown, or other
  misc_feature (758)..(758): n is a, c, t, g, unknown, or other
  misc_feature (759)..(759): n is a, c, t, g, unknown, or other
ctccccgcggtggcggccgctctagaactagtggatcccccgggctgcaggaattcgtctcacccctagaaaaagtccttcgcgcttcttcgccagctcgtccttcgcgcttcttcgccagccgtcggcgagagagggtgagaggatcctacgtgccttgtacgctcgctcgggagccggccgggatcgcgccgcgccaccgtaccccgccccggacatgtgcgtggaggggctggacgacgcagcagggaggctcggcttcggagaccaggagaccgacaggcgcgccggtgatgcgatggagagagtttgtgagaacacagtggctgttgacttcaagcagactaagctgaacaactttgtgccattcatccggtcaggggaatggtctgatattggaggtcgcgattacatggaagatgcccatgtgtgcatctctgatctggcaaagaattttggctatgactcagtcgaagatgaagtaatttctttctatggggtgtttgatggccataatggcaaagatgctgctcattatgtccgtgataacttgccacgggtcatcgtggaagacgctgattttcctcttgagcttgaaaaggtagtaaagaggtcatttgtgcaaanctgatagtaagtttgcagagaaattctctcaccacanggggactttcttctggaacgacagcacttacagcaatgattttttggaanggtccccttctggntgcgaatgccggtganctgcagagcggtgnnctctcgcgcgtggcactgcccattgagatgtccaaagaccacaggcctttgctgcatgaatgaaaagaagcgcgtagagtcactttggcggctaccttggacga

SEQ ID NO: 73412 - protein, 136 aa, Zea mays
  misc_feature: Ceres CLONE 1557751
  misc_feature: SWISSPROT Homolog: EC 3.1.3.16 Phosphoprotein phosphatase
MCVEGLDDAAGRLGFGDQETDRRAGDAMERVCENTVAVDFKQTKLNNFVPFIRSGEWSDIGGRDYMEDAHVCISDLAKNFGYDSVEDEVISFYGVFDGHNGKDAAHYVRDNLPRVIVEDADFPLELEKVVKRSFVQ

SEQ ID NO: 73413 - DNA, 826 bp, Zea mays
  misc_feature: Ceres CLONE 1557752
  misc_feature: Translation starting site: 385
  misc_feature: SWISSPROT Homolog: EC 3.1.1.29 Aminoacyl-tRNA hydrolase
ctggagctccccgcggtggcggccgctctagaactagtggatcccccgggctgcaggaattcgtctcacccctagaaaaattttcctcgtccttctccccgatactaccatgggtatttgtgggtcttggcaaccctggtgagaaggtcagtccaccaagcacaacgagggttttggatatgatagatgcttttgctcaatcccaaggtatacccctgactacaccttaattcaaagcactctttggtgaaggaatggttgatggagtccctgttcttcttgccaagccacagacttatatgattctcaatgtagaatctgtcgagcccgcttgctgcctattataaactgccacttaatcctgtcctagtggcgtttgataacatgcacttgccctgtggagttctccgtctcacgtcaaaaggaggttctggacaacacaatgggttgaagagtgttatatacctctttcataagaatccagaattctgccaagtaatgattggaattggaccgacagctggccagatgaatcctaaaggctttgttcgtcacaagttcaatatgactggtcatgaaccgatcgattcaaccgcgataaacggtgtccatattctcaagatcgtggctgccatgagtttgacacacgcggcaaaactgaccaatgcggatccagacctaaagcatctgacatcacatggtatcctgactaaccatgagtagaccaatcgtactcgggcgggctactcttctcagcacatcttctcctattcggacctaacaccaaactcgttttatgggctgttgaaaatcaagagttcgatga

SEQ ID NO: 73414 - DNA, 652 bp, Zea mays
  misc_feature: Ceres CLONE 1557756
  misc_feature: Encodes the peptide sequence at SEQ ID NO. 73415
  misc_feature (360)..(360): n is a, c, t, g, unknown, or other
  misc_feature (425)..(425): n is a, c, t, g, unknown, or other
ggagctccccgcggtggcggccgctctagaactagtggatcccccgggctgcaggaattcgtctcacccctagaaaaagacggcaatcaccattacatttgatccgccgcgcgcggcccgatcgacgagcgagagcctcattcacaccccgatctagctagctagctagtttacgaaaaaaaaatctggccacagggatgcggtggcggctgcagccggcgccggcgccgacgctgctcctcgtcctgctggtggccaccgtcgccgccgtcgtcgtggtggtgcgggcggagccccaggtgccgtgctacttcgtgttcggggactcgctcgtggacaacggcaacaacaacgacatcngcgtcgctggcgccgggccaactacccgccctacggcatcgacttcggccgccggcccccacggncgttttcaagcaatggccctccaccaccgttcaaaccccataatttttggggttttcgggggcgtttccaacaaattaaattccccccctaaaacccttgggccccaaaacggggaaaataaaagttccccccccccgggggggaaaaaaatttttttttttttccccccccaaaaacccgggggggaatttctccttgaaaaaaaaaaacaccccgcccccccccc

SEQ ID NO: 73415 - protein, 151 aa, Zea mays
  misc_feature: Ceres CLONE 1557756
  misc_feature (55)..(55): Xaa is any aa, unknown, or other
MRWRLQPAPAPTLLLVLLVATVAAVVVVVRAEPQVPCYFVFGDSLVDNGNNNDIXVAGAGPTTRPTASTSAAGPHGRFQAMALHHRSNPIIFGVFGGVSNKLNSPPKTLGPQNGENKSSPPPGGKKIFFFFPPQKPGGEFLLEKKKHPAPP

SEQ ID NO: 73416 - DNA, 792 bp, Zea mays
  misc_feature: Ceres CLONE 1557757
  misc_feature: Encodes the peptide sequence at SEQ ID NO. 73417
ctggagctccccgcggtggcggccgctctagaactagtggatcccccgggctgcaggaattcgtctcacccctagaaaaaatgtggtggatgcagttggaaatccattcattccttcgtcccccacctctcgctctatctccatctccatcccgcctcctcctcctcctcatgctgctgcggccactgccactataatagcccagctagctagaggccacccatcaagctgcccattccctcgtgacagcgcagctgcctgcctgctccgaggcgccacccagctcttcctcgccccagcagccgtttctcgagatccttttcactttcaccaccagggtacatagaccgcatctgcggtgctctgcgctcctcagactcgacttgttggttcatccatccagctgccgccggagcccggaggtcgatcagctacctatcttggctagcttggctgttctctctgcaggcagttgccatcgtgtctgatcatactaatattctgtccagatcccaaggaggcaaaggaccgagcgtggaagctcccggaccggacattccattttccgttccgaagggggggtgagaaggcgggggaatgagtacaaccaaggtgaagagacgtgtgggcaagtatgagctcggccggaccataggcgaaggcaccttcgcgaaggtcaggttcgcgagggacacggtcaccggcgaggccgtggccattaagatcctggacaaggagaaggtcctcaagcacaagatggttgagcagatcaagcgggagatctcgacgata

SEQ ID NO: 73417 - protein, 65 aa, Zea mays
  misc_feature: Ceres CLONE 1557757
  misc_feature: SWISSPROT Homolog: EC 2.7.11.1 Non-specific serine/threonine protein kinase
MSTTKVKRRVGKYELGRTIGEGTFAKVRFARDTVTGEAVAIKILDKEKVLKHKMVEQIKREISTI

SEQ ID NO: 73418 - DNA, 873 bp, Zea mays
  misc_feature: Ceres CLONE 1557758
  misc_feature: Encodes the peptide sequence at SEQ ID NO. 73419
  misc_feature (391)..(391): n is a, c, t, g, unknown, or other
  misc_feature (424)..(424): n is a, c, t, g, unknown, or other
ctccccgcggtggcggccgctctagaactagtggatcccccgggctgcaggaattcgtctcacccctagaaaaaacctcgcacttatcggtgaaaccgcgcgatgactacggcggcgcccgcgctgcccatgttcctccggctgtgcccggcctcgcccttcctcctcccccccagcctacacgtccccagctcaaggcgccccactccgtcgcgcctgagctcttttcgccctgcaaggccactcttccccatctcagctgtggagaaaaccaacgaggctgctgcggctggggagggtgagctcgaggggatgccgcccgagttctacgacgagaagcaactgtattctcagcaaccatacaaacatacacttccacttccacatgcangactggcaggcccgtcagcgggagaggactaangagtggcatgcatatcggcagaaagaagaggccgaggaggaaagaataacaaatgagtaccgagagataggcatgcgcctgaaagcttatccgcaagaaagaagtcgcaaagctaggattttagttttcagtttcataagagctggttgaagatgttgaggaagaaaatttagaaggctgcctgaaagaggagagcctactgaaccttgtcttaatgggcatccggaaatcgactttaaatttgctccgcctgataaataaccggatgccatcaaaaagctttgatctctttgtaatgaaagggtaaaaacagagaattcttaagagggaaaccaactccgggccatgaaatggccccacggaccttcctaaaacctccttgaatggagggacaaattagaaaatgggttaaaaaaaatttaaaaagccccttgctttgaaatcttttc

SEQ ID NO: 73419 - protein, 62 aa, Zea mays
  misc_feature: Ceres CLONE 1557758
  misc_feature (2)..(2): Xaa is any aa, unknown, or other
  misc_feature (13)..(13): Xaa is any aa, unknown, or other
MXDWQARQRERTXEWHAYRQKEEAEEERITNEYREIGMRLKAYPQERSRKARILVFSFIRAG

SEQ ID NO: 73420 - DNA, 809 bp, Zea mays
  misc_feature: Ceres CLONE 1557759
  misc_feature: Encodes the peptide sequence at SEQ ID NO. 73421
  misc_feature (515)..(515): n is a, c, t, g, unknown, or other
  misc_feature (547)..(547): n is a, c, t, g, unknown, or other
ctggagctccccgcggtggcggccgctctagaactagtggatcccccgggctgcaggaattcgtctcacccctagaaaaagccaaactccgtttcgaattctagggttttgctgctctccgaccccgagctccgaaggccgcagcatcaggcgaggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaagggcttacttacagaaatgtcctacgtggcatagggatctgtgcanggtctgtgaaaacatccccattgtcctctgcngtaataagggttgatgttgaagaacaggcaggtcaaagccaagcagggtacttttccccggaaaaaagaaccggcagtcctttgaaatttcttgccaaaagcaactacaacttgaaaaaaactttcccgttcctttgcaaaggaaattggctggggaatcccaaaccttcacttgtttgaaaagggtgggcctttaaaccccccgggaatttcccctcccaaattggtgttttccccccccccccctttgacccccaatctt

SEQ ID NO: 73421 - protein, 127 aa, Zea mays
  misc_feature: Ceres CLONE 1557759
  misc_feature (15)..(128): Pfam Name: Ras Pfam Description: Ras family
  misc_feature (113)..(113): Xaa is any aa, unknown, or other
  misc_feature (124)..(124): Xaa is any aa, unknown, or other
MALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRAYLQKCPTWHRDLCXVCENIPIVLCXNKG

SEQ ID NO: 73422 - DNA, 817 bp, Zea mays
  misc_feature: Ceres CLONE 1557760
  misc_feature: Encodes the peptide sequence at SEQ ID NO. 73423
ctccccgcggtggcggccgctctagaactagtggatcccccgggctgcaggaattcgtctcacccctagaaaaaatcagcctcatcaacctcgacgaaggaggaacgaacggacaggttgttgcacagaagcgacatggctttcgcgcccaaaacgtcctcctcctcctcgctgtcctcggcgttgcaggcagctcagtcgccgccgctgctcctgaggcggatgtcgtcgaccgcaacaccgagacggaggtacgacgcggccgtcgtcgtcactaccaccaccactggctagagctgcggcggctgctgtcacggttcctgccgccccgccgcaggcgccggcgccggcgccggtgcccacaaaagcagcggcggcacctgcccgagaggaaggagccgtccggtgtcggacaaccatggcgggcgctcatgggccaaggggcaagacggcgtttcatcccgtaaaattaaccggccggggcgaaacccgggaaacctaaggcaaaaaaaaagggcccgaaagagggccctttcctttttttctttgggaaaagggttttttgggggccccccaaaatttttttttttgaaggtgtggggggggggggaacccccctggttgttttgggaggcccccccccaaaaatatgaggggggggggccaatatatatacaaaaagggttttttgggtggggggcggggggttttttttgggtcccccggggccccccaccccccattgtggaaccccccccggtgggggaggaaaaaaaaattctcccccgggggggggggggtggaggaaccccccccc

SEQ ID NO: 73423 - protein, 52 aa, Zea mays
  misc_feature: Ceres CLONE 1557760
MAFAPKTSSSSSLSSALQAAQSPPLLLRRMSSTATPRRRYDAAVVVTTTTTG

SEQ ID NO: 73424 - DNA, 784 bp, Zea mays
  misc_feature: Ceres CLONE 1557761
  misc_feature: Translation starting site: 94
  misc_feature (555)..(555): n is a, c, t, g, unknown, or other
ctggagctccccgcggtggcggccgctctagaactagtggatcccccgggctgcaggaattcgtctcacccctagaaaaagagtacctgagaaatggcggccgtctcctccacctccaccgcctcctcctacttctcctcgcagccgcagctgccgatctccaccgccgaccctgccgccagcaaaagtaggttgatgcggcagccacggcggagcagcagcttcgtgatgatggaggcgtcctctgccagcggcagcgacggcggggtggccaggacgaagagcctcacggaggacgacctggaggagctcaagggctgcctcgacctcggcttcggattcgcgtacagcgagatacccgagctctgcgggacgctgcccgcgctcgaactctgctactccatgacccggaggttcctcgacgagcagaaggcgccggggcaggaggaggagttggagcctgcgtcgccgccgctccccaattggaggatctctggcccggggtgacgatccagaagaagtgaaggcgaggttgaagtattgggctcaagctgntgcatgcactgtcaagctctgcagctaaactaaaagtcggatagaggctgaagaatctggttatatggtttttgggatacagggagcggaaagggggtgcttctgctctctggcatggaagcgacatgagggatctcctctgctctacaaaaaaacctgggaagggggaaggaacctgatccggaaacagcaacgaaccccgattcaaaatttggaaaaccgtggcccg

SEQ ID NO: 73425 - DNA, 841 bp, Zea mays
  misc_feature: Ceres CLONE 1557762
  misc_feature: Encodes the peptide sequence at SEQ ID NO. 73426
  misc_feature (822)..(822): n is a, c, t, g, unknown, or other
ctccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccggaccctgtcgcaccacgaggcgccgtcaacgagtcgggttgtttgggaatgcagcccaaatcgggcggtaaactccgtccaaggctaaatacaggcgagagaccgatagcgaacaagactcctgcagtccttctccacctagctcccccgcgccaagaacacgccagctagcaagcgcgctcgatcgaataccgttaccgtgtcgccatggccgccaccgcgtctctatcagccgtcggggcgccgctgtcggtgcccgggctcaggaagccgctcggcgtgtcgtcgctccggcccctgcagccgagggcggcgaggatgacgacgacggccgtgcgggcgtcggcgtcgccctcgtccacgtccatcaaggagaaggctgcggccgggctgaccgcggcggccctggcggccgcgctggtgctgccggacgtcgcggaggccgcgcagtccggcgggctcacgcgtcgctcaagaactcctcctcacatcgtgtcccggtgggtcgtgctccntgggaattgtccgcgcccc

SEQ ID NO: 73426 - protein, 109 aa, Zea mays
  misc_feature: Ceres CLONE 1557762
  misc_feature (103)..(103): Xaa is any aa, unknown, or other
MAATASLSAVGAPLSVPGLRKPLGVSSLRPLQPRAARMTTTAVRASASPSSTSIKEKAAAGLTAAALAAALVLPDVAEAAQSGGLTRRSRTPPHIVSRWVVLXGNCPRP

SEQ ID NO: 73427 - DNA, 847 bp, Zea mays
  misc_feature: Ceres CLONE 1557763
  misc_feature: Encodes the peptide sequence at SEQ ID NO. 73428
ccccgcggtggcggccgctctagaactagtggatcccccgggctgcaggaattcgtctcacccctagaaaaaacctgcaccacagtagctagctagctatctttgctacggcggctctgtaatctggtccactagcgctccattcgaccccacccacagccatggctgccgtgaccgcggcggccgtctctctgccctcctcctcctcctcccctgccgccgccaaggccaaggcgtccgcatccgcgtccccgtcgtctccatgcggccacctccagttcccgcggcggcacggcggcccgcgcgacggtgcggctgcgcgtgcaggtgtccaccaccaagaccgctgaggcggagccagtcaagaagctggagaaggtgtccaaaaatcacgaagaggggctcgtcaccaacaagtacagagcccgaggagccgtacatcgggaggtgcctgcacaacaccaggatcaccggcaaccaaacgcccggggagacgtagcacatggtcttcaccacagaaggcgaggtcttctacagagagggccagtccatcggcatcatcacggatggctaggacaagaacggcaagccgcacaagctcatgctctactccatcgccagcagcgccctcggagatttcggccactccaagactgtgacgctgagcatgaagacgctggactacaccaacgatcaggcggaggtcgtcaaaggagtctgctcgaactatctctgtgactagaaactacgcgcttcagtgaagatcacacgtccagagggtcaacgagatgctcatgccctaagacctccacgcaagcatcatcaagcttcgcaccggtacctggct

SEQ ID NO: 73428 - protein, 46 aa, Zea mays
  misc_feature: Ceres CLONE 1557763
  misc_feature: SWISSPROT Homolog: EC 1.18.1.2 Ferredoxin--NADP(+) reductase
MLYSIASSALGDFGHSKTVTLSMKTLDYTNDQAEVVKGVCSNYLCD

SEQ ID NO: 73429 - DNA, 866 bp, Zea mays
  misc_feature: Ceres CLONE 1557765
  misc_feature: Encodes the peptide sequence at SEQ ID NO. 73430
  misc_feature (770)..(770): n is a, c, t, g, unknown, or other
  misc_feature (772)..(772): n is a, c, t, g, unknown, or other
  misc_feature (815)..(815): n is a, c, t, g, unknown, or other
aaagctggagctccccgcggtggcggccgctctagaactagtggatcccccgggctgcaggaattcgtctcacccctagaaaaatgctcttatcctatcctgcttttcttcgcttctctcttccccgctctctcattcttctcatacaagtctgttgttggagggacacacgtatccagcccaccaaagatttactcaatttatcccagacgagacacacactcgcaacgaccggaccgtcgaatctcgcgactccggcgacatgtcgacggcggtggcagaggtgcggccgccctacgggttccccggatccgggaaggggagcggcggcgggtatgggaaggaggcgcacttggccgcggccgggaagaggaggagcgacggcttcttcatagaggaggaggaggttgaagaagacgtgctgactgacaactcgtcgatcggggcgccgtctccctcgggatcgtcgatcggtgagaactcgtcgtcggaggccggcggggacgacggggaggaggaggtcgagagcaagctcaaggagggtgatgtgctcggctgcttggacgcgctcgaggactccttgccgatcaagaagggcctctcgagcttctactccggcaagtctaagtcgttcaccagcctcgccgaggccacagcggcggcggcggcggtcaaagaggtgctggccaagccgggagagccctttcacaagcgcccgcgcattctggcccactggttccagaagagcctcctgcagctcgctgggcacngncacctacctgcctcagctcttggggccccgaccacgccctggnccaaaaggggacgagggcgagaaggacaacttccaccaacgagtgggagta

SEQ ID NO: 73430 - protein, 201 aa, Zea mays
  misc_feature: Ceres CLONE 1557765
  misc_feature (170)..(170): Xaa is any aa, unknown, or other
  misc_feature (185)..(185): Xaa is any aa, unknown, or other
MSTAVAEVRPPYGFPGSGKGSGGGYGKEAHLAAAGKRRSDGFFIEEEEVEEDVLTDNSSIGAPSPSGSSIGENSSSEAGGDDGEEEVESKLKEGDVLGCLDALEDSLPIKKGLSSFYSGKSKSFTSLAEATAAAAAVKEVLAKPGEPFHKRPRILAHWFQKSLLQLAGHXHLPASALGAPTTPWXKRGRGREGQLPPTSGS

SEQ ID NO: 73431 - DNA, 955 bp, Zea mays
  misc_feature: Ceres CLONE 1557767
  misc_feature: Encodes the peptide sequence at SEQ ID NO. 73432
atagctggagctccccgcggtggcggccgctctagaactagtggatcccccgggctgcaggaattcgtctcacccctagaaaaagcaggaccggtcactcggcagtcggcacgcaggctagcagcacagcagcagccagagccatcccctctcctcgctacgcttcgcttcctcggcgccgattcctcctcctcctcctccaccctcgtccgtcccgttccggcgcgcgagctcgcccgagatggcgaacgcgagatcgggtgtcgctgtgaacgatgagtgcatgctgaagtttggcgagctgcagtcgaagaggctgcaccgcttcataactttcaagatggacgacaagttcaaggagatagttgtggaccaggtcggggatcgcgctaccagctacgatgacttcacaaacagcctccctgagaaatgactgcgatacgcgatctatgatttcgactttgttactgcagaagatggtccagaagaacaagaatctctcataacctagggtccccatccctccgccaagggggaaaagcagaagcttttttggcagccccaaacccaaaatttcaaaaaggggccccaaggggatttcaggggtgaaacccccgggcgcccgaaaggggagggggaaaaccccccccccaaagaaaaacaaaggaaatggggcgacccctatgggcaccccccctccccgggggggtttttgtaaaaccccacctaggggggccccccccccccacaggggggggattgtggccccccctcttaaaaaacttgtgggcggcaaaaaaaaaacccttgggggaaatttgggggggtttttgcccccgccaaaaaaaaaaaccagggggtcccaaaaaaaaaaaagaaagggggggggggaaataagggggtctccccttttggtcccgcccaatttttgttaaaataagagaaggagagggcg

SEQ ID NO: 73432 - protein, 63 aa, Zea mays
  misc_feature: Ceres CLONE 1557767
MANARSGVAVNDECMLKFGELQSKRLHRFITFKMDDKFKEIVVDQVGDRATSYDDFTNSLPEK

SEQ ID NO: 73433 - DNA, 845 bp, Zea mays
  misc_feature: Ceres CLONE 1557768
  misc_feature: Encodes the peptide sequence at SEQ ID NO. 73434
  misc_feature (566)..(566): n is a, c, t, g, unknown, or other
  misc_feature (577)..(577): n is a, c, t, g, unknown, or other
agctccccgcggtggcggccgctctagaactagtggatcccccgggctgcaggaattcgtctcacccctagaaaaagacaacaccgcgcgcgcaatacacgggacacacgcagatccgagctaaccaccgcagatccgagattatccagccggagcgaccttttcttttttcttttacacagcgggacagagaaaggagtcaggcagccaaagccacccaccgcttttaccgatcggcgttgccgccaccgctagcattgtcggcttcagctccatccaaatccaccgccagcaagcaagccggcgccatgggtcctgccgatgaggagggagagggacgcggaggcggagctgaacctgccgccggggttccggttccaccccaccgacgacgagctggtggagcactacctgtgccgcaaggcggcggggcagcgcctccccgtgcccatcatcgccgaggtggacctgtacaggttcgacccctgggacctgccggagcgcgcgctcttcggggcccgcgagtggtacttcttcacgccagggaccgcaagtacccccacggntcccgcccaancgcgccgccggcaacgggtactggaagggcacccgggccgacaagcccgttccgccgcgcggccgcacgctcgggatcaggaaagcgctcgtctttctaccccggaaagcgccccgccggggtccagacggactgggatcttgcccaatacagggtttgccaaagccggccgggcccccccccccaaaaaaggggccccttaagggtgaaaaaacgggggccttttgcccgcttttacaacaaaaaaaacaaattgggaaaaaaaatc

SEQ ID NO: 73434 - protein, 152 aa, Zea mays
  misc_feature: Ceres CLONE 1557768
  misc_feature (13)..(108): Pfam Name: NAM Pfam Description: No apical meristem (NAM) protein
  misc_feature (82)..(82): Xaa is any aa, unknown, or other
  misc_feature (86)..(86): Xaa is any aa, unknown, or other
MRRERDAEAELNLPPGFRFHPTDDELVEHYLCRKAAGQRLPVPIIAEVDLYRFDPWDLPERALFGAREWYFFTPGTASTPTXPAQXRRRQRVLEGHPGRQARSAARPHARDQESARLSTPESAPPGSRRTGILPNTGFAKAGRAPPPKKGAP

SEQ ID NO: 73435 - DNA, 810 bp, Zea mays
  misc_feature: Ceres CLONE 1557769
  misc_feature: Encodes the peptide sequence at SEQ ID NO. 73436
  misc_feature (771)..(771): n is a, c, t, g, unknown, or other
aagctggagctccccgcggtggcggccgctctagaactagtggatcccccgggctgcaggaattcgtctcacccctagaaaaagaagcaaaagcaaccgtcgagcttgcaacgccttacgcctccacactcaacagtcatggtcgtcatgggcaaggagcagcaacaacacgaggaggaggaggtgcaagggaaggtcgtccaagaagaagtgcaagtcgttcaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagcggctgggcccggagctgcaggagatgcgcggcgggctgatccgcctctgcgccgacgccgaagcgctgctgggagcgcactactccgaactgctggcctctttcgacacccgctgggagcacctgtcgcctcttcccgaaaataaaaaactacttcctgtaaaccaactgggacacggcctgttgggcggaaatgtccggggcacaccccgggggggtggggcttttttggggtcgggggcccccccccggaaaaccctggggggtttgggggggccccaccttttgggggggccctttttaaaaaaaaaaaaattttggggagggggcaaaaaccaggggcgggggtcttgtgtggttcgnaaaaaagacgcccccccaagacccctggagttttttccc

SEQ ID NO: 73436 - protein, 224 aa, Zea mays
  misc_feature: Ceres CLONE 1557769
  misc_feature (39)..(219): Pfam Name: NAS Pfam Description: Nicotianamine synthase protein
  misc_feature: SWISSPROT Homolog: EC 2.5.1.43 Nicotianamine synthase
MVVMGKEQQQHEEEEVQGKVVQEEVQVVQETVVPVPSEEDKEAEAALVHKISSLAAAIAKLPSLSPSPEVNALFTELVTACIPRSSVDVERLGPELQEMRGGLIRLCADAEALLGAHYSELLASFDTRWEHLSPLPENKKLLPVNQLGHGLLGGNVRGTPRGGGAFLGSGAPPRKTLGGLGGPHLLGGPFLKKKKFWGGGKNQGRGSCVVRKKDAPPRPLEFFP

SEQ ID NO: 73437 - DNA, 842 bp, Zea mays
  misc_feature: Ceres CLONE 1557771
  misc_feature: Encodes the peptide sequence at SEQ ID NO. 73438
aaagctggagctccccgcggtggcggccgctctagaactagtggatcccccgggctgcaggaattcgtctcacccctagaaaaagactcattgccacattggcccctcaaccatcctccctccacagatctctccggggaggcagcaacagttatgtcatatcattgtcgcgtcctcgtccccgttccatttcattatccccccggagctggtgcgcgagtcggagctggtgcagggtcacccttcccctcggcctcaagagctctgcggttgccgcggccaagggcgtccgtggagaagcgggagcaggtggcggcgatggaagagcaaggcggccaggcggcgctcggatgggcggccagggacgactccggcgtcctctccccctacagcttctccagaagggttcctaaagacgacgatgtcacgatcaaggtgctctactgcgggatctgccacaccgacctgcacgtcatcaagaacgactggcgaaacgacatgtacccagttgtcccggggcacgagatcatgagcgtggtgaccggcgtcagcagcagcatcacgcagttcaaggccggcgacacagtcggcgtgagctacatcgtggggtcctgccgctcctgcgacagctgcggcaaaggggacgacaactactgcgcggggatcgtgctcactctcaacggcgtagaccacgcgcacggaggagcgcccaccaaggggggattctccgacgtgctggtcgcgagcgagcactacgtgctccacgtccccgacggactggcgctggaccacacagcgcctctgcatctgcgcggcggtcacgtgtacagacccatgatgcg

SEQ ID NO: 73438 - protein, 174 aa, Zea mays
  misc_feature: Ceres CLONE 1557771
  misc_feature (33)..(150): Pfam Name: ADH_N Pfam Description: Alcohol dehydrogenase GroES-like domain
  misc_feature: SWISSPROT Homolog: EC 1.1.1.255 Mannitol dehydrogenase
MEEQGGQAALGWAARDDSGVLSPYSFSRRVPKDDDVTIKVLYCGICHTDLHVIKNDWRNDMYPVVPGHEIMSVVTGVSSSITQFKAGDTVGVSYIVGSCRSCDSCGKGDDNYCAGIVLTLNGVDHAHGGAPTKGGFSDVLVASEHYVLHVPDGLALDHTAPLHLRGGHVYRPMM

SEQ ID NO: 73439 - DNA, 825 bp, Zea mays
  misc_feature: Ceres CLONE 1557772
  misc_feature: Encodes the peptide sequence at SEQ ID NO. 73440
  misc_feature (825)..(825): n is a, c, t, g, unknown, or other
ctggagctccccgcggtggcggccgctctagaactagtggatcccccgggctgcaggaattcgtctcacccctagaaaaaacatctcttttgccctaaatccacagcttccgctagattccgacgtttttgggcactcaagcgatcttgggatcgccgccgccgccctacattggaggtaggggtgctcacgtctccatcaggatcaagccatttgacggggcacgagcactctcatctacacggtgtaacaatgtcttctcctgtggaatccccataccttcctgctcccactgaacttctaccccatcctcaacaagctaatgatgattctcaccccatttcaatcctttaccgcgtcatttgcgacccgtcactcctctgattatgtactgaaaacaaaatactctgcacatgtagctaatctcacttactacctcactaaaaaaaacacacctaacgatctgcgtaatcttttaacacaactccaaccattttttgcgatgattcataacgcctacagtgccaaaattgtccttggaaaaatagatgctaccaccgatataccagcaacatcagatctgtcgtataccactctgaagagaaatggtagaatggacccgtgaaggaccaacgtcactttcctccagcgacttgtgaaggaaaagatggcaaatgctctgttcgagaatcaggagtatactgtaccccttaacctgcttaataatcttatctctgaagctcaggaactctgacacagggtacctctcgtggacattgacattgtggtaagcacacttaacatcatgcctgaagaacctgcgcn

SEQ ID NO: 73440 - protein, 100 aa, Zea mays
  misc_feature: Ceres CLONE 1557772
MMILTPFQSFTASFATRHSSDYVLKTKYSAHVANLTYYLTKKNTPNDLRNLLTQLQPFFAMIHNAYSAKIVLGKIDATTDIPATSDLSYTTLKRNGRMDP

SEQ ID NO: 73441 - DNA, 836 bp, Zea mays
  misc_feature: Ceres CLONE 1557773
  misc_feature: Encodes the peptide sequence at SEQ ID NO. 73442
  misc_feature (511)..(511): n is a, c, t, g, unknown, or other
  misc_feature (556)..(556): n is a, c, t, g, unknown, or other
ctccccgcggtggcggccgctctagaactagtggatcccccgggctgcaggaattcgtctcacccctagaaaaagtgcccagtctgacaacgcgccccaaccccaacccagtcgagtccccctccgctctctctgcagttctgcactctgcagctgccggccatggcgcgcgccccgagctcgtggacgccgtccctcgccatggtgctcctcgtcgtggccgccgccgccgtggccgtgtcgtcggaggcggccagggtgcccgccgccgtcggcaactggacgggggaggagctgcgcggggccgcggcgaggcggggcggccggcgctcccggcgccgcgcgttcgagaacggcctcggccggacgccgcagatggggtggaatagctggaaccacttcggctgcgggatcaacgagaacctcatcaagcagacagctgatgcgctggtcaacaccggtctggcgaagctgggctacgagtatgttaacatagatgattgctggggcngagtctgacagggactaccaggggaagcttcgttgcaaacagacnaaaccttcccctctggcatcaaggcgctcgcggactacgtgcacgcccagggggctcaagcttggcatctacagccatgctgggccacggaactgttacccgaaaaatgccggggtcccttgacaccaaagaagcaggaccctgaaaacattccccggccccggggataccgattttcttgaaattaaaaaaaattggaaaaaaccccgggagggagccttttggggaaaggggttatccaaaaaagaacaccaccctctttaaaaaaccttttgggaaa

SEQ ID NO: 73442 - protein, 118 aa, Zea mays
  misc_feature: Ceres CLONE 1557773
  misc_feature: SWISSPROT Homolog: EC 3.2.1.22 Alpha-galactosidase
  misc_feature (117)..(117): Xaa is any aa, unknown, or other
MARAPSSWTPSLAMVLLVVAAAAVAVSSEAARVPAAVGNWTGEELRGAAARRGGRRSRRRAFENGLGRTPQMGWNSWNHFGCGINENLIKQTADALVNTGLAKLGYEYVNIDDCWGXV

SEQ ID NO: 73443 - DNA, 853 bp, Zea mays
  misc_feature: Ceres CLONE 1557781
  misc_feature: Encodes the peptide sequence at SEQ ID NO. 73444
  misc_feature (316)..(316): n is a, c, t, g, unknown, or other
ctggagctccccgcggtggcggccgctctagaactagtggatcccccgggctgcaggaattcgtctcacccctagaaaaaaaaacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgnccggcggcggggaggagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagctcgcccgcatctgcgacggcatcctcgcgctcctcgactcccacctcgtcccatccgccggcggcgccgagtccaaggtcttctacctcaagatgaagggtgactaccacaggtaccttgctgagttcaaagtcagtgcagagaggaaggatggctgcggagagcaccatgaatgcccacaaagctgctcaggatattgcctcttgctgatctgggctccaacccaccccaatcaaggctcggggcttgctctcaaccttctcagtggttcaaccaacaagaatcctccaactccccctgaaccgtggcttggcaacccttgccaaaaacagggcccttttgaatgagaga

SEQ ID NO: 73444 - protein, 84 aa, Zea mays
  misc_feature: Ceres CLONE 1557781
MKGDYHRYLAEFKVSAERKDGCGEHHECPQSCSGYCLLLIWAPTHPNQGSGLALNLLSGSTNKNPPTPPEPWLGNPCQKQGPFE

SEQ ID NO: 73445 - DNA, 818 bp, Zea mays
  misc_feature: Ceres CLONE 1557784
  misc_feature: Translation starting site: 155
  misc_feature: SWISSPROT Homolog: EC 3.4.22.16 Cathepsin H
  misc_feature: SWISSPROT Homolog: EC 3.4.22.15 Cathepsin L
  misc_feature (586)..(586): n is a, c, t, g, unknown, or other
ctccccgcggtggcggccgctctagaactagtggatcccccgggctgcaggaattcgtctcacccctagaaaaagtgccagcgcccagcaggccattctgctcgccttactccctcacagaacccagtaaaatattgccagtcccgccgtcgagatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttcgccgtcaggtacggcaagagctacgagagcgcggcggaggtccataagcggttcaggatcttctccgagagcctccagctggtccgctccaccaaccgcaaaggcctctcctaccgcctcggcatcaaccgcttcgcggacatgagctgggaggagttccgtgcgacccggctcggcgcagcccagaactgctccgccacgcttaccggcaaccaccggatgcgcgccgccgccgttgcgctgccngagacaaagactggagggaggatgggattgtgagcccagtgaaaaaccagggcactgtggatcatgctgggacttcagcactactggtgcacttgaggctgcatatacccaggcaactggcaaggctatctcttttctctgagcaaccaacttgtttgactgtgggtttttgccattcaacaatttcgggaaggcaacggaaggccttccatccccaggccttttgaaaaaa

SEQ ID NO: 73446 - DNA, 816 bp, Zea mays
  misc_feature: Ceres CLONE 1557787
  misc_feature (768)..(768): n is a, c, t, g, unknown, or other
  misc_feature (778)..(778): n is a, c, t, g, unknown, or other
ctccccgcggtggcggccgctctagaactagtggatcccccgggctgcaggaattcgtctcacccctagaaaaactacctcgagctctactcgcataccactgcatgggtgttggggttcttgtatccctgctagtgatgaccctctcccacagccaccaagtctgctctgtccagagaatcaagtgccagtggtgaccatgctcacaattctttaccccaccatagccagaacattctagggagttgctggcctatatgaagcttgttccataatctcagaattcccagaagaagaagatgatgaaattcaagaagtggtttctgaagaggagtctgcttcagtgcctgctcatcaagtgatgggagccatctaactggggtttaatagagggatctagaactccgtctctgcaacaaaggcaagccccggtgcatgcaaccccttccttgtgtttttaaatacttttcgcacacttaagtctagtgaaatgtgcattaggtttataggagttgcttgaaaccttttgatgcattgccttccttgatatccatacctttatagatacttctggtgaagtatcaaaatttgatttacaaaaatgcttagccctgcttagatcttgtggatagaggttgtcttttgcaatactgcctagctcaggggttatcctgaggaaagatggcttctacctgcaagaatactttcatttgagagtgtggtgggatcttactgcaaagctccctgtgaatgctctttcatcctaangacagaaacnatcctaaggatggaagtacttaaatcgagacttgggtt

SEQ ID NO: 73447 - DNA, 873 bp, Zea mays
  misc_feature: Ceres CLONE 1557790
  misc_feature: Encodes the peptide sequence at SEQ ID NO. 73448
  misc_feature (591)..(591): n is a, c, t, g, unknown, or other
ctccccgcggtggcggccgctctagaactagtggatcccccgggctgcaggaattcgtctcacccctagaaaaaatatgggagaactatgtcgagggtgaaaatgcttccaatggatccacacctgaatctaaacaaaagcaaattctcaaggttgttgtcacggaagttcttggtggtgggaagttttatgttcagacaatgggtgaccagagggtggcttcaattcaacagcagcttgcatctttgaaacttaaagatgcgccggtcattggtgcttttaatcctgtgaagggagagatagtcctcgcacaatttagcgttgacaactcctggaacagagctatgattgttaatggacctcgttctgttgaatctccggacgacaagtttgaagtattctatattgactatggcaaccaagaggtggttacctacagtcgtttacgacctgtagacccatctgtttcctcgtctcctgctcttgctcagctatgcagccttgctttcataaaagtgcccagtcttgaggatgactttggtcaggaagcagcagagtatctaagtgaaatgttgctcagtagctcaaagncataccgggcaatgatcgaagaccatgatacttccggggggaaaatcaaaagacaagaacccggaaaagttccccttgttaccctttgttgaggcggaaaccaaaagtgcataaacccctcccttctttgagaaaggcttgcccccggtcaaaaaaacaaaaaatgggacccctggggaaagaaaacaggttttccaaaacctgagaaatttccgggaaaaggaaaaaaaggaaaggccccccatttggcccccccggaaattttaacctccaaagacaaac

SEQ ID NO: 73448 - protein, 226 aa, Zea mays
  misc_feature: Ceres CLONE 1557790
  misc_feature (43)..(169): Pfam Name: TUDOR Pfam Description: Tudor domain
  misc_feature (197)..(197): Xaa is any aa, unknown, or other
PRGGGRSRTSGSPGLQEFVSPLEKIWENYVEGENASNGSTPESKQKQILKVVVTEVLGGGKFYVQTMGDQRVASIQQQLASLKLKDAPVIGAFNPVKGEIVLAQFSVDNSWNRAMIVNGPRSVESPDDKFEVFYIDYGNQEVVTYSRLRPVDPSVSSSPALAQLCSLAFIKVPSLEDDFGQEAAEYLSEMLLSSSKXYRAMIEDHDTSGGKIKRQEPGKVPLVTLC

SEQ ID NO: 73449 - DNA, 794 bp, Zea mays
  misc_feature: Ceres CLONE 1557793
  misc_feature: Encodes the peptide sequence at SEQ ID NO. 73450
  misc_feature (738)..(738): n is a, c, t, g, unknown, or other
  misc_feature (744)..(744): n is a, c, t, g, unknown, or other
ctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggcccgggctctttcaagcaagcgggctccgtccaagatggtccaaaggttgtttacaaaagaaaggacctgggggcggaaaccccggggaaatttggagattccgggaacaaaggccctccagccttaaaaaaaacccgggggcctccctttcccaaacaaattttaacggggtttaataacctttttaaaagggaaaaaaccccccctgaaggggggggaaaaacggggggggggcccccccccccccccccccctaaaaaaataggggaatcccccccccccccccaaaggaagcaccccccaagggggggggggggggnggtccnatacacccaaggagagatgttttactattaatgggccccggagtacaaaa

SEQ ID NO: 73450 - protein, 135 aa, Zea mays
  misc_feature: Ceres CLONE 1557793
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLARALSSKRAPSKMVQRLFTKERTWGRKPRGNLEIPGTKALQP

SEQ ID NO: 73451 - DNA, 829 bp, Zea mays
  misc_feature: Ceres CLONE 1557795
  misc_feature: Encodes the peptide sequence at SEQ ID NO. 73452
ggagctccccgcggtggcggccgctctagaactagtggatcccccgggctgcaggaattcgtctcacccctagaaaaaaccccacaccccacagagcagcagccctgcccagccgcgcgagctagaggccgaccagaccgaccgacaggagctcgctcgctcgcaactccgcaatggcgtccatcatcgtgcaagcggtggtgatcctcctggacgtgatcgccttcggcctgggcgtcgccgccgagcagcgccggagccgggccaccgtcaccccggacgccgccaaggagtacgactactgcgtctacgactccgacatcgccacggggtacggcgtcggcgcgctgctcctcctcgccgccgcgcaggtggtgctcatggtcgccagccgctgcttctgctgcggccgcgggctcaagccggggggctcccgcgcctgcgcccttatcctcttcctcttcacatgggtggcattcctcatcgcggaggcgtgcctgctggcaggatcagtgcgcaacgcgtaccacacccggtacaggggcatattctacggcgactcgctctcatgtgagacggtgcggaagggcgtcttcgcggctggtgcggccttcaccttcttcacggccatcctgggcgaggtgtactacctcagctactccaagtcccgggacgccgccggtggtgccccctacggcggctccagcattggcatgggcccttacaactaactaaagggcggccccgggtcgcttcatgctggaggaatgcagcagtgttctttttgacgttaccttagtaaggaccggtgtattttggttatggatca

SEQ ID NO: 73452 - protein, 185 aa, Zea mays
  misc_feature: Ceres CLONE 1557795
  misc_feature (44)..(159): Pfam Name: DUF1218 Pfam Description: Protein of unknown function (DUF1218)
MASIIVQAVVILLDVIAFGLGVAAEQRRSRATVTPDAAKEYDYCVYDSDIATGYGVGALLLLAAAQVVLMVASRCFCCGRGLKPGGSRACALILFLFTWVAFLIAEACLLAGSVRNAYHTRYRGIFYGDSLSCETVRKGVFAAGAAFTFFTAILGEVYYLSYSKSRDAAGGAPYGGSSIGMGPYN

SEQ ID NO: 73453 - DNA, 836 bp, Zea mays
  misc_feature: Ceres CLONE 1557799
  misc_feature: Encodes the peptide sequence at SEQ ID NO. 73454
ctccccgcggtggcggccgctctagaactagtggatcccccgggctgcaggaattcgtctcacccctagaaaaatgagaccgagagcctccagaaacccacgcgacgcgaccgaccaccatggccgcctccgcgctcctcctctcgccgcggctcgtgtctttcccgcctcacccgagcctcgccccactcttcaccaagagaccaccgccctaccccctcggcggcgccggcgcgaggctccgggccgtcggggacgggcccggcgcggggctgccacccgagcaggccacggtctacgacggcgcctacggtccctggaccctggaggactccgacgtgcgcgaggtcctgctgtaccggtcggggctggtgacggcggcggcgtccttcgtggcggcgtcctccgcggcgttcctgccggaagggaaccccgccgcctccgccgtcaccggcgccgccgacctcctgtacgccgccggcgccgcggggctggggctgtcgctggtcctcatccacatctacgtcaccccgataaagcgcttcctccaggcgctgtgggccggccggggcgctcggctccatcgggaactacctcgtcgccgcccgcccgctggatgaaggcctcgtgcagtacgtgctggaccaccccgccgcgctgtggttcgtcggccccacgttcgccgcgctcactggcctcgtcttccaggaaggtctctgctatggggaacttggaggctggcatcctgacgttttctatccttggggcttcttcttgggcattttggcagggctttttaggactgggggaggcttccttttccaaactttcgcgcg

SEQ ID NO: 73454 - protein, 166 aa, Zea mays
  misc_feature: Ceres CLONE 1557799
MAASALLLSPRLVSFPPHPSLAPLFTKRPPPYPLGGAGARLRAVGDGPGAGLPPEQATVYDGAYGPWTLEDSDVREVLLYRSGLVTAAASFVAASSAAFLPEGNPAASAVTGAADLLYAAGAAGLGLSLVLIHIYVTPIKRFLQALWAGRGARLHRELPRRRPPAG

SEQ ID NO: 73455 - DNA, 638 bp, Zea mays
  misc_feature: Ceres CLONE 1557800
  misc_feature: Translation starting site: 134
  misc_feature: SWISSPROT Homolog: EC 1.14.13.81 Magnesium-protoporphyrin IX monomethyl ester (oxidative) cyclase
  misc_feature (330)..(330): n is a, c, t, g, unknown, or other
ggagctcaccgcggtggcggccgctctagaactagtggatcccccgggctgcaggaattcgtctcacccctagaaaaagagcagctcactcccgctgcccagtcctcgccaccgcccactccgtcgccaaccaatggcctccgccatggagctctcgctcctcaaccccgccgcgacgcaccgccaccgcggcggcctcgccggcctgcccctcgcgcggcgctccgtggtccgcttccgcgtgtccgcctccgccgcggccaccgcgccgcccaagtcctcgggccccaagtaagcgggggcaaagaacggagaatcccaggaagaacngcttggctcaacgcccccggttctacaccacggaactcgacgagatggagcgcctcttcaacgccgagatcaacagcagctcaacaggccgaagtcgaacccctgctgcgggagtcaagacggactaaaaccggacccaccttcgggcgcaaaccccaagtttaaaggcccccccccaaaagggatggaaaggcgcccccctcccccccaaaaacttttcggcgaagattcccccaaaaggggcccccgggaacaccccccaaaaattttctcccggggggtttccccctcccccttaaaaaaagaga

SEQ ID NO: 73456 - DNA, 802 bp, Zea mays
  misc_feature: Ceres CLONE 1557805
  misc_feature: Encodes the peptide sequence at SEQ ID NO. 73457
  misc_feature (723)..(723): n is a, c, t, g, unknown, or other
  misc_feature (735)..(735): n is a, c, t, g, unknown, or other
acccgcggtggcggccgctctagaactagtggatcccccgggctgcaggaattcgtctcacccctagaaaaaagctgagcgaagcatccggtgtgttccctcgccatccgccgccgccgccatgccgggcttcgctcagcgtctcgcgggcatcccgtggcggagcatcgcgaggcaaggcctctcccgcgtgttcctggtggcgaaggcctactgcttgatccacgtcgtcaacgaccacctctgctcggtgaccttagtgcggggcgccagcatgctgccgtccctgaacctggcgggcgacgcggtggcggtggacagggtcagcgtgaggctcggccgggtcgcgccgggggacatcgtgctgatgatctcccccgaggacccgcgcaagtcggtcgtcaagcgcgtcgtcgggatgcagggggactccgtcacctaccttgtcgaccccggcaaaagcgactcctccagaaccgtcgtggtaccgcaagatcatgtctgggtgcagggtgacaatatctttgcttctaacgattcgaggcaatttggagctgtgccttatgggctgattacagggaagatcttttgccgggtttggccgccagagagttttggcgcaattgatgacgcaacgaagcagtcttaacgctgaggaggagccgaggaggtactgagcacatggacccatattgtttgctcgcgcccagagattctatctantacatactgcangggggggcccttccttgagctcgagagctttcgacgaccttacgcagcgcatttctacagcgaagca

SEQ ID NO: 73457 - protein, 175 aa, Zea mays
  misc_feature: Ceres CLONE 1557805
  misc_feature (46)..(125): Pfam Name: Peptidase_S24 Pfam Description: Peptidase S24-like
  misc_feature: SWISSPROT Homolog: EC 3.4.21.89 Signal peptidase I
MPGFAQRLAGIPWRSIARQGLSRVFLVAKAYCLIHVVNDHLCSVTLVRGASMLPSLNLAGDAVAVDRVSVRLGRVAPGDIVLMISPEDPRKSVVKRVVGMQGDSVTYLVDPGKSDSSRTVVVPQDHVWVQGDNIFASNDSRQFGAVPYGLITGKIFCRVWPPESFGAIDDATKQS

SEQ ID NO: 73458 - DNA, 842 bp, Zea mays
  misc_feature: Ceres CLONE 1557807
  misc_feature: Encodes the peptide sequence at SEQ ID NO. 73459
  misc_feature (805)..(805): n is a, c, t, g, unknown, or other
ctggagctccccgcggtggcggccgctctagaactagtggatcccccgggctgcaggaattcgtctcacccctagaaaaaaagcccagccaacacaagtcaagtcggagcccgcaggtgtcgacaccgcgcgccgggagccggaagaagggtggggggtgagctgtggaccatgagcgcgaccgggcgagccccgtgcggcctgccgcgcatcggcctgggcacggcggtgcagggcccgcggccggaccccgtccgcgccgcggtgctgcgcgccatccagctcggctaccgccacttcgacacggccgcgcactacgccaccgaggcgcccatcggggaggccgccgccgaggccgtgcgcacggggctcgtcgcctcccgcgaggacctcttcgtcacgtccaaggtctggtgcgccgacgcgcaccgggacagggtgctcccggccctccgccggacgctcagcaatctccagatggaatacgtggacctgtacatggtgcactggcccgtgaccatgaaggccgggaggttcacggcccccttcacgcccgaggacttcgagccgttcgacatgcgggccgtgtgggaggccatggaggagtgccaccgcctgggcctggccaaggccatcggcgtgtgcaacttctcctgcaagaagctcgagaccctgctctccttcgccaccatccctcccgtggtcaatcaggttgagatcaacccggtgtggcagcagcggaagctgagggagttctgcaggccgaagggcatccagctatgcgcctactcgcccctgggcgccnaggcacgcactgggccagcgacttcgtgatggactca

SEQ ID NO: 73459 - protein, 220 aa, Zea mays
  misc_feature: Ceres CLONE 1557807
  misc_feature (7)..(221): Pfam Name: Aldo_ket_red Pfam Description: Aldo/keto reductase family
  misc_feature: SWISSPROT Homolog: EC 2.3.1.170 6'-deoxychalcone synthase
  misc_feature (212)..(212): Xaa is any aa, unknown, or other
MSATGRAPCGLPRIGLGTAVQGPRPDPVRAAVLRAIQLGYRHFDTAAHYATEAPIGEAAAEAVRTGLVASREDLFVTSKVWCADAHRDRVLPALRRTLSNLQMEYVDLYMVHWPVTMKAGRFTAPFTPEDFEPFDMRAVWEAMEECHRLGLAKAIGVCNFSCKKLETLLSFATIPPVVNQVEINPVWQQRKLREFCRPKGIQLCAYSPLGAXARTGPATS

SEQ ID NO: 73460 - DNA, 962 bp, Zea mays
  misc_feature: Ceres CLONE 1557810
  misc_feature: SWISSPROT Homolog: EC 2.7.4.6 Nucleoside-diphosphate kinase
  misc_feature (673)..(673): n is a, c, t, g, unknown, or other
  misc_feature (862)..(862): n is a, c, t, g, unknown, or other
  misc_feature (896)..(896): n is a, c, t, g, unknown, or other
  misc_feature (962)..(962): n is a, c, t, g, unknown, or other
aagctggagctccccgcggtggcggccgctctagaatagtggatcccccgggctgcaggaattcgtctcacccctagaaaaacccctgacgctcgacgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgaacgcgttcagcggggccctgattcgggacatcttcagtcgcctcgagaaaaaaaggtctaccttcagggggatgaatttatggacctgagagggtctttgcgcaaaaacactatgcttgacctttttcaaaaagccttttttccccgggttgggggaaaaaaacatttttccgccccctgttggccaatattttttgaaaagggaaaaaaaccccctttttttttttgtccccccagaaataatttgggggcccccccagcccctcttgtgagggaaggacccccccccaaaaaaatattttgggggggggaaaccacccccccgcgaaaaaacaccccccgcgcgaaaaatatcttttccctcttgtgggaagaaaacaaaccccccccttctttgggaaaaaacagggaaaaaaaaaaagaaagaaaancccccaccctccctcccgcgtgtgccccccctcccaaaagaggggtggggggcgcccccccccggagaaaaagaaaaaaaaaaaatttttatttttttctccctcctgggggggtgttgtgaaaaaaaaaggggggtggttgtgtgtttatattttagagaaacttaatccgtggtgggggggaggggngttgttgcgcctcttctccctcttcttcccttgntggggttggggaaaaaaaaaaaaaaaaaaaaaaaagttgttttttttattttttgtggtgattaan

SEQ ID NO: 73461 - DNA, 678 bp, Zea mays
  misc_feature: Ceres CLONE 1557812
  misc_feature (166)..(166): n is a, c, t, g, unknown, or other
  misc_feature (226)..(226): n is a, c, t, g, unknown, or other
  misc_feature (234)..(234): n is a, c, t, g, unknown, or other
  misc_feature (235)..(235): n is a, c, t, g, unknown, or other
ctggagctccccgcggtggcggccgctctagaactagtggatcccccgggctgcaggaattcgtctcacccctagaaaaagaacttgactgtctgccctgtctgcaggcactcgtcttcttcctggagagaaaaagcagaagacaatacaaagatgtccaagatgngcggaggagaaggggcggcggcagtgggcggactcggaggagccgggggcggcgggacgncggcgcanncaaccacacaacttgggcaaaccagggggaaggccccggggggttccggggggggcccccggaaaaaaacctttttcccgggacccttggggttttgggggcccccaacccctttttcttaaccccaaaaaacaaatgtgggccccccccccccccccccggggggggttaaaaattttttttttaaaagggggtttgggggccccccaagggggggggggccggtataaaaaggggggggggggggggcccccccccgggggccccccccggggttttttcccccccccccccaagggggggggggcccccccccccccccccccggggggggggccccccccccggggagaaattttttgtttttccccccccccccccacccccaagaaaaaaaaagaagagggggggggagagaaaaaaaaccccccccccattctttc

SEQ ID NO: 73462 - DNA, 783 bp, Zea mays
  misc_feature: Ceres CLONE 1557813
  misc_feature: Encodes the peptide sequence at SEQ ID NO. 73463
ctcaccgcggtggcggccgctctagaactagtggatcccccgggctgcaggaattcgtctcacccctagaaaaatccgtgcggcgacgacggactgggcaaccgccaccgccctccctttccctgcgccagcgacgactgggcgaacgctgcctcgcttcgtcacctcttcgccggcggcgacgatcacccaccaggttgatgctgattttttggttgacaatttgaagattactaacttctatgatcctgagggcaagaagtaatgatccgcccaggctcaaaggactcgcaaaattatgataacaataatcaaagagtccatcctcaaccaatcaacgagaacatgaatcagaacggggactcaatggacactgtgatcgggaggattttcaacaacatatcctctttaaaatccgcctacattcagctgcaggaagcccacactccatatgaccctgacaagatccaggaagctgataaacttgtcatagaggagcttacgagggcttcagaaactcagcacgcttacagagaaaaacatcctaagcccatagctgcatccccctcaagatccacgcttgctttctgaattccaagagcagccagacttggttgaaaaacctaccaagtcatgggaaagaaagttcccggtcccagatcccgacccgaaaccctgggaaaaccccttcttccggcggcaatttggggaaagctaaaccttcggaaaatccaaccctggggaaaaaaaccgaaaaaagggggggccccttttaacgggggg

SEQ ID NO: 73463 - protein, 108 aa, Zea mays
  misc_feature: Ceres CLONE 1557813
  misc_feature (24)..(107): Pfam Name: DUF641 Pfam Description: Plant protein of unknown function (DUF641)
MIRPGSKDSQNYDNNNQRVHPQPINENMNQNGDSMDTVIGRIFNNISSLKSAYIQLQEAHTPYDPDKIQEADKLVIEELTRASETQHAYREKHPKPIAASPSRSTLAF

SEQ ID NO: 73464 - DNA, 855 bp, Zea mays
  misc_feature: Ceres CLONE 1557818
  misc_feature: Encodes the peptide sequence at SEQ ID NO. 73465
  misc_feature (689)..(689): n is a, c, t, g, unknown, or other
  misc_feature (799)..(799): n is a, c, t, g, unknown, or other
  misc_feature (802)..(802): n is a, c, t, g, unknown, or other
  misc_feature (815)..(815): n is a, c, t, g, unknown, or other
tggagctccccgcggtggcggccgctctagaactagtggatcccccgggctgcaggaattcgtctcacccctagaaaaagtggacccacctgccattttatagcaacttcagtgagtaagctttcgctaaaaccctagctccaaaaaaaacgaactagaaacgaccgcgaagccacaggtcgaaggcggcggcggcgatggggagcgacacggagacggagaagaaggcctcggtggcgctgatgtccatcgcgaaacccctcgctggaaagaagctctgcaagcggaccctcaagctcgtgcgacgagcctccgaggcgaagtgcctcaagcgcggagtcaaagaggtagtcaagagcattcgccgcgggaacaaaggattgtgtgtgatcgctggaaatatttctcctattgatgtgattacacatgttccgatactatgtgaggaagctaatgttccttacgtatatgttccatcaaaagaggatcttgcgaccgcaggaaccactaagaggccgacttgttgcgtcttggttctgaccaaaccaaacaagggggagctcagtggagaggtgaaggataaactgaagtcggactatgaccaagttgtaacggaagtcgctgaggctacatctgcaatgttctgaggaccacattatctgagaatccggcaattccctgtgcacgtncttcttggtgtagtatcctgcccagcttccgtgaaccgcaccagtatgttttgcacggtggctggagcgagatatgactatgagtttacctatatgctatggaccatccntgntgggcgcatatgnatctaccagtggatagatctagccaatttatatcaggtag

SEQ ID NO: 73465 - protein, 149 aa, Zea mays
  misc_feature: Ceres CLONE 1557818
  misc_feature (29)..(123): Pfam Name: Ribosomal_L7Ae Pfam Description: Ribosomal protein L7Ae/L30e/S12e/Gadd45 family
MGSDTETEKKASVALMSIAKPLAGKKLCKRTLKLVRRASEAKCLKRGVKEVVKSIRRGNKGLCVIAGNISPIDVITHVPILCEEANVPYVYVPSKEDLATAGTTKRPTCCVLVLTKPNKGELSGEVKDKLKSDYDQVVTEVAEATSAMF

SEQ ID NO: 73466 - DNA, 890 bp, Zea mays
  misc_feature: Ceres CLONE 1557819
  misc_feature: Translation starting site: 193
  misc_feature (562)..(562): n is a, c, t, g, unknown, or other
ctggagctccccgcggtggcggccgctctagaactagtggatcccccgggctgcaggaattcgtctcacccctagaaaaaatccattcccacagcaccaagcaagagcaaagagcaacacaaggcaaggcagcacacgacccgcggcgacgcaagaagagaagccagcagtcgtctggatccatcgattgacatggccatggcggcggcagcggagggcaagagccggaggttcgcgctggcctgcggggtgctgagccagtacgtgaaggccgagcagcagatggcggccgccggggcccctgccccgcgcgccccggccacgacgctgagcctcatgcccggcgcggacgtcggcgccgagcaggagccggccgccgcgagggggcaggagacggccgggtccgcctccacggcggcgccgctcaccatcttctacggcggcagggtggtcgtgttcgacgacttctcggcggagaaggcagccgaggtcatgcgcctcgcagctggcgccgagcgcccggcggccccggccccggcgtcggcgccgcgcgacgacttgnctatcgccccgaaaggcgtcgctgcagcgggttcttggccaagcccaaaggaccgcctccggggagcggggccccctaggcccggccgttccccatcggaaggaagcggaaaaaggcgaaaccgggcctccttggctcggggttggggggaccggacccccaaaagccctaaaaaacgggcttgagaatttgaaatccgggggtgaccccccccccgaaacacaccgggggggaaattaaatggcgcggggcccccggctttccttttggcccttcccaaaatggggggtgggggggggaaatccccaaacccgggggattttttaac

SEQ ID NO: 73467 - DNA, 799 bp, Zea mays
  misc_feature: Ceres CLONE 1557821
  misc_feature: Encodes the peptide sequence at SEQ ID NO. 73468
  misc_feature (282)..(282): n is a, c, t, g, unknown, or other
  misc_feature (455)..(455): n is a, c, t, g, unknown, or other
ctccccgcggtggcggccgctctagaactagtggatcccccgggctgcaggaattcgtctcacccctagaaaaagcatgcagagtgcagtagaacggcatcagttacactagtagtgctcatctcgctggtactgctgagctgaccaccgccgatccttccaagatggcgaggcagggtgtcgtcgcttccatgcatgcgctggcattgcttctcggagcattcgcagccattcctacaggagtccaatccatcggcgtgtgctacggcgtgaacggcgacnacctgcccccggcgagcgacgtggtgcagctgtaccagtccaacgggcatcacctgatgcgcatctacttcccggacgcccacgcgctgaacgcgctgagcggcaccagcatcgggctcattatggacgtgcccaacaccggacttcgcctcggcttgcctccgaacccgagnccggggggcccccttgggtgcaaaaaaaaaccttccgggggttttccccggtggggggaaagttttcgcataaaattcccgtgggggaaaaagggccctccggggggggaaacaccgggaaatttcttttcccccttgaaaaaaactttaacgggggggtgggggaaaaccccgggccttggggggcgaaatataaggggtgttcccccggggggggaaaaagaagccttccccccccgggggttttcccccccccccgggggggcgttcttttctcggggggggatatttgtgggcccccccctccgcgcaattcttcttgaaaaaaaaaacccccccccccc

SEQ ID NO: 73468 - protein, 211 aa, Zea mays
  misc_feature: Ceres CLONE 1557821
  misc_feature: SWISSPROT Homolog: EC 3.2.1.39 Glucan endo-1,3-beta-D-glucosidase
  misc_feature (40)..(40): Xaa is any aa, unknown, or other
  misc_feature (97)..(97): Xaa is any aa, unknown, or other
MARQGVVASMHALALLLGAFAAIPTGVQSIGVCYGVNGDXLPPASDVVQLYQSNGHHLMRIYFPDAHALNALSGTSIGLIMDVPNTGLRLGLPPNPXPGGPLGCKKKPSGGFPRWGESFRIKFPWGKKGPPGGETPGNFFSPLKKTLTGGWGKTPGLGGRNIRGVPPGGEKEAFPPRGFSPPPGGAFFSRGGIFVGPPLRAILLEKKNPPP

SEQ ID NO: 73469 - DNA, 838 bp, Zea mays
  misc_feature: Ceres CLONE 1557825
  misc_feature: Encodes the peptide sequence at SEQ ID NO. 73470
  misc_feature (694)..(694): n is a, c, t, g, unknown, or other
agctccccgcggtggcggccgctctagaactagtggatcccccgggctgcaggaattcgtctcacccctagaaaaaatttataatcgatctccagcttacagcgacgtccaggtccaggtctgagctcgaggcacaggactccctttataatttatccatccatggcttcctccaattccaatagcagcagcaacccgctggaagccatgggcgccttcttctcgaagcaggtggaccggcggaagctggtgaccaccgagaagcgggcgctggccacgcgtctgtcctcctccggcgacacgttcccggggtcggagcaccggccggcggaccggaagcggtggatggcggagctgggcgccgacaagctgcgcgtgcaccaggtggtgtggcccggcacgcacgactcggccaccaacaagatcggcgtgccgctggtgacccgccccttcgcgcagtgccagtccatgtctgtgtacgagcagctggccatgggcacgcgcgtcatcgacgtgcgcgtgcaggaggagcgccgggtctgccacggcatcctggcgacgtaccccgtggacgtggtgctggacgacgtgagccggttcctgggcgagaccgagtccgagctgctcatcctggagatccgcaccgagttcgggcacgaggacctcgccggggtcgacagggtcctggccgacnagctgggcgagcacctgatcccgcaggacgaggcggtgttccacaggaccgtcgcgaagctgctccccgcggcgggtcatctgcgtctggaagcccccgcagtcgccgccgcctaggcccgggggacccgctgtggagcgcccg

SEQ ID NO: 73470 - protein, 215 aa, Zea mays
  misc_feature: Ceres CLONE 1557825
  misc_feature: SWISSPROT Homolog: EC 4.6.1.13 Phosphatidylinositol diacylglycerol-lyase
  misc_feature (178)..(178): Xaa is any aa, unknown, or other
MASSNSNSSSNPLEAMGAFFSKQVDRRKLVTTEKRALATRLSSSGDTFPGSEHRPADRKRWMAELGADKLRVHQVVWPGTHDSATNKIGVPLVTRPFAQCQSMSVYEQLAMGTRVIDVRVQEERRVCHGILATYPVDVVLDDVSRFLGETESELLILEIRTEFGHEDLAGVDRVLADXLGEHLIPQDEAVFHRTVAKLLPAAGHLRLEAPAVAAA

SEQ ID NO: 73471 - DNA, 814 bp, Zea mays
  misc_feature: Ceres CLONE 1557831
  misc_feature: Encodes the peptide sequence at SEQ ID NO. 73472
  misc_feature (776)..(776): n is a, c, t, g, unknown, or other
  misc_feature (785)..(785): n is a, c, t, g, unknown, or other
ctccccgcggtggcggccgctctagaactagtggatcccccgggctgcaggaattcgtctcacccctagaaaaaagagccgtatacagaggagtgacggtcgtcgtacacagatcacgatgctgctcccacactcttcgtcagcctctgcaactgctaccactcgagggctagcactagcagcagcagcaccgccgccgcgtccgaccgctcgcccccggcgcgcacgcctcctgcctccacgcgcgcgggccgagacgcatgcgacgggcgttggcgccgacagcgcggccgatgcgcttctccagagcgggctgcgccgtgagtcgctgccgcggcacgtcgcggtggtgatggacgggaactcgcagtgggcgcgcgagcgggggctgacgcccgcggacggccacaaggccgggggccgcaacctggagcaggtcgttgcgatgtcgcgcgactagggcatccgcgcgctcaccgccttcgtctgctcccgcgagaacttgagccgccccaatgacgaggacgactacatgatgggcttgtccgagtggctgatatgcgacaacatcgacaagctctcgaggcaggggatccgactgcacgtgatcggcgacgccgagaagatgccagcctctctgcagagcgcagcggtgcaagccgacgatgacactaggctaaactcgcagctgcacgtgatgctggccatctgctacagcaggcgataggacattggtcaggcagtgcaggaagctggccggggaagtgcaggcgaancgaggtcantccggacgacatcgaactagtcgatcatc

SEQ ID NO: 73472 - protein, 64 aa, Zea mays
  misc_feature: Ceres CLONE 1557831
  misc_feature: SWISSPROT Homolog: EC 2.5.1.31 Di-trans,poly-cis-decaprenylcistransferase
MMGLSEWLICDNIDKLSRQGIRLHVIGDAEKMPASLQSAAVQADDDTRLNSQLHVMLAICYSRR

SEQ ID NO: 73473 - DNA, 788 bp, Zea mays
  misc_feature: Ceres CLONE 1557835
  misc_feature: Encodes the peptide sequence at SEQ ID NO. 73474
ctggagctcaccgcggtggcggccgctctagaactagtggatcccccgggctgcaggaattcgtctcacccctagaaaaaacctcacgcttcagagcagcatcggctgctgcttttcaccgccgctgcagtgtcacggtgcgccgtgcacgcactcccaatggcacccggcggcggcagcggcatcagagccccttcgccagacctcccagtcccagcccggcaaaagttcgcaaactcgacgagaagaccacgggcttattccgctgccagtgcgctaccaaaactcccacggcctcaatcgatcagacgcggagccgtggtggtagtggtagcatgcgcccgcggaagcgagcaacaatcctctccggccgtcgcggcaaaagtgcggcccgagcccggcacgctcagcgtcgagttccggatgcaggacagctgccggctcggcatcgccaggtacccggacttcgcgtacaacgcgcatggcggccgcggagtgggcgccgggcgcgggtcgaagagcggggaggatgatggcattggcacggtactcgtcgacttctacgtggcgaccctgtacatcccgcccatgtccggcgcgacgaccaggttcctcggcctgccgctacctgcgtacctcaagatcgatatcttgcccgaggcactgggcggcaccatcgatcgagccactgggtcagttgatctcaagtttagatcgaagtactgcttctcgattgggagcgtctacaaagcgacgccactgatcatcgagactacactgacctacca

SEQ ID NO: 73474 - protein, 209 aa, Zea mays
  misc_feature: Ceres CLONE 1557835
MAPGGGSGIRAPSPDLPVPARQKFANSTRRPRAYSAASALPKLPRPQSIRRGAVVVVVACARGSEQQSSPAVAAKVRPEPGTLSVEFRMQDSCRLGIARYPDFAYNAHGGRGVGAGRGSKSGEDDGIGTVLVDFYVATLYIPPMSGATTRFLGLPLPAYLKIDILPEALGGTIDRATGSVDLKFRSKYCFSIGSVYKATPLIIETTLTY

SEQ ID NO: 73475 - DNA, 713 bp, Zea mays
  misc_feature: Ceres CLONE 1557838
  misc_feature: Encodes the peptide sequence at SEQ ID NO. 73476
  misc_feature (458)..(458): n is a, c, t, g, unknown, or other
ctccccgcggtggcggccgctctagaactagtggatcccccgggctgcaggaattcgtctcacccctagaaaaacatttagatttccgtgggcgtgcataccctatgcatcctcatttgagtcacctaggttcagatctttgtcggggtgttctagagtatgctgaagggcggccactaggaaagtcagggttgtgctggttgaagatacacttggctaacaaatatggtggtggcattgaaaagctttctcacgagggcaagctagcttttgtggagaaccaactgtttgatatatttgattcagcagcaaatcctgttgatgggaactgctggtggacgaatgctgaggatccctttcagtgtttagctgcatgcatggacctttctgatgccttaagaagtccatcaccttaccatgctgtctctcacctgcctattcatcaggatgggtcatgncatggtttacaacattatgcgctccttggaaggaacttatgggccccggtgctgtcaacctgttccgggaaaaaactgcaaaattctacccaaaaatacctccagggacccgaaatgttttttttgaaaaccccattaaaggaccctgttatttacccaaattggttttttttgaaaaaggttttattttaaacgggggggaaaagaaaaatttttttaaccaaaaaaacctttgaaaccccggctcctaggggg

SEQ ID NO: 73476 - protein, 215 aa, Zea mays
  misc_feature: Ceres CLONE 1557838
  misc_feature: SWISSPROT Homolog: EC 2.7.7.6 DNA-directed RNA polymerase
  misc_feature (152)..(152): Xaa is any aa, unknown, or other
PRGGGRSRTSGSPGLQEFVSPLEKHLDFRGRAYPMHPHLSHLGSDLCRGVLEYAEGRPLGKSGLCWLKIHLANKYGGGIEKLSHEGKLAFVENQLFDIFDSAANPVDGNCWWTNAEDPFQCLAACMDLSDALRSPSPYHAVSHLPIHQDGSXHGLQHYALLGRNLWAPVLSTCSGKKLQNSTQKYLQGPEMFFLKTPLKDPVIYPNWFFLKKVLF

SEQ ID NO: 73477 - DNA, 844 bp, Zea mays
  misc_feature: Ceres CLONE 1557840
  misc_feature: Encodes the peptide sequence at SEQ ID NO. 73478
  misc_feature (693)..(693): n is a, c, t, g, unknown, or other
ctccccgcggtggcggccgctctagaactagtggatcccccgggctgcaggaattcgtctcacccctagaaaaaacgacccaagcaagctagctcgatctactactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctactacgatggccgctactggaccatgtggaagctgcccatgttcggctgcaccgacgccacgcaggtgtacaaggagctgcaggaggccatcgccgcgtacccggacgccttccaccgcgtcatcggcttcgacaacgtcaggcagacgcagtgcgtcagcttcatcgcctacaagcccccggcagcgagtagagaacgtggctagatcgacaantggccatgtctcctgctggtgatccgatcaccttcttgcaatgggtccctctctcttcctccttttttttccctttaacccatcaatttcttttctcgggcaggcaagggtcccttttgcttccaacaattttccggctgaatgaatcaga

SEQ ID NO: 73478 - protein, 174 aa, Zea mays
  misc_feature: Ceres CLONE 1557840
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCTDATQVYKELQEAIAAYPDAFHRVIGFDNVRQTQCVSFIAYKPPAASRERG

SEQ ID NO: 73479 - DNA, 848 bp, Zea mays
  misc_feature: Ceres CLONE 1557842
  misc_feature: Encodes the peptide sequence at SEQ ID NO. 73480
  misc_feature (689)..(689): n is a, c, t, g, unknown, or other
tggagctccccgcggtggcggccgctctagaactagtggatcccccgggctgcaggaattcgtctcacccctagaaaaaatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgcggcgcgaggacctagtcgagcaggtgaggcacgcggccgggacggtgggcttcttctggctggtgaaccacggcgtggcggaggagctgatgggcggcatgctccgcggggtgcgccagttcaacgagggccccgtggaggcgaagcaggcgctctactccagggacctggctcgcaacctgcgcttcgcctccaacttcgacctcttcaaggccgctgcggccgactggcgcgacacgctcttctgcgaggtggctccgaaccccgcgccgcgggaagagctgcctgagccacctgagaacgtgatgctggagtacgggcgcggncgtgacaaagctggcgcgggttcgtgttccagctgctgtccgagtccttcggcatgcccagcgaccacctgtacgaaaatggagtgcatgccaaaccttaacgtgggtgtggcagaaactacccgccgcggcccgaaccccacccccacccgggggccg

SEQ ID NO: 73480 - protein, 242 aa, Zea mays
  misc_feature: Ceres CLONE 1557842
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPSSPPSGAAIPVVDLSVTRREDLVEQVRHAAGTVGFFWLVNHGVAEELMGGMLRGVRQFNEGPVEAKQALYSRDLARNLRFASNFDLFKAAAADWRDTLFCEVAPNPAPREELPEPPENVMLEYGRGRDKAGAGSCSSCCPSPSACPATTCTKMECMPNLNVGVAETTRRGPNPTPTRGP

SEQ ID NO: 73481 - DNA, 889 bp, Zea mays
  misc_feature: Ceres CLONE 1557844
  misc_feature (264)..(264): n is a, c, t, g, unknown, or other
  misc_feature (327)..(327): n is a, c, t, g, unknown, or other
  misc_feature (494)..(494): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (682)..(682): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (699)..(699): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (705)..(705): n is a, c, t, g, unknown, or other
  misc_feature (780)..(780): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (840)..(840): n is a, c, t, g, unknown, or other
  misc_feature (842)..(842): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (865)..(865): n is a, c, t, g, unknown, or other
  misc_feature (866)..(866): n is a, c, t, g, unknown, or other
  misc_feature (875)..(875): n is a, c, t, g, unknown, or other
  misc_feature (877)..(877): n is a, c, t, g, unknown, or other
  misc_feature (889)..(889): n is a, c, t, g, unknown, or other
tggagctccccgcggtggcggccgctctagaactagtggatcccccgggctgcaggaattcgtctcacccctagaaaaagcgccactcatccccatctccctccgccgtcgactcccttcataccagtagcgccgcccaccccatccgccgaatagtagcgctgtgcctttccttccgctcggaaggaacggccgcccttcttcccttcaccatccaccggaacctatccaaggtaaaagcacaatctgcggtcttcgccgaanagtagcgctgcccactccattccgttcgggagaacccggcggccctcctccccctcaccattncaacggcccctatccaaagggaaatttttccgttggaaagcccccttctattcccccgtgccggaggtttaggcctccccccccacaaaacctggtttccggggtgggcccagggacaaaaaaattggatgggggggctcccgggggtccccccccctcccccccanaaaaaaaaaaaaaaaaaaataggggggggggggggtcttcttttcgggggggggtcgatctaaagcggaatgccacccccggggaagccgcccctccccttgttttttttttttcgggtcgcccaccgccnnnnnntttggggggtgtagcgggaagcgccgccccgccacgcgagcactcccccccntnnnnnnnntttttgtntnnntncccgggtgtggtgttgtaaagacaaaaaaaaaaccgcggccgcggggggggggcgggggggattgtcttttcacnatggtttttcccccccnnnncctcgggacacgtcgacaccatctctgnnnnnnnnaaccnantctgtnnnnntnnnnnnttaggnnccgagccantngggggggaaaan

SEQ ID NO: 73482 - DNA, 795 bp, Zea mays
  misc_feature: Ceres CLONE 1557845
ctccccgcggtggcggccgctctagaactagtggatcccccgggctgcaggaattcgtctcacccctagaaaaaacaaagctagcttatttcccttcccttccgcggcaagcggcggccggccttccgccgccatggccaccaccaccgcgcccgtcctcctcgtcttcctcgttgccattgccacgtccgtcgcccctcttcccatcctgacatggcggcggagcggacaacggcaccaccactgagcttcttatgcagacatccgtcggcgcagccgacgcggtgaggtgatcaagggccggcgcggggtccacccgacggcgcggccctggcatgacttccgcgacacctgttgattacaacccccttacagaagagggttcccgccttcccccccctgggcccctttcagggttttaaaatgctgggttcccaaaccggggcgggccttttggggtgtggccaaacttgttgtttaaattgggggggcccccaacagggggaaaccccccccccctgttttggggccccaaaaaaacacccggccaaaaaaaatcccggggaaaaatccccctcttttttgggggggaccccgggaaaatgttttcgggagggcccccccgggaaaaattttttttttgtagaaaaaaccccccgattggggtaataaaaggggggccaaaacccccccccccttaatggggggtggtttttttttttccccccccgggggggggaggaggggccccccaaaagacgcgggggggaaaccacccaggatggggggggggcg

SEQ ID NO: 73483 - DNA, 824 bp, Zea mays
  misc_feature: Ceres CLONE 1557847
  misc_feature: Translation starting site: 112
  misc_feature: SWISSPROT Homolog: EC 1.1.1.82 Malate dehydrogenase (NADP(+))
  misc_feature (514)..(514): n is a, c, t, g, unknown, or other
ctccccgcggtggcggccgctctagaactagtggatcccccgggctgcaggaattcgtctcacccctagaaaaaactcctcccctgctccggctccggctccggctccgccatgggcctttcaacagtttactccccggccggaccgcgcctcgtgccggcccctctcggccgctgccgctctgcccagcctcgccgcccgcgccgagccccgctcgccaccgtccggtgctccgtcgacgccaccaagcaggcgcaggatggcgtggcgacggcggtcgcgacggaggcgccggcgtcacggaaggagtgcttcggggtcttctgcaccacctacgacctcaaggcggaggacaagaccaagtcgtggaagaagctagtgaatgttgctgtgtcaggcgcggccgggatgatatcaaatcacctgctgttcaaactcgcttctggtgaggttttcggacaagaccaacccgatagcacttaagctactcggctcaaaagatcgtttcaggctntcaaggtgtagctatgggactggaggactccctgtattccctgctaagggaatcccccattggcaaaaatcctacccgagtctttcaagaagaaaatgggccctttttatggggctaaaccccaaagtccccggttggaagggacccccccctgggaaataaaggggccaatttttttttgacccggggaaaaccctttttggggggccccccccggggaacccgaaaaatttttttttttttggaaaaaacccctgtgaaacaaaaaaggcggcgtattttttttttttaaaaaaaaagcccccccccc

SEQ ID NO: 73484 - DNA, 819 bp, Zea mays
  misc_feature: Ceres CLONE 1557849
  misc_feature: Encodes the peptide sequence at SEQ ID NO. 73485
ctggagctccccgcggtggcggccgctctagaactagtggatcccccgggctgcaggaattcgtctcacccctagaaaaaaagggaaacgcggccagtttgccagcacagcaccaacacggccctgccggcatcgtctttccgggttggggactgaaaactgtcgctgttagttggggttggggactctttcaggctgcagcaagcaactggacgatgatggcttccaggcagtcagagaacaatgcacaagaagaaacatcaccattgacgactcctaacgccaacatagccaggatcatcccttcgctgcccctcgagaccaggtggccaccgttccctctccgacggtacgccaatttttggctgcctgaggtaacattgaaggaaggcgtccccggcgttcattcctgcttcgagccgagacccaccgacgtgttcctcgcaagcttccccaagtctggcaccacctggctcaaggccctcgccttcgcgacgctgaagcgttccacgcatccgccgttcgacgacgaccatccgctgcgccattgcaaccctcatgactgtgtcaggttcctcgaacttggtttcaaccagcagaaggatgagctcgaggcgctcccgtccccgcgtgtgctggccacgcacctcccctactccctgctgcccggcagcatcaccggggacggagagcactcggggtgccgcatcgtgtacgtctgccgggaaccccaagacacgctggtctcctactggctgttcacgaggaaagcagcgcccgccttgtggggttgacgcccgggtcgtcacgatccaggag

SEQ ID NO: 73485 - protein, 192 aa, Zea mays
  misc_feature: Ceres CLONE 1557849
  misc_feature (71)..(192): Pfam Name: Sulfotransfer_1 Pfam Description: Sulfotransferase domain
  misc_feature: SWISSPROT Homolog: EC 2.8.2.4 Estrone sulfotransferase
MMASRQSENNAQEETSPLTTPNANIARIIPSLPLETRWPPFPLRRYANFWLPEVTLKEGVPGVHSCFEPRPTDVFLASFPKSGTTWLKALAFATLKRSTHPPFDDDHPLRHCNPHDCVRFLELGFNQQKDELEALPSPRVLATHLPYSLLPGSITGDGEHSGCRIVYVCREPQDTLVSYWLFTRKAAPALWG

SEQ ID NO: 73486 - DNA, 805 bp, Zea mays
  misc_feature: Ceres CLONE 1557852
  misc_feature: Encodes the peptide sequence at SEQ ID NO. 73487
ctccccgcggtggcggccgctctagaactagtggatcccccgggctgcaggaattcgtctcacccctagaaaaaaacctggacatgtcggcatacaccaccacgcccgactaccgcatcccgctgacggcgctgggcgcggagcaggcgcgcgccgcggggcagcgcatccgcgacgtggtggcgggcagcggcaactggaaggtctacttctacgtgtccccctacgcgcgcacccgcgccacgctgcgcgagatcggccgcgccttcccgcgggaccgcgtcatcggcgcccgcgaggagtgccgcgtccgggagcaggacttcggcaacttccaggtggaggagcgcatgctcgccgtcaaggagacgcgccagcgcttcggccgcttcttcttccgcttccccgagggcgagtccgccgccgacgtcttcgaccgcgtcgccagcttccttgagtcgctgtggcaggacatcgacatggggcggctggaccaggaccacagctgcgagacgaacctggtgatcgtctcccacgggctcacctcacgggtgttcctgatgaagtggctcaagtggacggtggcccagttctagcgcctcagcaacttcgacaactgcgagttcaagggcatgcagctgggccccagcggggagtactccctcctcgttgaccacaccctatacgagctccagctgtgcggcatgtcgcccggaaatgatcgcctaccagcagtggcgcgcctccgccaatcaaccgctgcagggccgaggaatgctcctcctttatcaacagcttcttgcaa

SEQ ID NO: 73487 - protein, 197 aa, Zea mays
  misc_feature: Ceres CLONE 1557852
  misc_feature (25)..(185): Pfam Name: PGAM Pfam Description: Phosphoglycerate mutase family
PRGGGRSRTSGSPGLQEFVSPLEKNLDMSAYTTTPDYRIPLTALGAEQARAAGQRIRDVVAGSGNWKVYFYVSPYARTRATLREIGRAFPRDRVIGAREECRVREQDFGNFQVEERMLAVKETRQRFGRFFFRFPEGESAADVFDRVASFLESLWQDIDMGRLDQDHSCETNLVIVSHGLTSRVFLMKWLKWTVAQF

SEQ ID NO: 73488 - DNA, 824 bp, Zea mays
  misc_feature: Ceres CLONE 1557855
  misc_feature: Encodes the peptide sequence at SEQ ID NO. 73489
  misc_feature (775)..(775): n is a, c, t, g, unknown, or other
  misc_feature (823)..(823): n is a, c, t, g, unknown, or other
tggagctccccgcggtggcggccgctctagaactagtggatcccccgggctgcaggaattcgtctcacccctagaaaaaacttcaccccagttcgccgtctacgcgctccgtctcccccaaaccccacctcctcgccggaaccctagcccccgccgacgcggcgccatgagggagatcctccacattcagggcggacagtgcggtaaccagatcggtgcgaagttctgggaggtgatctgcgacgagcacggcatcgaccacaccggcaagtatgccggcgactccgacctccagctcgagcgcatcaacgtctactacaacgaggccagcggcggccgcttcgtcccgcgcgccgtcctcatggaccttgagcccggcaccatggactccgtgcgctcggggcccttcggccagatcttccgccccgacaacttcgtcttcggccagtccggcgccggcaacaactgggccaagggccactacaccgagggcgccgagctaatcgactccgtgctggacgtcgtgcgcaaggaggccgagaattgcgactgcctccaagggttccaggtctgccactcgctgggaggaggtactggttcaggaatgggcaccctgctcatctctaagatcagggaggagtacccggatcggatgatgttaacattctctgttttcccgtcgcccaaggtgtctgatactgtagtggagccctacaacgcaacgctctctgttcaccagctcgttgagaacgcagacgagtgcatggtgctcgancacgaggctctctatgacatctgcttccgcacgctcaagctttcccanc

SEQ ID NO: 73489 - protein, 218 aa, Zea mays
  misc_feature: Ceres CLONE 1557855
  misc_feature (45)..(218): Pfam Name: Tubulin Pfam Description: Tubulin/FtsZ family, GTPase domain
  misc_feature (203)..(203): Xaa is any aa, unknown, or other
MREILHIQGGQCGNQIGAKFWEVICDEHGIDHTGKYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLXHEALYDICFRTLKLS

SEQ ID NO: 73490 - DNA, 800 bp, Zea mays
  misc_feature: Ceres CLONE 1557858
  misc_feature: Encodes the peptide sequence at SEQ ID NO. 73491
  misc_feature (367)..(367): n is a, c, t, g, unknown, or other
  misc_feature (418)..(418): n is a, c, t, g, unknown, or other
  misc_feature (419)..(419): n is a, c, t, g, unknown, or other
  misc_feature (445)..(445): n is a, c, t, g, unknown, or other
  misc_feature (450)..(450): n is a, c, t, g, unknown, or other
  misc_feature (607)..(607): n is a, c, t, g, unknown, or other
  misc_feature (608)..(608): n is a, c, t, g, unknown, or other
  misc_feature (626)..(626): n is a, c, t, g, unknown, or other
ctggagctccccgcggtggcggccgctctagaactagtggatcccccgggctgcaggaattcgtctcacccctagaaaaaaacatacagatacagtacagttcacacactctcctgtctcctatccagccaccgaacgaagctagccaagatgtctcagttgctgcacctgccggacctcgcggcgccgcggaccaggatgggctcggcgctggcggcgggggcccgcgtcaagcagggggaggcggggacggcgagagggtgggtgctcaggctcgccgaccccgtgcggcgggagtgccgggtgccggtcccgctgccgccgccgccgccgccggtcctcgccgcggggaggcgcggagacgacnacaacgacgacggcgtcgacgaggataggcagaggtactaccctcacctgnngctacgcgatccggaacgctcagggnagagnctcccccgacgtgctctgcaagggaccacagcttcgacatctacagagacgacatttgtcttcagagaccctctgaacacatttcagggcctgggaaactacaagaggctcttctgggcgctgcgccctcaccggccgggtctccttcagggcgtcnngggggttgaagtggtcancatatgggcagcccgcccgagaacagcatccctgcttcgctggaaccgcccacgggggtcccccgggttgcccttggggggggggctggggacccccccgccccgctttccaccgggggccgtcccgtgttacagcctcgacgggaaacgggaaagatcttccaaagcccaagg

SEQ ID NO: 73491 - protein, 216 aa, Zea mays
  misc_feature: Ceres CLONE 1557858
  misc_feature (73)..(73): Xaa is any aa, unknown, or other
  misc_feature (90)..(90): Xaa is any aa, unknown, or other
  misc_feature (99)..(99): Xaa is any aa, unknown, or other
  misc_feature (100)..(100): Xaa is any aa, unknown, or other
  misc_feature (153)..(153): Xaa is any aa, unknown, or other
  misc_feature (159)..(159): Xaa is any aa, unknown, or other
MSQLLHLPDLAAPRTRMGSALAAGARVKQGEAGTARGWVLRLADPVRRECRVPVPLPPPPPPVLAAGRRGDDXNDDGVDEDRQRYYPHLXLRDPERSGXXLPRRALQGTTASTSTETTFVFRDPLNTFQGLGNYKRLFWALRPHRPGLLQGVXGVEVVXIWAARPRTASLLRWNRPRGSPGLPLGGGLGTPPPRFPPGAVPCYSLDGKRERSSKAQ

SEQ ID NO: 73492 - DNA, 815 bp, Zea mays
  misc_feature: Ceres CLONE 1557860
aaagctggagctccccgcggtggcggccgctctagaactagtggatcccccgggctgcaggaattcgtctcacccctagaaaaaacacacacactgaccgacacagcagctccgctcgtcgatcagctctcggctgaccactcatcgccagtgggtgcctgccgaccaggtctcgccgccgccaccgccgcggtagagaggggagggagagggggaaaaaactggcccagatcgagaggtacagcacgaaaaagagaggcaagagagataggggaccggagggcggcgggccggggcccaagaccgaggggctcgtgcgcaggaagctgatgaggctcctgtcgctcgtccccttcggctgccgtgctgggacccatcgacgacgcgccgccgtcctgtggaaccaccttccccccacctgccgcaaagaaggccccccgaaagaaagaagggccaaaaaaagccccccaatctttttggggggctttcttccaggggggcccccccaaaaaaggggggcccccttttttggggaaaattttgggaggagaaaaagaaaaattcctcaaatccctaaagggttcaagaagagggggttttttggggaaaacccccgggggggcttttccccccgcccacaaggggggagaaaaaaaaatccccggcccctttttgggggggggggtttttcccttcccccaacggtttttccccccaacaaagaggttttctctggttgaaaaaaaaaagagggggggggggggagggggaaaaaatctgtttgtttcttctccctccaggtgggggggaagggg

SEQ ID NO: 73493 - DNA, 843 bp, Zea mays
  misc_feature: Ceres CLONE 1557862
  misc_feature: Encodes the peptide sequence at SEQ ID NO. 73494
ctggagctccccgcggtggcggccgctctagaactagtggatcccccgggctgcaggaattcgtctcacccctagaaaaacttcccttccccgcaactactctgtgctctctactacacgcttctatctaagagaacagaccagaccacgcacgccggcagagaaaaaccagaattctccaagcaatcctatcgccaacccggccacggatcggggctgccgtctgtttccgccggcgctggcgccgacgccgatgggctccgccgatcgcagtaagctgcagatcgacgggatcgtggtgacggagaaaggcgccaggagctgcgtcgaatgccgcgccaccaccacgcccatgtggcgcagtggcccgaccgggcccaggtcactttgcaacgcttgcgggattcggtaccgaaagaagaggaggcaagagcttggcctagagcacaacaagcagcagcaacaactaccaaataatggcgaggcgaagactggagtaaaagacagctctagcaacagcagtagcagcgggagcagcaactttcacgtggtgcagaaactgacgctcctaatggaagtggagaagctgctctgctgctgatgaccccatcttttttcgcccgcatccacaatgctacctgggctaggaaccctggaacccccaaatcaacgatgggtcttccccccccgggggtttcccccccccaaacccttttaaagggtccccctcccaaggaattcccaggtccaaaatggaaaaaaggtttttctccaaccccccttttggaaaaaatggggaaagggggggggggccataacccccgggggaggttggtgggcacc

SEQ ID NO: 73494 - protein, 115 aa, Zea mays
  misc_feature: Ceres CLONE 1557862
  misc_feature (24)..(59): Pfam Name: GATA Pfam Description: GATA zinc finger
MGSADRSKLQIDGIVVTEKGARSCVECRATTTPMWRSGPTGPRSLCNACGIRYRKKRRQELGLEHNKQQQQLPNNGEAKTGVKDSSSNSSSSGSSNFHVVQKLTLLMEVEKLLCC

SEQ ID NO: 73495 - DNA, 857 bp, Zea mays
  misc_feature: Ceres CLONE 1557867
  misc_feature: Encodes the peptide sequence at SEQ ID NO. 73496
ctccccgcggtggcggccgctctagaactagtggatcccccgggctgcaggaattcgtctcacccctagaaaaaaactaccaaccaaccaaccaaccaagcttcgagccgtcgagtcgaagcatctgggccacgccgccacaaaaggaaacgagaagacaaggcctccgcggctccgcccccgatgcctccgctcctcacctcacccgcctccctcccctccgcctcccctctcctcgtctcctgtatcggcgctctccaccgccccggccccttcctccaccagcgcgccgccgcctcggtccacttcctcgcgccgcacaggaagacccgaccgccccccgcgatgagctggcttgggaagctgggcctgagcgggcttggaggcagcccgcgcgcgtcggaggcgtcggcagcgctggcgcaggggcccgacgaggaccagcccgcgccggggaacgagttcgcgcaattcggcgccggctgcttctggggcgtggagctcgcgttccagcgcgtgccgggagtcacccgcacggaggtcggctacagccagggcaacatccacgatccgacctacgaggacgtctgcaccggcaccacaaaccacaacgaagtcgtccgcgtgcaatacgacccggccgcctgcaagtacgacgacctcttcgacaacttctgggggcgccacgaccccactactcccaaacgaacaggggaatgatgttggaacacagtataggttaagggatatactacttttaccccaaaacaggaaaaagccggcaaaaaattcccttggagaaaccaacaaaaactttttgaaaccggaaaaatcgtctccccaaaaatcgttcccaa

SEQ ID NO: 73496 - protein, 178 aa, Zea mays
  misc_feature: Ceres CLONE 1557867
  misc_feature (93)..(178): Pfam Name: PMSR Pfam Description: Peptide methionine sulfoxide reductase
  misc_feature: SWISSPROT Homolog: EC 1.8.4.11 Peptide-methionine-(S)-S-oxide reductase
MPPLLTSPASLPSASPLLVSCIGALHRPGPFLHQRAAASVHFLAPHRKTRPPPAMSWLGKLGLSGLGGSPRASEASAALAQGPDEDQPAPGNEFAQFGAGCFWGVELAFQRVPGVTRTEVGYSQGNIHDPTYEDVCTGTTNHNEVVRVQYDPAACKYDDLFDNFWGRHDPTTPKRTGE

SEQ ID NO: 73497 - DNA, 839 bp, Zea mays
  misc_feature: Ceres CLONE 1557869
  misc_feature: Encodes the peptide sequence at SEQ ID NO. 73498
  misc_feature (750)..(750): n is a, c, t, g, unknown, or other
  misc_feature (753)..(753): n is a, c, t, g, unknown, or other
ctggagctccccgcggtggcggccgctctagaactagtggatcccccgggctgcaggaattcgtctcacccctagaaaaaaccaccagcagcgcatccaagccaagcggcctcctcttcccgggcaaagcagagcaagcagaagcagtgcaacaatggccgtggggttccgtcggacgctgaccacgctggcgtcgcccaagtcgatggctccgtcgttcctgctggactgcgcgcggcccaagaagctgtcgtacgcgcgggtgcggtcgaccagcctccccgtgcggctgcacccgctggcggcggcgctgcacgagtcggcgcgcgcgctgctggcgtgggcggacgcgccggcgcagacggggcccgcgtgggtggcggacggcgccgggcgcgcggggcgcgtgctgtcggggctggcggacctgctccaccacccgcaggcccgcgacgcgctccggcggcacccctggacgacggagcagctgctggacgacctgctcctgctggccgacctccacgggtgcttccgcgagtcgctggtggcgctgacgcagctcctggccgagacgcacgcggcgctgcgcaggcgcgacggcgcccgcctcgccgccgcgctgcgggcgcagcggcggtcggcgcgggaggtgtcccgcctggcgtcctccgcgcgggacctctcccaccgcgcggcgcccgacgacgactccgacgaggccaccctcgccgacgccttcgcggccgcaanggntttgccgtggacggcagcctcggccgacgtcttcgccggcttgttcgccgcgttcgccatagtcggcggccagcttccgcgccgtc

SEQ ID NO: 73498 - protein, 228 aa, Zea mays
  misc_feature: Ceres CLONE 1557869
  misc_feature (199)..(199): Xaa is any aa, unknown, or other
  misc_feature (200)..(200): Xaa is any aa, unknown, or other
MAVGFRRTLTTLASPKSMAPSFLLDCARPKKLSYARVRSTSLPVRLHPLAAALHESARALLAWADAPAQTGPAWVADGAGRAGRVLSGLADLLHHPQARDALRRHPWTTEQLLDDLLLLADLHGCFRESLVALTQLLAETHAALRRRDGARLAAALRAQRRSAREVSRLASSARDLSHRAAPDDDSDEATLADAFAAAXXLPWTAASADVFAGLFAAFAIVGGQLPRR

SEQ ID NO: 73499 - DNA, 836 bp, Zea mays
  misc_feature: Ceres CLONE 1557870
  misc_feature: Translation starting site: 154
ctccccgcggtggcggccgctctagaactagtggatcccccgggctgcaggaattcgtctcacccctagaaaaaaccagtccaccaccaccgcatccaagccaagcggcctcctcttcctgggcaaagcagagcaagcagaagcagtgcaacaatggccgtggggttccgtcggacgctgaccacgctggcgtcgcccaagtcgatggctccgtcgttcctgctggactgcgcgcggcccaagaagctgtcgtacgcgcgggtgcggtcgaccagcctccccgtgcggctgcacccgctggcggcggcgctgcacgagtcggcgcgcgctgctggcgtgggcggacgcgccggcgcagacggggcccgcgtgggtggcggacggcgccgggcgcgcggggcgcgtgctgtcggggctggcggacctgctccaccacccgcaggcccgcgacgcgctgcggcggcacccctggacgacggagcagctgctggacgacctgctcctgctggccgacctccacgggtgcttccgcgagtcgctggtggcgctgacgcagctcctggccgagacgcacgcggcgctgcgcaggcgcgacggcgcccgcctcgccgccgcgctgcgggcgcagcggcggtcggcgcgggaggtgtcccgcctggcgtcctccgcgcgggacctctcccaccgcgcggcgcccgacgacgactccgacgaggccaccctcgccgacgccttcgcggccgcacggggcgtcgtggccgccgccttcggccgcggtctttcgccgggcgtgtccgccgcgttcgcccgagtcggcgggcaagcgcgcgccgatc

SEQ ID NO: 73500 - DNA, 831 bp, Zea mays
  misc_feature: Ceres CLONE 1557873
  misc_feature: Encodes the peptide sequence at SEQ ID NO. 73501
tggagctccccgcggtggcggccgctctagaactagtggatcccccgggctgcaggaattcgtctcacccctagaaaaagtgcctcttcatttttatgcacgcccagacggcggaggaagggggaaagaggagggcagagcagcaacagtacatcgagcgagggagtagagcaaattgaatcaggtttcgtgtcgattcggaggctttcgcttctgcttgcggagttgcggtggagatttgaggcctgcggcgacgatggcacctgcggaatccggggagaaggcgaccagcttcgccatggcctgcagcctgctcagccgctacgtcaggcagaacggtgccgcggctgccgatctcggcctcgctatcagagctgaatccgatgcaaagaggacgtcgacggacatggaaaagggggagacggggaaggagaccatggatctcttcccccagatcgctggattcggctcggaggctgccacgaaggaagcccctgatgcgagggagccagagaagcgccaactgactatcttctatgggcgggagggtcttgtggtcgatgacttccctgctgagaaggcaaaagacctgatgcaaatggccagcaaggggtcatccgtagccaagaaccctggcttgctggctctttcacaggtggaaccgttactgacgcacccaagatcccaacattgccacccgcaccaattgttgtggccaagccccaaaaaaggcgcaaaattacccgaaggtctccggggattccttcccaagttccttgaaaaaaaaaaggtccctttcttggaaaaacccctcccggggtcccccttaaa

SEQ ID NO: 73501 - protein, 191 aa, Zea mays
  misc_feature: Ceres CLONE 1557873
MAPAESGEKATSFAMACSLLSRYVRQNGAAAADLGLAIRAESDAKRTSTDMEKGETGKETMDLFPQIAGFGSEAATKEAPDAREPEKRQLTIFYGREGLVVDDFPAEKAKDLMQMASKGSSVAKNPGLLALSQVEPLLTHPRSQHCHPHQLLWPSPKKGAKLPEGLRGFLPKFLEKKKVPFLEKPLPGSPL

SEQ ID NO: 73502 - DNA, 823 bp, Zea mays
  misc_feature: Ceres CLONE 1557874
  misc_feature: Encodes the peptide sequence at SEQ ID NO. 73503
  misc_feature (687)..(687): n is a, c, t, g, unknown, or other
  misc_feature (759)..(759): n is a, c, t, g, unknown, or other
agctccccgcggtggcggccgctctagaactagtggatcccccgggctgcaggaattcgtctcacccctagaaaaaaacttgcgtagagagttgggcgcagagaatccccaagcaaacaaacagggtagagggagaggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagctcctcgtccgcaacccgtttggtcaggttccagctctgcaggatggtgacttgtacctcttcgaatcacgagcaatctgctactaccccgctcgcaaaaacaagccagagctgttgagggaaggaaacctcgaggaggcagcaatggtggatgtttggatcgaggtggaggctaaccagtacaccgctgcactgaaccccatcctcttccaggtcctcatcagtccgatgcttgggggaaccaccgaccagaaagttgtggatgagcaccttgacacgctcgacaacctgctcgccctgtacgacgcacccctgaccacgtccacgtaccttgctggagacttcctcagcctccccgacctgaaccatcctncctcccactctctgcctgtttgctacccccctcccctctctgctcgacgcctacccccatgtcaaggcctgncgccctcgcctcctcccccaccccccctgtccccaaagtcccctgcccttatgaacccatctgt

SEQ ID NO: 73503 - protein, 214 aa, Zea mays
  misc_feature: Ceres CLONE 1557874
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
  misc_feature (170)..(170): Xaa is any aa, unknown, or other
  misc_feature (194)..(194): Xaa is any aa, unknown, or other
MAPMKLYGAVMSWNVTRCATALEEAGSDYEIVPINFATAEHKSPELLVRNPFGQVPALQDGDLYLFESRAICYYPARKNKPELLREGNLEEAAMVDVWIEVEANQYTAALNPILFQVLISPMLGGTTDQKVVDEHLDTLDNLLALYDAPLTTSTYLAGDFLSLPDLNHPXSHSLPVCYPPPLSARRLPPCQGLXPSPPPPPPLSPKSPALMNPS

SEQ ID NO: 73504 - DNA, 1053 bp, Zea mays
  misc_feature: Ceres CLONE 1557876
  misc_feature: Encodes the peptide sequence at SEQ ID NO. 73505
tctaataaggagggtggctgcttgtgctcgcccctcatttggtgtatagtatataaaaaaagaaaagagtggggttgggggaaaggggtgctccccgcgggggccgccgctctagaactagtggctcccccgggctgcaggaattcctctcacccctagaaaaaccgtctggccacccatccgatcccacccggcagcggcgctgctcaatggccacccacgcagctctcgccacctcccgaatccccgccggcgcccggctgcacagcatggcgccggcgtcgtccaggcacggcgtgcagaggctagacttccccaacttctccgggctcaggccggggtcgtgctccgtgagcgctgccgcgcgagaggcgtccttctccgacgtccttggcacgcagctcgtcgccaaggccaccggggagaacgccgtgagggcgcccgcagaggcgaagctgaaagtggcgatcaacggcttcggccgcatcggccggaacttcctccggtgctggcacggccgcgaggactcgccgatcgacgtcgacgacgtaaacgacagacgaaagcgtcaaggaacacagtcccaccgtcctcaagaacaaactcggatgctcgggcacccttcaaaggccgaacaatgcgaggatccgctggagacgaaacacggatcctattcaagacggagcggactgggccaaatccccagttcaaccgggttcctttccaccccaaggcaatgagggtacccgccaacatcctaagagcttccccccaaaaaaaagaggaggaatgcctactccggcaaatgtggaaccaatccagaccatttcgggagggaggcaacccagggtaggggcgtttccctttacaaaacgaggcccccccgggagcaacacaaaacaaagtgcagccagtcccaaaggacccgggggcgccggaaatggacagggctggaatcaaatcaacggggctttcccccgcgccagaggggaccggcctcaaaccattccctggaacccttaagtaatccgtcctgggcgttctaaacacaaa

SEQ ID NO: 73505 - protein, 156 aa, Zea mays
  misc_feature: Ceres CLONE 1557876
  misc_feature: SWISSPROT Homolog: EC 1.2.1.13 Glyceraldehyde-3-phosphate dehydrogenase (NADP(+)) (phosphorylating)
MAPASSRHGVQRLDFPNFSGLRPGSCSVSAAAREASFSDVLGTQLVAKATGENAVRAPAEAKLKVAINGFGRIGRNFLRCWHGREDSPIDVDDVNDRRKRQGTQSHRPQEQTRMLGHPSKAEQCEDPLETKHGSYSRRSGLGQIPSSTGFLSTPRQ

SEQ ID NO: 73506 - DNA, 806 bp, Zea mays
  misc_feature: Ceres CLONE 1557880
  misc_feature: Encodes the peptide sequence at SEQ ID NO. 73507
  misc_feature (538)..(538): n is a, c, t, g, unknown, or other
  misc_feature (586)..(586): n is a, c, t, g, unknown, or other
  misc_feature (593)..(593): n is a, c, t, g, unknown, or other
  misc_feature (675)..(675): n is a, c, t, g, unknown, or other
ctccccgcggtggcggccgctctagaactagtggatcccccgggctgcaggaattcgtctcacccctagaaaaactgcacccaaagcttccggagaattcctcccttgccccgccgtcgcatcctcttcgaagttcgaatcgaatcgcgccgcgatcacccacctcatggcggacaaggagcctgtcgtggagcggccagaggcgggtgaggaggaggaggacgcctcagccgccgccgccgcgggggaggaggaggacacgggcgcccaggtggctcccatcgtgcggcttgaggaggtagccgtcaccaccggcgaggaggacgaggacgtcctgctcgacatgaaggcgaagctgtaccgattcgacaaagacggtaaccaatggaaggaacggggcacgggcgctgtcaagcttctcaagcacaagcagaccggcaaggtccgcctagtcatgcgccaggctaaaacgcttaagatctgcgcgaaccacctcgtggcctcccacacgaagatgcaggagcatgcgggcagcgancagtcgtgtgtttggcacgctgctgactttgccgatggcgaacttaangaagagnatgttgccatcaggtttgggtcggtaagaaactggcagaagttcaagagttggttgaggaaatacctgaatcccttacaagnaaccagggcaggaaagggaaaaagggggttccacggctggaatgcttggcaaacttcttgggagccagggcaattctaaggaaatgggcaggcttgaacccctgaatttgggcaaagggactgaaacccaa

SEQ ID NO: 73507 - protein, 195 aa, Zea mays
  misc_feature: Ceres CLONE 1557880
  misc_feature (46)..(167): Pfam Name: Ran_BP1 Pfam Description: RanBP1 domain
  misc_feature (124)..(124): Xaa is any aa, unknown, or other
  misc_feature (140)..(140): Xaa is any aa, unknown, or other
  misc_feature (143)..(143): Xaa is any aa, unknown, or other
  misc_feature (170)..(170): Xaa is any aa, unknown, or other
MADKEPVVERPEAGEEEEDASAAAAAGEEEDTGAQVAPIVRLEEVAVTTGEEDEDVLLDMKAKLYRFDKDGNQWKERGTGAVKLLKHKQTGKVRLVMRQAKTLKICANHLVASHTKMQEHAGSXQSCVWHAADFADGELXEEXVAIRFGSVRNWQKFKSWLRKYLNPLQXTRAGKGKRGFHGWNAWQTSWEPGQF

SEQ ID NO: 73508 - DNA, 833 bp, Zea mays
  misc_feature: Ceres CLONE 1557881
  misc_feature: Translation starting site: 156
  misc_feature (283)..(283): n is a, c, t, g, unknown, or other
  misc_feature (757)..(757): n is a, c, t, g, unknown, or other
  misc_feature (817)..(817): n is a, c, t, g, unknown, or other
ctccccgcggtggcggccgctctagaactagtggatcccccgggctgcaggaattcgtctcacccctagaaaaagcagccaaccatctaccagcgactcagcgagcgagagcagcacacacgcagctagctaggagcagcagcagagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctnacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaacctccctcccctccagcgctccagctcccctccatcctcggccaaaaattctgcggcgagctccgatccggtccgactactaacccacgccgcagaagccgcgcgacctgatcgcgcgggggtcgaggaanaggggaagcgcgggcgccccggtttgcctgcccacgtaccgccgcagggagaagaagaangagcccgtatcccctc

SEQ ID NO: 73509 - DNA, 860 bp, Zea mays
  misc_feature: Ceres CLONE 1557882
  misc_feature: Encodes the peptide sequence at SEQ ID NO. 73510
ctccccgcggtggcggccgctctagaactagtggatcccccgggctgcaggaattcgtctcacccctagaaaaagcagcagaagcaaaagccgcaggccgcaactactccgatctgagtatcacagtcacagctaatagctagccagcagcccagcacccagcaactacccgtacgtacgaacgtgcgcttccgatggcgaccacggtgatggcctccgcgaccgcgagctcccccgccttctccgcccccggcgcgcgcgccaggcgcgccgcccggcttccggcggggttccgcggccgtgtcgccgcgccgccgcgccgcctcgcgctgctcgccagggcctcccagcaggccgatgacgctgccgccgacacgagcgcgagcgcggcgccggctgctcggaagctggggctctgggacgcgctggcgttcagcgggcccgcgccggagcggatcaacgggcggctggcgatggtgggcttcgtgtccgcgctcgccgtcgaggccacccgcggcgacggcatcctctcgcaggccggcaacggcgcccgcctcgcgtggttcgcgtacaccgccgctgtcctgtccgccgcgtcccttggtgccgctgctccagggggaagagacgcccagggcaggaaccggccggttcatgaacccccgacgcccaaacctctggaaaagggcccccttcgccatggctcgggcttcgtttggggcttccccggtacccaaaaaaccttatacgggggcggcccctcttttttaaaggggggaaaaataataaataaaaagccccgccaaccgttaaagatttgtggaaaaaaaaagggggaagaaaactttttaaaattttgg

SEQ ID NO: 73510 - protein, 222 aa, Zea mays
  misc_feature: Ceres CLONE 1557882
MATTVMASATASSPAFSAPGARARRAARLPAGFRGRVAAPPRRLALLARASQQADDAAADTSASAAPAARKLGLWDALAFSGPAPERINGRLAMVGFVSALAVEATRGDGILSQAGNGARLAWFAYTAAVLSAASLGAAAPGGRDAQGRNRPVHEPPTPKPLEKGPLRHGSGFVWGFPGTQKTLYGGGPSFLKGGKIINKKPRQPLKICGKKKGEENFLKFW

SEQ ID NO: 73511 - DNA, 781 bp, Zea mays
  misc_feature: Ceres CLONE 1557883
  misc_feature: Encodes the peptide sequence at SEQ ID NO. 73512
ctccccgcggtggcggccgctctagaactagtggatcccccgggctgcaggaattcgtctcacccctagaaaaagttacgtaacacggcgattcaggaggggatagcatcgtcatcgcaaaatgcaggctctcctgctccccgcgcgggccgcgccgccgacgccggcgatgcttcggcagcgtgcggtttctgcctccgcgtgtgcgtcgcaggtctgccgccccctattcggtgccgccaattgcatctcctgtggggtctacggaagcgttcggcggcacctcacagtggcggtggcggcggccccgccctcgccttcgtcctcaccttcgtcgggaccgctctacccgacgcctccacccaccgagcaggaggtggagagggtcaagctcgagcaggttatgaggagactagagaaaacagcaaggtatttcaagaatttgggtaccctggggttctggtcccaattggtgtgcacaattatttctgctggaattttggcattctctacagttgtaacggggaaggtgacatcaccctttacattctatgcaactgctgctggtattgctgctgcttttatttcagtcttctggtcatttgggttacacccgtctctctgaaaaggctagaaaaacatccaaagacctgcttaggctccctccccttgctgatggtgttaaaagccctaaaaaatggcatccgggggttaaatttccttgggatggggcctttgctttttccggaatgaaaaccaacagggtggggggccttgggga

SEQ ID NO: 73512 - protein, 151 aa, Zea mays
  misc_feature: Ceres CLONE 1557883
MLRQRAVSASACASQVCRPLFGAANCISCGVYGSVRRHLTVAVAAAPPSPSSSPSSGPLYPTPPPTEQEVERVKLEQVMRRLEKTARYFKNLGTLGFWSQLVCTIISAGILAFSTVVTGKVTSPFTFYATAAGIAAAFISVFWSFGLHPSL

SEQ ID NO: 73513 - DNA, 777 bp, Zea mays
  misc_feature: Ceres CLONE 1557884
  misc_feature: Encodes the peptide sequence at SEQ ID NO. 73514
ggagctccccgcggtggcggccgctctagaactagtggatcccccgggctgcaggaattcgtctcacccctagaaaaaaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctatagctcctgcgtgagctagtagctagctagtgccatgcgtcgtctctgtcgttcggttttgcttcggggtcaccgtaccctttgcttgctt

SEQ ID NO: 73514 - protein, 170 aa, Zea mays; identical to SEQ ID NO: 73340
  misc_feature: Ceres CLONE 1557884
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase

SEQ ID NO: 73515 - DNA, 957 bp, Zea mays
  misc_feature: Ceres CLONE 1557889
  misc_feature: Encodes the peptide sequence at SEQ ID NO. 73516
  misc_feature (172)..(172): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
ctccccgcggtggcggccgctctagaactagtggatcccccgggctgcaggaattcgtctcacccctagaaaaacttccagtcccaggagcgtggcctcactctcctcgtcgcatcccccctcctcatcttcgcagcgcgggcggcggcaatggcgatggcctccacctacncgccgggcggaggcgcgcgggcgctcgcgcagggtagatgcagggtccgcggtcccgcggggctgggcttcctcggcccctccaagccgccgggctgccccgccccctctgcctcgcagggggatgagcaaccccttacacgtgggcgccaggcccgcatcatgccgggtcccctcccccccccccgctcccggggggcgccgcaccggccccccgggtttttttccctttcaaaaaagagggcggccaagcttgtgtctaccccttgcacccttnnnccnnnctcgggggggcgcaaacccnnnnnnnatatcactcacggcccccctnnnnntctccaaaaaaaattttccccccaaaaccccccctggaaaaattttggaaaaacctctttttttggcgcccccccccccttccggggggggttttttacaaaaaaacccccggggggggggggcccccggggggtgtttaaacaaccccccccgcggcggggttttttataaaaaagagcttctttcccccccccgcaaaaaaaaaaaaacactttttttttaaaaaaaaaaaaactcccccccccccaccttttttataaaagaggcgccgcaacaagaaaaagaggcccccccccgggggggggctcccccctttctcggggggggggggggcccccccaaaaaaaaacctctttttttttcccccccgggaatttttttttaacaaaaaaaattcccccccgcgcgggggttttttaatgtgggcggcacaccccccccgcggggggg

SEQ ID NO: 73516 - protein, 175 aa, Zea mays
  misc_feature: Ceres CLONE 1557889
  misc_feature (8)..(8): Xaa is any aa, unknown, or other
  misc_feature (100)..(100): Xaa is any aa, unknown, or other
  misc_feature (102)..(102): Xaa is any aa, unknown, or other
  misc_feature (109)..(109): Xaa is any aa, unknown, or other
  misc_feature (110)..(110): Xaa is any aa, unknown, or other
  misc_feature (111)..(111): Xaa is any aa, unknown, or other
  misc_feature (118)..(118): Xaa is any aa, unknown, or other
  misc_feature (119)..(119): Xaa is any aa, unknown, or other
MAMASTYXPGGGARALAQGRCRVRGPAGLGFLGPSKPPGCPAPSASQGDEQPLTRGRQARIMPGPLPPPRSRGAPHRPPGFFSLSKKRAAKLVSTPCTLXPXSGGRKPXXXITHGPPXXLQKKFSPQNPPWKNFGKTSFFGAPPPFRGGFFTKKPPGGGGPRGVFKQPPPRRGFL

SEQ ID NO: 73517 - DNA, 647 bp, Zea mays
  misc_feature: Ceres CLONE 1557891
  misc_feature: Encodes the peptide sequence at SEQ ID NO. 73518
tccccgcggtggcggccgctctgaatagtggatcccccgggctgcaggaattcgtctcacccctagaaaaagcgtctccgcctcatggcggcatcagcgtctcggcccctcgcgctcctcgcgtgcacctcggcatctcacggcgctgggcggcgggcgtgggctcgcttggctgtctcttcctattcggcgaggtcggcgctccccaggctccgcgggcgtcggtcgttcgccgcctccgcagggggcgcccgtgatgggggaacccagggcccccggcgccgtttgacgcccgacctccggggatgggaaccccctttcaaacgggcgggcttcaattttttaaaaggaacaaaatgcccattttttaaggggggggttggaaaccccggacccaatttttttcttttcggggcccccccgaaaaactcccccaaaaaattttaaaaaaagttggcgcccatttttttttcttgtgggggggaaaaaaaaaaatttttgacccccccctcttggagaaaaaaaaaattttctcctttttggaaaaaaaaaaaaaaaaaaccttttttttttttccaaggggggggtggggtttttttcccccccccccttttttttttcaataaaaaaaaaacccccctccaaac

SEQ ID NO: 73518 - protein, 120 aa, Zea mays
  misc_feature: Ceres CLONE 1557891
MAASASRPLALLACTSASHGAGRRAWARLAVSSYSARSALPRLRGRRSFAASAGGARDGGTQGPRRRLTPDLRGWEPPFKRAGFNFLKGTKCPFFKGGVGNPGPNFFLFGAPPKNSPKKF

SEQ ID NO: 73519 - DNA, 760 bp, Zea mays
  misc_feature: Ceres CLONE 1557893
  misc_feature: Encodes the peptide sequence at SEQ ID NO. 73520
  misc_feature (490)..(490): n is a, c, t, g, unknown, or other
  misc_feature (504)..(504): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (709)..(709): n is a, c, t, g, unknown, or other
  misc_feature (715)..(715): n is a, c, t, g, unknown, or other
tggagctccccgcggtggcggccgctctagaactagtggatcccccgggctgcaggaattcgtctcacccctagaaaaaaaaaaattcccttcgaaccggccggtggccttcgttctcccaccaggcctgtctgtctgctgtatccgccagagcttccatggattccaccctcttcatcatcggcgtcataggcaacatcatctcagttctcgtcttcatatcgcctatcaagacgttctggaggatcgtgcggggcgggacgacggaggagttcgagccggcgccgtacgtgttgacgctgctcaacgcgctgctgtggctctactacggcctcaccaagcccgacggcttcctcgtcgccaccgtcaatggctttggggctgtcatggaggccatctacgtcgtcctcttcatcgtctacgccgccaaccatgccacaagggttaagaccgcaaagctggcagcagcgttggacatcggtggctttcngagtcgtgtttgcnggcaccaccattcgccatcagtgaattttggaattgaaaaaatagggggaaaaagaaatgaaaatgtgccccgcccccaaatggggcccatggaacggggttccacccccccttttgttttttttttttttaaaaaaaaggggggggggccccccccaaaaaaaaaaaaagggggggggggggggggggnnnnnnnnnnnncctntctttnttttgggggggggggggggggtttctttttctctccccccaacat

SEQ ID NO: 73520 - protein, 200 aa, Zea mays
  misc_feature: Ceres CLONE 1557893
  misc_feature (6)..(93): Pfam Name: MtN3_slv Pfam Description: MtN3/saliva family
  misc_feature (111)..(111): Xaa is any aa, unknown, or other
  misc_feature (116)..(116): Xaa is any aa, unknown, or other
  misc_feature (179)..(179): Xaa is any aa, unknown, or other
  misc_feature (180)..(180): Xaa is any aa, unknown, or other
  misc_feature (181)..(181): Xaa is any aa, unknown, or other
  misc_feature (182)..(182): Xaa is any aa, unknown, or other
  misc_feature (183)..(183): Xaa is any aa, unknown, or other
  misc_feature (184)..(184): Xaa is any aa, unknown, or other
  misc_feature (186)..(186): Xaa is any aa, unknown, or other
MDSTLFIIGVIGNIISVLVFISPIKTFWRIVRGGTTEEFEPAPYVLTLLNALLWLYYGLTKPDGFLVATVNGFGAVMEAIYVVLFIVYAANHATRVKTAKLAAALDIGGFXSRVCXHHHSPSVNFGIEKIGGKRNENVPRPQMGPMERGSTPPFVFFFFKKKGGGPPPKKKKGGGGGGXXXXXXLXFGGGGGGFFFSPPN

SEQ ID NO: 73521 - DNA, 856 bp, Zea mays
  misc_feature: Ceres CLONE 1557894
  misc_feature: Encodes the peptide sequence at SEQ ID NO. 73522
ctccccgcggtggcggccgctctagaactagtggatcccccgggctgcaggaattcgtctcacccctagaaaaaaaaaaaaacaccagtgcgaatctataggaaccgcgtccatcagctgttgcagcgctacatgcgtccatgcaagggctgcttccaccatggcagatctcctccacggcgatggccggcaccccgcagtcaaggtgggctccttcggcgagggccgcatcaccatgcccaagaccgcgggcaagcccaaggtggctgcgtcaggcagccccatggtaccgcccccaccgcttcaagtacctcggccccttctctggcaagcccccaagctacctcaccggagagttcctccgccactactgctgggacaccttcgggctgacttccgatttcaacaccttcgccaagaatctcgcgctgaaagtcatccactccagctgggccatgatctgggtcactcggctgcgtctaatgctagctgctctcccgaactgcatccagatctgctagacccatatggttcaacgcaggcttccatattttaaacaggcggggatggaataccttggaacccccgcctgattcattcgtagaagaatttttcctttttggcctgggccaagggcgccccttgggggccaaccaagggaaacccgaaaagcgcggagggccatttccgttaaggtcccaaaaaaccaattttaccccggtggcggaagatttttgaaacccccctgggggcgcgtggggaaaaaaaaccccccaagggcttttttggggggaaattctagagggggggagagggggttttttttttaagggggggagcggccccctctcccctc

SEQ ID NO: 73522 - protein, 112 aa, Zea mays
  misc_feature: Ceres CLONE 1557894
MAGTPQSRWAPSARAASPCPRPRASPRWLRQAAPWYRPHRFKYLGPFSGKPPSYLTGEFLRHYCWDTFGLTSDFNTFAKNLALKVIHSSWAMIWVTRLRLMLAALPNCIQIC

SEQ ID NO: 73523 - DNA, 817 bp, Zea mays
  misc_feature: Ceres CLONE 1557895
  misc_feature: Encodes the peptide sequence at SEQ ID NO. 73524
  misc_feature (614)..(614): n is a, c, t, g, unknown, or other
  misc_feature (666)..(666): n is a, c, t, g, unknown, or other
  misc_feature (699)..(699): n is a, c, t, g, unknown, or other
ccccgcggtggcggccgctctagaactagtggatcccccgggctgcaggaattcgtctcacccctagaaaaagcacgccagacgccacccttttcccatctcccgtggccagccagacaaacaaatctctcgcgcctcccactcctccccgccactcgccgccagcgaccaaccatcgcccgcccagcagcagcacggtcccacgccaggactcgacccacgcgcggctagctaagctcccgccgccatgatcacggccctgcaggtctccggcggcggcctgccgctcctgttcgcccggcgccggcgccgggcgttccggccgccccaagcggtggcgtccgacgccgccgccgccgccgagggcacggcgagggaggatggcgggaaggtggccctgggcgggtccggcgtagccgtcaccaagctcggcgtcggggcgtggtcctggggcgacaccacctactggaacgagttccggtgggacgatacgaagctgaaggcagccaaaggagcgtttgacgcgagcatcgactgcggaataaccttcttcgacaccgccgaagtgtacggagcaggggtatcgggagcgattaattcagagagtttactangaaagggttatcaagagaagcagcggaaaggagcaggtggacgtggctgtcncgaccaagttcgcagctctttcatggaaggtcngtcggggggagcgtcatctgggccgctcaaggcctcgctggatcgcccttggcgtcttcttcgggtggagctctaccaacctccattgggcaaggaaaatgggggaaacaaaaaacac

SEQ ID NO: 73524 - protein, 190 aa, Zea mays
  misc_feature: Ceres CLONE 1557895
  misc_feature (123)..(123): Xaa is any aa, unknown, or other
  misc_feature (140)..(140): Xaa is any aa, unknown, or other
  misc_feature (151)..(151): Xaa is any aa, unknown, or other
MITALQVSGGGLPLLFARRRRRAFRPPQAVASDAAAAAEGTAREDGGKVALGGSGVAVTKLGVGAWSWGDTTYWNEFRWDDTKLKAAKGAFDASIDCGITFFDTAEVYGAGVSGAINSESLLXKGYQEKQRKGAGGRGCXDQVRSSFMEGXSGGASSGPLKASLDRPWRLLRVELYQPPLGKENGGNKKH

SEQ ID NO: 73525 - DNA, 775 bp, Zea mays
  misc_feature: Ceres CLONE 1557897
  misc_feature: Encodes the peptide sequence at SEQ ID NO. 73526
ctcaccgcggtggcggccgctctagaactagtggatcccccgggctgcaggaattcgtctcacccctagaaaaaccccaatccccctcgtctcacaaccctagctgcccccgaatccatggatcctaacaaatccagcaccccgccgccgcctccagtcatgggtgcccccgttgcctaccctccgcctgcgtaccctcccggtgtggccgccggcgccggcgcctacccgccgcagctctacgcaccgccggctgctgccgcggcccagcaggcggcggccgcgcagcagcagcagctgcagatattctgggcggagcagtaccgcgagatcgaggccactaccgacttcaagaatcacaacctcccgctcgcccgcatcaagaagatcatgaaagccgacgaggacgtccgcatgatcgccgccgaggctcccgtggtgttcgcccgggcctgcgagatgttcatcctcgagctcacccatcgcggctgggcgcacgccgaagagaacaagcgccgcacgctccagaaatccgacattgccgctgccatcgcccgcaccgaggtattcgacttccttgtggacatcgttccgcgcgacgacggtaaagacgctgatgcggcgggccgccgcagctgccgccggctgccgggaatccgggccccggcggccggagttaccagccaaccgaaccttcttcggcctaataataacgtgccctccagcggtaaatggtttccaatccttccccgtttatttggtttcccgtccctat

SEQ ID NO: 73526 - protein, 205 aa, Zea mays
  misc_feature: Ceres CLONE 1557897
  misc_feature (67)..(131): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 1107 in the 10/374,780 US patent application
MGAPVAYPPPAYPPGVAAGAGAYPPQLYAPPAAAAAQQAAAAQQQQLQIFWAEQYREIEATTDFKNHNLPLARIKKIMKADEDVRMIAAEAPVVFARACEMFILELTHRGWAHAEENKRRTLQKSDIAAAIARTEVFDFLVDIVPRDDGKDADAAGRRSCRRLPGIRAPAAGVTSQPNLLRPNNNVPSSGKWFPILPRLFGFPSL

SEQ ID NO: 73527 - DNA, 813 bp, Zea mays
  misc_feature: Ceres CLONE 1557901
  misc_feature: Encodes the peptide sequence at SEQ ID NO. 73528
  misc_feature (606)..(606): n is a, c, t, g, unknown, or other
ctccccgcggtggcggccgctctagaactagtggatcccccgggctgcaggaattcgtctcacccctagaaaaagctctgctctcctcgcatatagggtttatcttctcccctcctctgcccccatctcgcttctcgcacacggcagccggattccgaagcgcaccccctcggccccagccaaaagcatcgcagtttctaatcgtttggagagcacacaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaactgtcgtcaccccaaagtacacttcactgaagcctctgggagatagggtgcttgtgaagcttggtgccgcagaggagaagacagttggtggcattttgcttccatctactgcccagactaaaccacaaggaggtgaggttgttgctgttggagcaggaaggaccatcggggacaagaaaatagctgtggatatagagactggagcacaagtagtatactcaaagtatgctgggggactgaggttgaanttcatgactcaaagcatcttattctcaaagaagacgatatcattggtatttcttgagacagatgatgtggaggacatgaagcctctccaatgaccgtgttctcattcaaggttgcaaaaactaagaacaaacttctggggggcttattcttcctgaaacacttaggaagaagcctccataggaaaccgttgtatctttttggccccg

SEQ ID NO: 73528 - protein, 158 aa, Zea mays
  misc_feature: Ceres CLONE 1557901
  misc_feature (54)..(145): Pfam Name: Cpn10 Pfam Description: Chaperonin 10 Kd subunit
  misc_feature (128)..(128): Xaa is any aa, unknown, or other
MSFVQLSGAGVAAVAFTNKSLVSRHAALRVCSSRRSIRSLVVKAATVVTPKYTSLKPLGDRVLVKLGAAEEKTVGGILLPSTAQTKPQGGEVVAVGAGRTIGDKKIAVDIETGAQVVYSKYAGGLRLXFMTQSILFSKKTISLVFLETDDVEDMKPLQ

SEQ ID NO: 73529 - DNA, 881 bp, Zea mays
  misc_feature: Ceres CLONE 1557902
  misc_feature: Encodes the peptide sequence at SEQ ID NO. 73530
  misc_feature (529)..(529): n is a, c, t, g, unknown, or other
  misc_feature (601)..(601): n is a, c, t, g, unknown, or other
  misc_feature (659)..(659): n is a, c, t, g, unknown, or other
agctccccgcggtggcggccgctctagaactagtggatcccccgggctgcaggaattcgtctcacccctagaaaaaaataccaaaaccatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttcccggacagcttctgggcgggccgcgtggtggcgcgcacgggatgcagctccgggcattcccggtgcgagacggggagcgcagcgccggcgacggtggtgcagctggtggtgcacgcggaggggcaggacctggcgtcgtacagcgtgagcctggtggacgggttcaacgtgcccgccgtggtgagcccgcangcggtgggcggcgggcagtgcccggccctggggtgcgcggcggacctcaacgccgggtgcccgccctcgcancgcgtgctggggcggggggccgcgctttgttgcccttccaaggcccccccgggctacntcaaaggagcggtgccccgctgaagcgcaacacgcccaaccgacgtgggagcccgtgcccgcaaccggtgctttggcgccccggcgaagctcaaaggtcgtctttcttgccaatcccgcccttgggtgaacacccgccccccgcccccccaaaaaccaaacgccatcccgccaccgttcgttgcggaaaaaattaaaaggtaactagacgtgtctagcctgc

SEQ ID NO: 73530 - protein, 186 aa, Zea mays
  misc_feature: Ceres CLONE 1557902
  misc_feature (34)..(185): Pfam Name: Thaumatin Pfam Description: Thaumatin family
  misc_feature (136)..(136): Xaa is any aa, unknown, or other
  misc_feature (160)..(160): Xaa is any aa, unknown, or other
  misc_feature (180)..(180): Xaa is any aa, unknown, or other
MAGTAKTPVLGFLLALALVATSTPAAATTLTLHNLCPYPVWPLVSPNTGFPAISENTGRLDGGGRGLVSFRFPDSFWAGRVVARTGCSSGHSRCETGSAAPATVVQLVVHAEGQDLASYSVSLVDGFNVPAVVSPXAVGGGQCPALGCAADLNAGCPPSXRVLGRGAALCCPSKAPPGYXKGAVPR

SEQ ID NO: 73531 - DNA, 805 bp, Zea mays
  misc_feature: Ceres CLONE 1557903
  misc_feature: Encodes the peptide sequence at SEQ ID NO. 73532
ggagctccccgcggtggcggccgctctagaactagtggatcccccgggctgcaggaattcgtctcacccctagaaaaaaaaaatatccacttccgtcgtcctggactcgtagttcatccacgacgcaccgaaccgcaatggccacgttcctgggaagctcaccggcgctcctcgcccgtcccatcgccaagccccacatctcctgcgcgcagacaccgcgcccgccaagcgcccagaaccagccgccgtccagcgagcaaccgcaagcacaaacacagcagcagtccgtgcaagcgcagccacagcaggcgacggcgaggccgaagcgcgcaggcggcgcggactccacggactgggtggcctcgtcgctgacgcggcggttcgggatcggcgcggggctggcgtgggccggctttctggccgtcggcgtcgtgtccgagcagctcaagacccgcttcgaggtcgcgcagcagcaggccaacaccaaggacgtggaacaggagcaggaggtcgtcctgcccaacggggtccggtactacgagatgcgcgtcggcggcggcgacgtcccgcggccgggcgacctggtggtgatcgacctgcagggccgggtggccggcagtggcggcggcggggaagcgttcgtggacacgttcgtcgacggcaagcggccgctggcgctggtgatgggctcccggccgtacaccaggggcatgtgcgaaggcgtcaagtacgcgctgcgctccatgatggccggcggcaagcggcggggtgttcgtcccccccggggcctcggttcaggcgacaa

SEQ ID NO: 73532 - protein, 222 aa, Zea mays
  misc_feature: Ceres CLONE 1557903
MATFLGSSPALLARPIAKPHISCAQTPRPPSAQNQPPSSEQPQAQTQQQSVQAQPQQATARPKRAGGADSTDWVASSLTRRFGIGAGLAWAGFLAVGVVSEQLKTRFEVAQQQANTKDVEQEQEVVLPNGVRYYEMRVGGGDVPRPGDLVVIDLQGRVAGSGGGGEAFVDTFVDGKRPLALVMGSRPYTRGMCEGVKYALRSMMAGGKRRGVRPPRGLGSGD

SEQ ID NO: 73533 - DNA, 624 bp, Zea mays
  misc_feature: Ceres CLONE 1557906
  misc_feature: Encodes the peptide sequence at SEQ ID NO. 73534
agctccccgcggtggcggccgctctagaactagtggatcccccgggctgcaggaattcgtctcacccctagaaaaaattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgcccccagcaaacaacggggcagaacaacctggaaagaaccccctggaaaaaaaaggcccgggggccctggctttccgggccctccagccgaaagaaaaaaaccttacttttcggaaaaaattggccccctttctccctttttcccgaaaaaaccccgggaaatttaaaaccccccccctttttcggttttttccgccccccccaaaag

SEQ ID NO: 73534 - protein, 176 aa, Zea mays
  misc_feature: Ceres CLONE 1557906
  misc_feature: SWISSPROT Homolog: EC 3.1.27.1 Ribonuclease T(2)
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRCPQQTTGQNNLERTPWKKKARGPWLSGPSSRKKKTLLFGKNWPPFSLFPEKTPGNLKPPPFFGFFRPPQK

SEQ ID NO: 73535 - DNA, 771 bp, Zea mays
  misc_feature: Ceres CLONE 1557907
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (116)..(116): n is a, c, t, g, unknown, or other
  misc_feature (117)..(117): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (128)..(128): n is a, c, t, g, unknown, or other
  misc_feature (133)..(133): n is a, c, t, g, unknown, or other
  misc_feature (135)..(135): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (217)..(217): n is a, c, t, g, unknown, or other
  misc_feature (392)..(392): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccnnggnnnnnnccnaaaangntcnnnnnnnnnnnnnnnnnnnnnnnnnnnnnccaaaactggactcaaaccgggcggccgctctaaaactagtggaacccccnggctgcaagaattcgtctcacccctagaaaaaattagggttctacttctagcccgggccgactccactccaatccaatcctggggcgagcgactgcctccttccctcgatctattccccatcttgtcctccctttgctaaaaataacgaagcaaaaagcatcttcgatttgaagntgcgctttcctctttccctcgcttcgctctcgggtcgcaagtgaatgggcctgaaaagttccaaacaaaaaaaacccgtttggccctcaaaattggggaaaaaaacctggttccccgggggtaaaaaaaaaaaaattgaaaaataaaaaaaacccccccccccaaaaaggaaaaatccccctttttttccaagcaaaaaaaaaatttcgggggaaaaaaaaaaccctcccaaactcgtaaaaaaaggcaaaaaaaaaaaaggggggggggtttttcttttttaaaaaaaaaaaaaaaaaaaatttttttaacccgaaaaaaaaaaatttatttttccccccccaaagaagaaggttttttttttaaaaagaaaaatttt

SEQ ID NO: 73536 - DNA, 868 bp, Zea mays
  misc_feature: Ceres CLONE 1557911
  misc_feature: Encodes the peptide sequence at SEQ ID NO. 73537
  misc_feature (268)..(268): n is a, c, t, g, unknown, or other
ctggagctccccgcggtggcggccgctctagaactagtggatcccccgggctgcaggaattcgtctcacccctagaaaaaaccagctcgatcgcacgggagaagaggataagaggaagcgagtgggactgtgagtgagttggaaggaggggggtggcaatggcgttgcggaatggtggtggtggtggtggagcctgtcccgcggcggttgtgctggtggctgcggccgtcgcggcgctgctgggcgccggggtggcggcggcgaccgngttcgacgacgtggtgcagcccagctgggccaacgaccacgtggtgtacgacggcgacctcctcaagctccgcctcgactccagctccggcggagggttcgtgtcaaggaccaagttcctgtacggcccccccagccccgacctcaagctcgtgccgggggactccgccggcgtcgtcacggctttctatctgtcgtcggccggggacaagcacgacgacttcgacttcgagttcctgggcaacgtgaccggcgagccgtacctggtgcagacccacctgtacatcgacggcgtgggcaaccgggagcgccgcatctacctgaggttcgaccccacggccgacttccacacgtgcgccctgctgaggagccccacccagggtgctgtccatggtggacaacgcccccacccgggtgtccgaaaactccccgccttcaccaggggcccagccacggccccccacctgcacggcctgcgcggcgggcgaaggcagcggccccactcccccacccccccccgtgctgcctgccccggcgccccttcccagggcccctccccatgcccctttacccctcctcctgtacccgcaacgctggtgca

SEQ ID NO: 73537 - protein, 236 aa, Zea mays
  misc_feature: Ceres CLONE 1557911
  misc_feature (38)..(200): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature (37)..(37): Xaa is any aa, unknown, or other
MALRNGGGGGGACPAAVVLVAAAVAALLGAGVAAATXFDDVVQPSWANDHVVYDGDLLKLRLDSSSGGGFVSRTKFLYGPPSPDLKLVPGDSAGVVTAFYLSSAGDKHDDFDFEFLGNVTGEPYLVQTHLYIDGVGNRERRIYLRFDPTADFHTCALLRSPTQGAVHGGQRPHPGVRKLPAFTRGPATAPHLHGLRGGRRQRPHSPTPPRAACPGAPSQGPSPCPFTPPPVPATLV

SEQ ID NO: 73538 - DNA, 805 bp, Zea mays
  misc_feature: Ceres CLONE 1557912
  misc_feature: Encodes the peptide sequence at SEQ ID NO. 73539
gagctccccgcggtggcggccgctctagaactagtggatcccccgggctgcaggaattcgtctcacccctagaaaaaacactcacacagccatctctcccagtgtcccagctcagcttagcaatccgtctctctatctacaggcgggggaattaatagatggagggcaaggaggaggacgttcgcctgggcgccaaccgctactcggagcgccagccaatcggcacggcggcgcagggcacggaggagaaggactacaaggagcctccgccggcgccgctgttcgaggcggaggagctgacgtcgtggtccttctaccgggccgggatcgccgagttcgtggccaccttcctgttcctgtacatcagcatcctgactgtgatgggcgtgagcaagtcgtccagcaagtgcgccaccgtgggcatccagggcatcgcgtggtccttcggcggcatgatcttcgcgctggtgtactgcacggcgggcatctccggcggccacatcaacccggccgtcaccttcggcctcttcctggcgcggaagctgtcgctcacgcgcgcgctcttctacatggtcatgcagtgcctgggcgccatctgcggcgccggcgtcgtcaagggctccaggagggcctctacatgggcgccggcggcgggcgccacgcccgtcaccccggggtacacaaggggcgaacgggctcgggggcggaaatcgtcgggaccctttcgggtccgtttaaacccgtttttttcccccccccgaaacccaaaagggaggggccccgcgaaattccccctggtgcccac

SEQ ID NO: 73539 - protein, 215 aa, Zea mays
  misc_feature: Ceres CLONE 1557912
  misc_feature (46)..(215): Pfam Name: MIP Pfam Description: Major intrinsic protein
MEGKEEDVRLGANRYSERQPIGTAAQGTEEKDYKEPPPAPLFEAEELTSWSFYRAGIAEFVATFLFLYISILTVMGVSKSSSKCATVGIQGIAWSFGGMIFALVYCTAGISGGHINPAVTFGLFLARKLSLTRALFYMVMQCLGAICGAGVVKGSRRASTWAPAAGATPVTPGYTRGERARGRKSSGPFRVRLNPFFSPPRNPKGRGPAKFPLVP

SEQ ID NO: 73540 - DNA, 748 bp, Zea mays
  misc_feature: Ceres CLONE 1557921
  misc_feature: Encodes the peptide sequence at SEQ ID NO. 73541
ctccccgcggtggcggccgctctagaactagtggatcccccgggctgcaggaattcgtctcacccctagaaaaaatggtgttcacggtgtacggcgaccactggcgcaagatgcggcgcatcatgaccgtccccttcttcaccaacaaggtggtggcccagaaccgcgccgggtgggaggaggaggcccggctggtggtggaggacgtgaggaaggaccccgaggccgcggccggcggcgtcgtgctccgccgccgcctccagctgatgatgtacaacgacatgttccgcatcatgttcgaccgccggttcgacagcgagcacgacccgctcttcaacaagctcaaggcgctcaacgcggagcgcagccgcctgtcgcagagcttcgagtacaactacggcgacttcatccccgtgcttcgcccctttcctcgcggctaccttcaccgctgccacgacctcaagacgcccccaatgaagttcttcaagacaaatttctacaggaacgcaagaaagcggccaaatccatttctttttccttcctttccttttaacccaagtacctcccaattccacccggcccaccttggtttctgttttgttaacaacggggggaatttcaaattttcctctcccccccgggggaaggattaaaacctgggaggccggaaacttgtgggggaaaaaaacaattgggggggccttttcacacttgggcgccccccttggggggggggggggcgcccccc

SEQ ID NO: 73541 - protein, 216 aa, Zea mays
  misc_feature: Ceres CLONE 1557921
  misc_feature: SWISSPROT Homolog: EC 1.14.13.11 Trans-cinnamate 4-monooxygenase
PRGGGRSRTSGSPGLQEFVSPLEKMVFTVYGDHWRKMRRIMTVPFFTNKVVAQNRAGWEEEARLVVEDVRKDPEAAAGGVVLRRRLQLMMYNDMFRIMFDRRFDSEHDPLFNKLKALNAERSRLSQSFEYNYGDFIPVLRPFPRGYLHRCHDLKTPPMKFFKTNFYRNARKRPNPFLFPSFPFNPSTSQFHPAHLGFCFVNNGGNFKFSSPPRGKD

SEQ ID NO: 73542 - DNA, 874 bp, Zea mays
  misc_feature: Ceres CLONE 1557923
  misc_feature: Encodes the peptide sequence at SEQ ID NO. 73543
  misc_feature (768)..(768): n is a, c, t, g, unknown, or other
  misc_feature (840)..(840): n is a, c, t, g, unknown, or other
ctacccgcggtggcggccgctctagaactagtggatcccccgggctgcaggaattcgtctcacccctagaaaaagggacgagcgtcagtgcagtgcgcgtgtggtcgggtagcgatccgaggagcgcgcagcgatggcggcggcggccgtggcgactgtggccaccccatcccccgcttccaggcggctgttcccctccgccggcccgtctcttctccggctcccaaggccgaccacgcggctcaggcgcgccctgcggttcgccgcggcgggggatgaagcggacgtgctgcctggcccgggggccgagggggaggccgtggtgcccgggaggctggaggagcagcgggacgagcagctgggcggaagccagctcgacatcggagggctcgccttccagggcgacgtgggcgggggtttcaccggcggcggagcgggctccggggcttccggcggtggcggcggcaacaagatgctggaccggggcatcaacacggccatcgtgctcggggccagcacctacgcgctcaccaagctgctcaccgtcgaccaggactactggcatgggtggacgatcttcgagatcctgcgctatatgccggagcacaactggtccgcatacgaggaggccctcaaagccaacccggttctagccaagatgatgatcagcggtgtcgtctactcccttggtgactggattgcacagtgctacgaaggcaagccgatatttgatttcgaccgtgctaggatgttccggtctgggcctgntgggttcacgcttcatgggtcactttcacattactactaccatatatgcgaagcactgttcccatttcaggnattggtgggttgttccctgcaaagggtgcattcc

SEQ ID NO: 73543 - protein, 247 aa, Zea mays
  misc_feature: Ceres CLONE 1557923
  misc_feature (212)..(212): Xaa is any aa, unknown, or other
  misc_feature (236)..(236): Xaa is any aa, unknown, or other
MAAAAVATVATPSPASRRLFPSAGPSLLRLPRPTTRLRRALRFAAAGDEADVLPGPGAEGEAVVPGRLEEQRDEQLGGSQLDIGGLAFQGDVGGGFTGGGAGSGASGGGGGNKMLDRGINTAIVLGASTYALTKLLTVDQDYWHGWTIFEILRYMPEHNWSAYEEALKANPVLAKMMISGVVYSLGDWIAQCYEGKPIFDFDRARMFRSGPXGFTLHGSLSHYYYHICEALFPFQXLVGCSLQRVHS

SEQ ID NO: 73544 - DNA, 888 bp, Zea mays
  misc_feature: Ceres CLONE 1557925
  misc_feature: Encodes the peptide sequence at SEQ ID NO. 73545
  misc_feature (888)..(888): n is a, c, t, g, unknown, or other
ccccgcggtggcggccgctctagaactagtggatcccccgggctgcaggaattcgtctcacccctagaaaaaaaagctcccgcacaccctgcctgatccctcccaataagctccccagctccacgccggacgcagcagcagcagcagtagagatggccgccctcgccgcctcctccacggccgccttcgccgccaagccgcgcctcccacgcgcgcgcctcaccgtggcctgctccgccaccggcggcgacggcaacggcagcagcagcagcgtgtcgctcgcatcctccgtgaagacgttctcggccgcgctggctctgtcgtcggtgcttctctcctcggccgccagctcccctccccccgcggccgccgacatcgcggggctgaccccgcgcaaccagtccaaggcgttcgccgagcgcgagaagaactcgatcaagaagctcaccgcgtcgctcaagaagtacgcgcccgacagcgccccggccctcgccatcaacgccaccatcgagaagaccaagcggcggttcgagaactacggcaaggtcaacctgctctgcggcgacgacagcctgccgcacctcatcgtcagcggggaccaccggcactggggcgagttcgtcaacccgggcctgcttcttccccctaatagccgggtggaatcgggaggggtcggcaggaagctaccttctgcaccattcagccggcgagaaggaagcccgccctggggggagatcatttatctaaaggtgaaggtaagccacccggcccttcttccacagggggattttaatctgggcgccttccccggggcctaccccgggagcataaatcgaaggggagagaccttcgggccgtccaacccgacaaaaagaaacttctggcctn

SEQ ID NO: 73545 - protein, 245 aa, Zea mays
  misc_feature: Ceres CLONE 1557925
  misc_feature (49)..(203): Pfam Name: PSI_PsaF Pfam Description: Photosystem I reaction centre subunit III
MAALAASSTAAFAAKPRLPRARLTVACSATGGDGNGSSSSVSLASSVKTFSAALALSSVLLSSAASSPPPAAADIAGLTPRNQSKAFAEREKNSIKKLTASLKKYAPDSAPALAINATIEKTKRRFENYGKVNLLCGDDSLPHLIVSGDHRHWGEFVNPGLLLPPNSRVESGGVGRKLPSAPFSRREGSPPWGEIIYLKVKVSHPALLPQGDFNLGAFPGAYPGSINRRGETFGPSNPTKRNFWP

SEQ ID NO: 73546 - DNA, 836 bp, Zea mays
  misc_feature: Ceres CLONE 1557926
  misc_feature: Translation starting site: 159
aaagctggagctccccgcggtggcggccgctctagaactagtggatcccccgggctgcaggaattcgtctcacccctagaaaaagtcgccgccaccactctcccagcctctcttactctccgccgtcgccctgctcgcccgaagcagctgccggcaaaatggccccgaagagaggcggtagggcgccggtccccgccaagaagaaggcggtggtgacgaacccgctcttcgagaagaggccgaagcagtttgggatcggcggcgcccttccgcccaagaaggacctccaccgcttcgtcaagtggcccaaggtcgtgcgcatccagcgccagcgccgcatcctcaagcagcgcctcaaggtgcccccggcgctcaaccagttcacacgtaccctcgacaagaaccttgcaacaaacttgttcaagatgcttcttaagtaccgccccgaggacaaagctgccaagaaggagaggctcttgaagagggcccaggctgaaaacgaggggaaaactgttgagtcaaagaaaccaattgttgtgaagtacggccttaaccatgtgacttacctcatcgagcagagcaaggcccagctggttgtcatagctcatgatgttgatccgatcgagctggtcgtgtggctcccggccctttgcaggaaaatggaggttccatactgcattgtcaagggaaaagcacgcccttggatcgatcgttcacaagaagactgcatctgttctttgcttgaccaccgtcaagaacgaagacaagcttgagttcagcaaaatcttggaggctatcaaggctaacttcaacgacaagtttgatgaggtcaggaa

SEQ ID NO: 73547 - DNA, 812 bp, Zea mays
  misc_feature: Ceres CLONE 1557927
  misc_feature: Encodes the peptide sequence at SEQ ID NO. 73548
  misc_feature (758)..(758): n is a, c, t, g, unknown, or other
gatagctggagctcaccgcggtggcggccgctctagaactagtggatcccccgggctgcaggaattcgtctcacccctagaaaaaaatagcaccaacaaggattcatgtgacatgtgcactagtatatgggccaacccctaccggaagaattcacaaaggagtctgttctacttggatgaagcattcgactcccttgaaagatagcaaagactgcagctgggctccaatttttgttaggcaatcaaacttcaaactgcctgctgatcctactgtgcccattataatgattggccctgggactggtctggcacctttcaggggcttcttacaggaacgactagctttaaaacaggcagaggtggaactgggccatgctgtcctcttctttgggtgcagaaatcggaagatggacttcatatatgaggatgagctcaataattttgttgatgccggtgccctctctgagttgatcgtagccttttctcgtgagggtcctacaaaagagtatgttcagcacaaaatggcgcaaaaggctgccgagctttggagcatcatttctcagggcggctatatttatgtttgcggtgacgcaaaaggcatggctagagatgtccatcgcacgctacataccatcgtccaggagcaggggtctatggacaacaactccaaggcagaaagctacgtgaagagcctgcagatggaagggagatacttgagagatgtttggtgacgtatgccaaagaaacgtggaccctgntccgtcgtagttgccggcgaatacaaacctaaatcaacgtcgtggaggaaaata

SEQ ID NO: 73548 - protein, 184 aa, Zea mays
  misc_feature: Ceres CLONE 1557927
  misc_feature (36)..(148): Pfam Name: NAD_binding_1 Pfam Description: Oxidoreductase NAD-binding domain
  misc_feature: SWISSPROT Homolog: EC 1.6.2.4 NADPH--hemoprotein reductase
MKHSTPLKDSKDCSWAPIFVRQSNFKLPADPTVPIIMIGPGTGLAPFRGFLQERLALKQAEVELGHAVLFFGCRNRKMDFIYEDELNNFVDAGALSELIVAFSREGPTKEYVQHKMAQKAAELWSIISQGGYIYVCGDAKGMARDVHRTLHTIVQEQGSMDNNSKAESYVKSLQMEGRYLRDVW

SEQ ID NO: 73549 - DNA, 725 bp, Zea mays
  misc_feature: Ceres CLONE 1557929
  misc_feature: Translation starting site: 164
  misc_feature: SWISSPROT Homolog: EC 1.6.5.2 NAD(P)H dehydrogenase (quinone)
  misc_feature (328)..(328): n is a, c, t, g, unknown, or other
  misc_feature (339)..(339): n is a, c, t, g, unknown, or other
  misc_feature (345)..(345): n is a, c, t, g, unknown, or other
  misc_feature (621)..(621): n is a, c, t, g, unknown, or other
ctggagctccccgcggtggcggccgctctagaactagtggatcccccgggctgcaggaattcgtctcacccctagaaaaaacctgcgcattttgtaaaggtacgaggagctaggtgaggcaccaccaccaaccgggctccgactccgagttcatcacgcacgcatggaaggctcggcggcacaggcgccggggaagaccgtcctgagggtggtggcgatctccggctcgctgcgcagggcgtcggccaacaccggcctcatccgcgccgccgcggagatctgcagggagtcgatcccggggctggaggtggagcacgtggacatctcnggagctgccgnctgctngaacaccgaccctggagggcccggggcccccggcggcgttcccggcgggccgttccaaggcgtttccgccggcaaaggtggcgggcccgcccgaattgcttcccttgtttccggtcggccccgaagtaaaaattaacccccttttctgggggccccccttaaaaaaaacccccctcggagaacgggggggggtttcccccccccccccccaaaaattgttttgggggggggaaaaaaaggggggcccccccccccccctcttctttttaaaaaaantttttttgtggggggggggggtttttctgggggggggggggggaaaacacccccccccccccccccccacacaaaaaaaaacaacccaacagggtggcgccggc

SEQ ID NO: 73550 - DNA, 834 bp, Zea mays
  misc_feature: Ceres CLONE 1557931
  misc_feature: Encodes the peptide sequence at SEQ ID NO. 73551
  misc_feature (834)..(834): n is a, c, t, g, unknown, or other
ctccccgcggtggcggccgctctagaactagtggatcccccgggctgcaggaattcgtctcacccctagaaaaaatcgctgacgcccagcctcctctgtcatctccctcctcggacctcgccacctcacgcggaaggaggggaagaggaagcgcggagactggaaatcggaccccaaatccgcttcggtctctcgatcggcgaggcatgatttatacaaccggctaggatggcctcaaaagctataaaaagaaggcctatcagcgctgagactgataaaacaggggaaaatcaaatggatacagcactgtcagatcctgtaacagaacctcttctaggaaacactcctcaggaagagaaatccaagacatatgagcctattacaaggtcaggtttctgggatgcgacgacacaggagtgtcttcgttggacacatcttttagcagcttttgttgctcaatctgcaagaaaaatagtaaatgttctttctgaatttggatatttgctagcaagactctttggttgctcttctgcttccaaaagttcacaaaatggacagacacttccagttaatctcagtccattacaggaagaaaggttaagattgttgagacaaaggatagatgtgccatatgactgctccctcgtccagcatcaggatgccctggagagactttggaggttggcttaccctaacagacaacttcctcctctgaagtcagatctctggaaggagatgggctggcagaactctgatccatcacagattttagagcagctgggttcatgtcccttggagaatctaatatattttggcagaaaatacccagaatcn

SEQ ID NO: 73551 - protein, 202 aa, Zea mays
  misc_feature: Ceres CLONE 1557931
MASKAIKRRPISAETDKTGENQMDTALSDPVTEPLLGNTPQEEKSKTYEPITRSGFWDATTQECLRWTHLLAAFVAQSARKIVNVLSEFGYLLARLFGCSSASKSSQNGQTLPVNLSPLQEERLRLLRQRIDVPYDCSLVQHQDALERLWRLAYPNRQLPPLKSDLWKEMGWQNSDPSQILEQLGSCPLENLIYFGRKYPES

SEQ ID NO: 73552 - DNA, 899 bp, Zea mays
  misc_feature: Ceres CLONE 1557932
  misc_feature: Encodes the peptide sequence at SEQ ID NO. 73553
  misc_feature (478)..(478): n is a, c, t, g, unknown, or other
ctccccgcggtggcggccgctctagaactagtggatcccccgggctgcaggaattcgtctcacccctagaaaaagagcagagccaccgatcgctcctgagcactttccacattccagttccactccgcctccgctgccggtcgccgtctccgagactccgacagtccgaccgcaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggactgattaagggtgatcgagtcctgtactcatcagttgtataccctcacaattatggtttcgntcaagggactctttgtgaagacaatgacccaatggatgtgttagtcctgatgcaggaacccgttgttcctggttcgttcctgccagcaaaagcaatcggccttatgccctgatttgcccgggggaaaaggatgacaagaaaatgcccgcccgggccgaaagaacccggaaatcgcccctccaaccaatccggggggggtgtccccctcatgcccggaaaaaaataaagggtttcttttaaagttttttaagaaaatgggaataaagggggtgggtgtgaaaaaattttttgccgggaaccccgttttggagggggtttccgacccccccgggatttgtgggccccaaatttttttccaaactttgggggcctatttttggaaccctcttttttttgggggctttttaaaaaagggggatta

SEQ ID NO: 73553 - protein, 129 aa, Zea mays
  misc_feature: Ceres CLONE 1557932
  misc_feature (52)..(130): Pfam Name: Pyrophosphatase Pfam Description: Inorganic pyrophosphatase
  misc_feature: SWISSPROT Homolog: EC 3.6.1.1 Inorganic diphosphatase
  misc_feature (93)..(93): Xaa is any aa, unknown, or other
MSEEDKTAASAEQPKRAPKLNERILSSLSRRSVAAHPWHDLEIGPDAPAVFNVVVEITKGSKVKYELDKKTGLIKGDRVLYSSVVYPHNYGFXQGTLCEDNDPMDVLVLMQEPVVPGSFLPAKAIGLMP

SEQ ID NO: 73554 - DNA, 1602 bp, Zea mays
  misc_feature: Ceres CLONE 1557939
  misc_feature: Encodes the peptide sequence at SEQ ID NO. 73555
aactttctcctcctcgtgaagcgagctctccacgcccctgcgattccatttccatcctgtccgctcccaacttcaaaatcaaaacggccgcggcgcagatccacacgcacgggcaggcaggcatacggacaggaccgccgccgcagcagctttcaaatcccggggcggattaccctgcagacggagcccacagcccagcaccgcagcagtccaccgggatctcgccttcgtcgccccgtgtcgcgccggtggcgctagctagagcctactgtagaccgtagagccatggggaacagcatctaccggttcctatgcggcctgtgcgcgccctcgtcgtcggagcacgggctccacggcgcgcaccccgccgtcgccgcgctcggccgcgacgtcctcagcttccagagcacctcgcaggttccggacgagctgagccggcacgtcgtctcctccaagaaagcgcaggcgaattggtacaagaagctgctggtggcatggaagagagcccggccgcctccgaagacgcccgaggaagccgcggccttcgttgtgcagacgctcaagaaccatcagaaggcagatgtggagggcctgttgtctttctacggcctgccgcatccgaacgcggcggcagcagcagcaggcgcgcccgccgctcgcccgccgcccaagaaggcccagcagggcgccaagttcgagctgcacacgctccccattgaccccaagtctgtggccgacggcgacacggtgaacgtgtacgtcgacgcggcggacccgcgggaggccggcagcgtgccccgcgaggtgcagaaggctgcggcggagcgggccagggcgcgggctgccaaggactaccagaaggccgacgcgctgcagaaggtcatagtcgacgcagggtacaggccggttcctaacgcgagaggcgaggaggtgctggcgaagaagtacaggatcaggctgagggggatcgatgcgcccgagagcgcgatgccgtatggcaaggaagccaaggaggcgctgctcaaacttgtccaggggaagagcttgaaggtctacgtgtacgacgaggaccggtacggtagatgcgtcggagacatctactgcgacggggtatttgtgcaggagcaaatgctgaagaagggtttcgcgtggcactacaccgcctacgatcaacgcccggagctggccaagtgggagaagcaagcgcagaccggccggaagggcctgtgggcggcgtcgaagccacagaaaccatgggagtggaggaaggacaagcgcaacgggacagcatgaacaaacccccttcagtgtgtgtgtccatgtccatgaacacctgatacattgatgtacctgcagacttttaggacggtatatgtgtcggggattcagtagcggtgcagtatgattgtgtgtacactgtaatagacgattccttacagttacagggatgtgaaagcaggacaagagagattggcgtgatccctaatttcgtatggggattcgtcgtgcaactgtatcaaatgcattgtaccatcatttacactcatgtgacctgttgtgaagaagagtagctgagattgtgaccaaaaaaaaaaaaaaaaa

SEQ ID NO: 73555 - protein, 335 aa, Zea mays
  misc_feature: Ceres CLONE 1557939
  misc_feature (140)..(317): Pfam Name: SNase Pfam Description: Staphylococcal nuclease homologue
  misc_feature: SWISSPROT Homolog: EC 3.1.31.1 Micrococcal nuclease
MGNSIYRFLCGLCAPSSSEHGLHGAHPAVAALGRDVLSFQSTSQVPDELSRHVVSSKKAQANWYKKLLVAWKRARPPPKTPEEAAAFVVQTLKNHQKADVEGLLSFYGLPHPNAAAAAAGAPAARPPPKKAQQGAKFELHTLPIDPKSVADGDTVNVYVDAADPREAGSVPREVQKAAAERARARAAKDYQKADALQKVIVDAGYRPVPNARGEEVLAKKYRIRLRGIDAPESAMPYGKEAKEALLKLVQGKSLKVYVYDEDRYGRCVGDIYCDGVFVQEQMLKKGFAWHYTAYDQRPELAKWEKQAQTGRKGLWAASKPQKPWEWRKDKRNGTA

SEQ ID NO: 73556 - DNA, 803 bp, Zea mays
  misc_feature: Ceres CLONE 1557941
  misc_feature: Encodes the peptide sequence at SEQ ID NO. 73557
ctccccgcggtggcggccgctctagaactagtggatcccccgggctgcaggaattcgtctcacccctagaaaaagtccctcgtcaaatccacgcgaccgcgagagctctcagaaggccctagcacgcaaaaaccccacgagagagacgaatcttccgaatctctcggtggcgatggcgctctccgaccgctcccgcgagtcgctcctcccgagcttcctctacggctcctcggcgcgctctttcgctgccacaggagccgccgcgcgcctccctgtctcctccccggcgcctgccgcggctggagcaggaggcggcgtgccgttctcgatccaggcgcccaaggagaagatcgagatgtactcgccggccttctatgccgcctgcactgccggaggaatcgccagctgcgggctcacccacatggccgtcacgcctctcggcctcgtcaagtgcaatatgcagattgactcagcgaaatacaagagtatctcatctggatttggtatcctggtaaaggagcaggggcccaggggtttcttcaaggggatgggtgcctactttgcttgggctacagtgctcaaggggcctggcagtttggcttccaatgaggtccttaaagaatattaacttcggacatttgaggggcctgaaaattgccccaaaattcacaaacccttaaccctcccttccccgggaatttgcattcggctaagggaaaatgggcggaagggggctctcttggcccctttttaaaactttttaaaaggaaccctgtttcaaaaaaacaacccggggattttct

SEQ ID NO: 73557 - protein, 151 aa, Zea mays
  misc_feature: Ceres CLONE 1557941
  misc_feature (67)..(152): Pfam Name: Mito_carr Pfam Description: Mitochondrial carrier protein
MALSDRSRESLLPSFLYGSSARSFAATGAAARLPVSSPAPAAAGAGGGVPFSIQAPKEKIEMYSPAFYAACTAGGIASCGLTHMAVTPLGLVKCNMQIDSAKYKSISSGFGILVKEQGPRGFFKGMGAYFAWATVLKGPGSLASNEVLKEY

SEQ ID NO: 73558 - DNA, 806 bp, Zea mays
  misc_feature: Ceres CLONE 1557943
  misc_feature: Encodes the peptide sequence at SEQ ID NO. 73559
  misc_feature (41)..(41): n is a, c, t, g, unknown, or other
  misc_feature (50)..(50): n is a, c, t, g, unknown, or other
  misc_feature (51)..(51): n is a, c, t, g, unknown, or other
  misc_feature (373)..(373): n is a, c, t, g, unknown, or other
  misc_feature (401)..(401): n is a, c, t, g, unknown, or other
tccccgcggtggcggccgctctagaactagtggatcccccngggctgcannggaattcgtctcacctcctagaaaaaaagctttgctagcgaagtccagtgcaactccaccctctccacctagctaccactcccttagagcgccactgccgccaagcgcatggcgggaggaggggcggcctaccagagctcgtcggcgtcgccggactggctgaacaagggagacaatgcgtggcagatgacgtccgcgacgctggtgggcctgcagagcatgcccgggctggtgatcctgtacggcagcatcgtgaagaagaagtgggcccatcactcggcgttcatggcgctgtacgccttcgccgccgtctggctctgcntgggtggtgtgggccctacacaatgtcntccgggcgaccggctgcttgcctttctgggggcaagggcaaaggccgggcctcgggcagcccttccttggtggggcaatcccagctcacggcccccggccctggcgtaaccccaacgggtccctccaaggcgaaaaagttcccccccttttacccggccggacacagggggaacttcccaggggcgggttccccaaaatacccgttttatttcttctcccggttcttttttggggccccagggaaaataaagggccgggaggggcccttttcccccccttgggaaacccttttttttaaaaaagggggttcccccttttttttttttttgggggggggggtgttttctttttttttagggggggggggtataaaaaaatatcttgcgggggggggaaaatatttc

SEQ ID NO: 73559 - protein, 116 aa, Zea mays
  misc_feature: Ceres CLONE 1557943
  misc_feature (72)..(72): Xaa is any aa, unknown, or other
  misc_feature (81)..(81): Xaa is any aa, unknown, or other
MAGGGAAYQSSSASPDWLNKGDNAWQMTSATLVGLQSMPGLVILYGSIVKKKWAHHSAFMALYAFAAVWLCXGGVGPTQCXPGDRLLAFLGARAKAGPRAALPWWGNPSSRPPALA

SEQ ID NO: 73560 - DNA, 687 bp, Zea mays
  misc_feature: Ceres CLONE 1557944
  misc_feature: Translation starting site: 187
  misc_feature: Pfam Name: PPTA Pfam Description: Protein prenyltransferase alpha subunit repeat
agctccccgcggtggcggccgctctagaactagtggatcccccgggctgcaggaattcgtctcacccctagaaaaaagtcaggccccagcagttggccagaactggccgacgtggtgccggtgccgcaggacgatgggcctagccctgtggtgtccatcgcctatcgagatgactttcgtgaggtcatggattacttccgcgccctctacctcaccggtgagcgaagccctcgcgctctccgcctcaccgccgaggccatcgagctcaaccccggcaactacactgtctggcatttccggcgccttattctggagtcactagattttgatttactagaggagatgaaatttgtcgaaaaattgctgaatgcaatccaaaaaattacaaatctggcacccatagagatggcttgctgagaaattaggacctggtattttgcaacaagagcatgaattcacaatgaagatacttgctattgatgcaaaaaaatatcatgctttgtctcataggcagtggggttctttcagccttggggggaatgggaagactgaaattagaatacttgggaaccccctaactttagggaaaaacgtctttcaaaaaattcccgctttggaaacccaaaaaataacttttggttttttaaacccaggatccccccctttttttctttgggggggggccct

SEQ ID NO: 73561 - DNA, 867 bp, Zea mays
  misc_feature: Ceres CLONE 1557946
  misc_feature: Encodes the peptide sequence at SEQ ID NO. 73562
ctggagctccccgcggtggcggccgctctagaactagtggatcccccgggctgcaggaattcgtctcacccctagaaaaaaccagcaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggagaccttcgcgcgcaaccgggagctagaggtgatccactcccggtgggcgatgctgggggcgctgggctgcgtgttcccggagatcctggctagaaacgcgtcaagttcggcaaggcggtgtggttcaaggcccggcccgcagatcttctcggaggccgggctggactacctgggggacccccaactggtggcaccgcagaagcatcctggccattcggggcgtgccaggtgggggcccaggggcctttcccgaagggtaccgggttcgggggggggccccttcggggaaagggtcccaaaggggtaccccgggggggcccctttaaacccttggggcctccccaaaaaaaccgaaaccccccccccagtttctgggggaaagggccccaaaaaggcgccccctcgccaggtttcccagggggggggtttttttgggagaggccctataccccga

SEQ ID NO: 73562 - protein, 235 aa, Zea mays
  misc_feature: Ceres CLONE 1557946
  misc_feature (59)..(231): Pfam Name: Chloroa_b-bind Pfam Description: Chlorophyll A-B binding protein
MAASALHQTTSFLGQALVARAAGVDAGGRITMRRTVKSVPQSIWYGPDRPKYLGPFSEQTPSYLTGEFPGDYGWDTAGLSADPETFARNRELEVIHSRWAMLGALGCVFPEILARNASSSARRCGSRPGPQIFSEAGLDYLGDPQLVAPQKHPGHSGRARWGPRGLSRRVPGSGGGPFGERVPKGYPGGAPLNPWGLPKKTETPPPVSGGKGPKKAPPRQVSQGGGFFGRGPIPR

SEQ ID NO: 73563 - DNA, 776 bp, Zea mays
  misc_feature: Ceres CLONE 1557952
  misc_feature (267)..(267): n is a, c, t, g, unknown, or other
  misc_feature (313)..(313): n is a, c, t, g, unknown, or other
ctccccgcggtggcggccgctctagaactagtggatcccccgggctgcaggaattcgtctcacccctagaaaaaaggacgtgacaggtgcagctcgcggagccggtagcaccccagacgcggccaaccgctagctaggccggtgccgccatggctgcgtcctcctgctgccaggcccgctggctgctccccctgctgctgcttgctgctgccgcgggtgctcttggtgcagagggcgcctcctccattgtgcagctggacgtggagntcctgctcccgtccgcagcggctcccttgccccacccccccttcanggccaaaaacaaaaaaagggcccgggccccccaaaagaatcccctgttgggacaaaaaaagggccccgggtttcccccttggggaaaaaaaaggaaaagggggaagggccccccccccccccggaaaaaaatttctcccgccgaaaaaaaaaccccccccccaaaaaaaaaacacccccccccccccgggtggggggaaaaaaaaacaccggggggggggggagaaaaaaaaaaaaaaaaaaaaggggggggccccccccctgggaattttttttgggggggggaggaaagacaacccccccttttccaaaaaaataaatttttccccccccccttgtgttttcccccccccccccttttttattaaaaaaaaaaaaaaaaccccccgggcccgccgttaaataaaaaagaggggcgcccccccccccccgcgggaaaaaaaaaaaaataaaatttatttttt

SEQ ID NO: 73564 - DNA, 808 bp, Zea mays
  misc_feature: Ceres CLONE 1557954
  misc_feature: Encodes the peptide sequence at SEQ ID NO. 73565
ctccccgcggtggcggccgctctagaactagtggatcccccgggctgcaggaattcgtctcacccctagaaaaatccaaaatccgagtcgctcatggcgatactatccaaaagtttgaagggccttggaagtcgaaggctctgtcatcgccgtcgttaacatcagacggcagataccttatatctgcgggcaaagattccaacgtctacatttggaacttcgcgaactctagagatgcaagatcggttcattcgtgcgagctgttcttctccaaagctgtaactaccgcagtaccatggccgggagtgtaccaagatgggcacacgaagccttcctacctgactgagaaatcctgcagcatacccattttgcgccacctcggggagtgccagtccgctgagccgtggtcgttcgtggacggcagcaagggattggcgacatggcctgaagagaagttgccttctacagcaaagcctggaagcagcccgcagctgggcgactgtctctccatgatatccgccgcgtggagcacggtcatcgtgaccgccagccgcgatggcgtgatccgatcttttcacaactacggcttgcccgttagattgtgagctttgagaccggtttgagctagtcagtggagcgccgccatggttggtgactgataatccgctaaggttttgtaagttttttttttttctttttcatttctggtcagagttactagaaattatttatgtagcatttttagatcattaatttcttgtggagagatgatctgtagtcagtccaagtccaaacacttgtgctgctt

SEQ ID NO: 73565 - protein, 200 aa, Zea mays
  misc_feature: Ceres CLONE 1557954
PRGGGRSRTSGSPGLQEFVSPLEKSKIRVAHGDTIQKFEGPWKSKALSSPSLTSDGRYLISAGKDSNVYIWNFANSRDARSVHSCELFFSKAVTTAVPWPGVYQDGHTKPSYLTEKSCSIPILRHLGECQSAEPWSFVDGSKGLATWPEEKLPSTAKPGSSPQLGDCLSMISAAWSTVIVTASRDGVIRSFHNYGLPVRL

SEQ ID NO: 73566 - DNA, 799 bp, Zea mays
  misc_feature: Ceres CLONE 1557958
  misc_feature: Encodes the peptide sequence at SEQ ID NO. 73567
  misc_feature (42)..(42): n is a, c, t, g, unknown, or other
  misc_feature (69)..(69): n is a, c, t, g, unknown, or other
ctccccgcggtggcggccgctctagaactagtggatcccccngggctgcaggaattcgtctcacccctngaaaaaaaaaaaaaaaaaaaaaaaaaaaaaaaaaaaaaaaaaaaaaaaaaaaaaaaagtcgtcaccgagaagcaaaagcagcagctgctgcctgctggtcgttcgttcgcctcgttctctccgcctccccccaccccccgcctcgcttcctcctccgcgcttccttcgccgttggcgccgtcgcctccgccaagcctagatccgtcgcccccgcggtggcgacaaggaggagcgtgcgcgtggcgcccgcggccaagcgaggaccaggctcgggaggaggcaggctcgtggctcgcagcgccgttgcagccaaggcggatgaggcggccgcggcggcgggatccaagtcaggcggccatgagttgctgatgtttgaggcccttcgtgaagccttgatagaagagatgaatttggatccaacagtgtgcgtcatgggtgaagatgttggtcattatggaggttcatacaaggtgaccaaagggttggctgagatgttcggagatctccgggtccttgatacccctatcgccgagaactccttcactggcatgggagttggagcaccaatgaaggggctgaggcctgttgtggaaggcatgaacatgggtttccttctccttgcctacaaccagatctcgaacaactgcggcatgcttcactacacctcaggcggccagttcaagatcccggtcgtgatccgaggccccgggcggtgtcggtccgcagctcg

SEQ ID NO: 73567 - protein, 265 aa, Zea mays
  misc_feature: Ceres CLONE 1557958
  misc_feature (142)..(265): Pfam Name: Transket_pyr Pfam Description: Transketolase, pyrimidine binding domain
  misc_feature: SWISSPROT Homolog: EC 1.2.4.1 Pyruvate dehydrogenase (acetyl-transferring)
  misc_feature (14)..(14): Xaa is any aa, unknown, or other
  misc_feature (23)..(23): Xaa is any aa, unknown, or other
PRGGGRSRTSGSPXAAGIRLTPXKKKKKKKKKKKKKKKKKKSRHREAKAAAAACWSFVRLVLSASPHPPPRFLLRASFAVGAVASAKPRSVAPAVATRRSVRVAPAAKRGPGSGGGRLVARSAVAAKADEAAAAAGSKSGGHELLMFEALREALIEEMNLDPTVCVMGEDVGHYGGSYKVTKGLAEMFGDLRVLDTPIAENSFTGMGVGAPMKGLRPVVEGMNMGFLLLAYNQISNNCGMLHYTSGGQFKIPVVIRGPGRCRSAA

SEQ ID NO: 73568 - DNA, 924 bp, Zea mays
  misc_feature: Ceres CLONE 1557960
  misc_feature: Encodes the peptide sequence at SEQ ID NO. 73569
  misc_feature (839)..(839): n is a, c, t, g, unknown, or other
  misc_feature (840)..(840): n is a, c, t, g, unknown, or other
ctggagctcaccgcggtggcggccgctctagaactagtggatcccccgggctgcaggaattcgtctcacccctagaaaaatagatgtgagaaagggagggttgttggagacggcctaaacccttctccatccgacggcgaacaccagcttccctccgcccgcccacatccctgctgtcagctgcgcctccccgcctgatcttgtcgcgcccgagagaccgcgggccagggaacgtcggccgccggagcctggcctgcattccgggggcagcgagaggatgttgcgttgcgcatacacgcagcggcggtgggcgcaccgccgggggggcttcgtaaccggcagcaccggttggtccaagccgccaccgccgagcctcggccgcgccgcgggggttggtacgaagaagtcggagtggtggacggtggacggggagatgcacgagatcggggaaagcgtgccgcatcgcgagcgcttcgccatcccgcgggacaacctccctaaccgccgccgcaagcagatgcgggagcaattcatgcgccgcacccgcctcgttctcaaagactcggaacacgaaacatggtgcaaaaagtacatggaattataccaagaacttagaaaaactgggaaaggttgtactggggacgaaggttattcaaaaaagattgctgaatctcatgctaattatgactctgccgaagaagatgatattgacttctcgccatacagcaggagaaggcagtccaatgtagaccaaacaaggaccttgggcttcggggtgaaacaaccgagtgaaacggtggggaagggttactcaaattcgtgacaattttgatatgacnngagaaaggagaatgagagaacgagcatttgctcccatgaacaccgagacaaattttggctcggcctgaccccagatttagaacc

SEQ ID NO: 73569 - protein, 181 aa, Zea mays
  misc_feature: Ceres CLONE 1557960
MLRCAYTQRRWAHRRGGFVTGSTGWSKPPPPSLGRAAGVGTKKSEWWTVDGEMHEIGESVPHRERFAIPRDNLPNRRRKQMREQFMRRTRLVLKDSEHETWCKKYMELYQELRKTGKGCTGDEGYSKKIAESHANYDSAEEDDIDFSPYSRRRQSNVDQTRTLGFGVKQPSETVGKGYSNS

SEQ ID NO: 73570 - DNA, 960 bp, Zea mays
  misc_feature: Ceres CLONE 1557961
  misc_feature: Encodes the peptide sequence at SEQ ID NO. 73571
  misc_feature (739)..(739): n is a, c, t, g, unknown, or other
  misc_feature (802)..(802): n is a, c, t, g, unknown, or other
  misc_feature (820)..(820): n is a, c, t, g, unknown, or other
tggagctcaccgcggtggcggccgctctagaactagtggatcccccgggctgcaggaattcgtctcacccctagaaaaacccaattcgaacgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaacgctgcccaggacattgctttggctgagcttgctccaactcaccctattaagcttggactggcactcaacttctcagtgttctactatgagattccaaactcncccgatcgcgactgcagtcttgcaaagcaggcttttgacgagccatctcggaactggacaccntggagcgaggagtctacnaggacagcactttgatcatggcagctccctcggggatactggaaccctatggactctgaattttcggaggaccctggcggaagaaataccggtaggggcccaaacccgatccaaggtaggggcataaaccccggcttcct

SEQ ID NO: 73571 - protein, 224 aa, Zea mays
  misc_feature: Ceres CLONE 1557961
  misc_feature (8)..(223): Pfam Name: 14-3-3 Pfam Description: 14-3-3 protein
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYNAAQDIALAELAPTHPIKLGLALNFSVFYYEIPNSPDRDCSLAKQAFDEPSRNWTPWSEESTRTAL

SEQ ID NO: 73572 - DNA, 955 bp, Zea mays
  misc_feature: Ceres CLONE 1557963
  misc_feature: Encodes the peptide sequence at SEQ ID NO. 73573
  misc_feature (700)..(700): n is a, c, t, g, unknown, or other
ctggagctccccgcggtggcggccgctctagaactagtggatcccccgggctgcaggaattcgtctcacccctagaaaaagaggtgttcaacttcactggtgcaggaggagttgccttatcaatgtacaacactgacgagtccatccatgcctttgctgacgcttctatggccactgcttatgaaaagaaatggccattgtatcttagcaccaaaaacactattttgaagaaatatgatggcaggttcaaggacattttccaggaggtgtatgaagctggttggaaaaccaaatttgaagctgccggcatatggtatgagcaccgccttatcgatgacatggtagcatacgcacttaagagtgaaggagggtatgtctgggcttgcaagaattatgatggagatgtgcagagcgatttcttagctcaaggttttggctcattgggtttgatgacttcggtactggtgtgccctgatggaaagacgatcgaagctgaagctgcccatggtactgttacccgtcattaccgtgttcaccagaaaggaggtgaaactagtacgaacagtattgcctcaatctttgcgtggacaagaggacttgcacacagggcaaagcttgatgacaatgctagactacttgacttcacccagaagcttgaggctgcctgcgttggagccgtcgagtctgggaagatgacaangaccttgcccttctcgttcacggatcttcaaatatcacgaggagccattacctgaacacggaagagttcattgacgctgttgctgatgagctcagatcaaggctggcagccaactcgaacctttgaaatcttgcccgaagtttgggtgctttccctggcgacgctttcgaaccgtttttatatgtcgccattttctttccctgtgccccaccctgatgtatgaagaaggctgaccttagcaacatctggaggcct

SEQ ID NO: 73573 - protein, 250 aa, Zea mays
  misc_feature: Ceres CLONE 1557963
  misc_feature (1)..(249): Pfam Name: Iso_dh Pfam Description: Isocitrate/isopropylmalate dehydrogenase
  misc_feature: SWISSPROT Homolog: EC 1.1.1.42 Isocitrate dehydrogenase (NADP(+))
  misc_feature (233)..(233): Xaa is any aa, unknown, or other
GAPRGGGRSRTSGSPGLQEFVSPLEKEVFNFTGAGGVALSMYNTDESIHAFADASMATAYEKKWPLYLSTKNTILKKYDGRFKDIFQEVYEAGWKTKFEAAGIWYEHRLIDDMVAYALKSEGGYVWACKNYDGDVQSDFLAQGFGSLGLMTSVLVCPDGKTIEAEAAHGTVTRHYRVHQKGGETSTNSIASIFAWTRGLAHRAKLDDNARLLDFTQKLEAACVGAVESGKMTXTLPFSFTDLQISRGAIT

SEQ ID NO: 73574 - DNA, 936 bp, Zea mays
  misc_feature: Ceres CLONE 1557964
  misc_feature: Encodes the peptide sequence at SEQ ID NO. 73575
  misc_feature (848)..(848): n is a, c, t, g, unknown, or other
agctccccgcggtggcggccgctctagaactagtggatcccccgggctgcaggaattcgtctcacccctagaaaaaacgagcacgagactgctcggccgacgaaataataaagcgcgcgcgcgcacgcggagaggctcggagagctgagtgagatggcacaagccatggcgtccatgaccggcctctcgcagggcgttctgcccagcaggcgcgccgccaacagggccaggacggccgccgtcgtcagggcgtccgccgaggcgcaggcgcaggcgcaggcgggccgccgcgccgtgctcgggctggtggccactggcatcgtcggcggcgccttgtcgcaggcggtgcacgccgagaccgtcaagaccatcaagatcggagccccgccgccgccctccggtggactccccgggactctgaactctgaccaggcgagggacttcgacctccccttgaaggagcggttctacctgcagccgctgccgccggcggaggcggtggcgagggtgaagacgtcggcgcaggacatcatcaacctcaagccactcatcgacaagaaggcgtggccgtacgtccagaacgacctccgcctccgggcctcctacctgcgctacgacctcaagaccgtcatcgcttccaagcccaaggaggagaagcagagcctcaaggagctcaccggcaagctcttcagcaccatcgacgatcttgaccatgccgcaaagatcaagagcaccccgggatgccgagaaatacttcgcagcaaccaaagatgcgctcggcgacgtcctcgccaagctagcctagatggaagctaatagatgggttaacgatgggccacgtattttcngacttgtgtttggtcatatggaggcggcaaatgtaccgtttcccgttcatatttatatccaagttcttggacaggtacctttgcgggg

SEQ ID NO: 73575 - protein, 216 aa, Zea mays
  misc_feature: Ceres CLONE 1557964
  misc_feature (9)..(204): Pfam Name: PsbQ Pfam Description: Oxygen evolving enhancer protein 3 (PsbQ)
MASMTGLSQGVLPSRRAANRARTAAVVRASAEAQAQAQAGRRAVLGLVATGIVGGALSQAVHAETVKTIKIGAPPPPSGGLPGTLNSDQARDFDLPLKERFYLQPLPPAEAVARVKTSAQDIINLKPLIDKKAWPYVQNDLRLRASYLRYDLKTVIASKPKEEKQSLKELTGKLFSTIDDLDHAAKIKSTPGCREILRSNQRCARRRPRQASLDGS

SEQ ID NO: 73576 - DNA, 916 bp, Zea mays
  misc_feature: Ceres CLONE 1557966
  misc_feature: Encodes the peptide sequence at SEQ ID NO. 73577
  misc_feature (780)..(780): n is a, c, t, g, unknown, or other
  misc_feature (833)..(833): n is a, c, t, g, unknown, or other
ggagctccccgcggtggcggccgctctagaactagtggatcccccgggctgcaggaattcgtctcacccctagaaaaaaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaccattggcaaggagattgttgacctgtgccttgatcgcatcaggaagcttgccgacaactgcactggtctccagggcttcctcgtcttcaacgctgttggtggaggaacgggctctggccttggttccctcctcctagagcgcctgtctgttgactacggcaagaaaccaagcttgggttcactgtgtacccttccccccaagtttctacttcggtagttgagccatacaacagtgtactggtcaaccactcccctctcgagnacactgatgtggctatactgctgggacatgaaggcatctacgacatcctgcgncgatccctttgacatgagcggccaacctacaccaacctcaacaggcttgtgtccaaggtcatctcattcccttactgcctccc

SEQ ID NO: 73577 - protein, 180 aa, Zea mays
  misc_feature: Ceres CLONE 1557966
  misc_feature (49)..(177): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKPSLGSLCTLPPKFLLR

SEQ ID NO: 73578 - DNA, 956 bp, Zea mays
  misc_feature: Ceres CLONE 1557967
  misc_feature: Encodes the peptide sequence at SEQ ID NO. 73579
  misc_feature (826)..(826): n is a, c, t, g, unknown, or other
  misc_feature (907)..(907): n is a, c, t, g, unknown, or other
ccccgcggtggcggccgctctagaactagtggatcccccgggctgcaggaattcgtctcacccctagaaaaaagcccgacaggtgaagccgccgccgctgcagtgtccatagccaccgcaggagactgagatggggggttttgtcaagacccacaagagcaatgcatacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatatctgctagtatagcaggtgatatggttcttgcttctgcttactcgcatgagttgccacgatatggtctcgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagtagtaccagtctcacttcagtgagtacattaagaagggaattgangctgacgacatggaagctctgtacaagaagtccatgctgccatccggtgctgatcccttctgtggtcaaagtcaacaagcngccccccaaaggagcccaagtaggtccaccccccagatacttgatttcg

SEQ ID NO: 73579 - protein, 217 aa, Zea mays
  misc_feature: Ceres CLONE 1557967
  misc_feature (27)..(173): Pfam Name: Ribosomal_L18p Pfam Description: Ribosomal L18p/L5e family
MGGFVKTHKSNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKTRGLDKEYEGNVEATGEDFSVEPADERRPFRALLDVGLIRTTTGNRVFGALKGALDGGLDIPHSEKRFAGFKKDDKQLDADIHRKYIYGGHVADYMRNLAEEEPE

SEQ ID NO: 73580 - DNA, 1409 bp, Zea mays
  misc_feature: Ceres CLONE 1557969
  misc_feature: Encodes the peptide sequence at SEQ ID NO. 73581
aacaggggtacgtctctttctccacgctcgatgcccagtgcaagtgcccacctcagactcctcccggaccagctgacctccgctccattcaccccacaccttcttcttcttcttcgtcgtcgtcttcccctgctgcggttagcctggccgtggccgcctcctgctcttcgatctcgcgctgcgatggagcggtacgaggtgatcagggacatcggctcgggcaacttcggggtgacaaagctcgtccgggacgtcagtaccaaggagctcttcgccgtcaagttcatcgagagaggacaaaagattgatgagcatgttcagagggagattatgaaccaccggtccctgaagcacccaaacataattagattcaaggaggtcgtgctaactcccacgcatttggcaatagttatggaatatgctgctgggggtgagctatttgaaaggatctgcagtgcggggagatttagtgaggatgaggcaaggttcttcttccagcaactgatttcgggagtgagctattgccattccatgcaagtatgccatagagatctgaaactagaaaacactctcctagatggtagtgtcgcaccccggctcaagatctgtgatttcggttactccaagtcttctgtgctgcactctcaaccgaaatcaactgttggcacacctgcatacattgctccagaggtcctctctagaaaagagtacgatggaaaggttgctgatgtctggtcttgtggagtaacactatatgtgatgctcgtcggcgcgtatcctttcgaagaccctgatgacccgaagaacttccgcaagacgatcacgagaatactcagtgtacagtactcaattccagactacgttcgcgttacaatggagtgcggacatctgctgtctcggatatttgttggaaatcctgagcagagaataaccattcctgagatcaagaagcacccgtggttcctcaagaatctgcccatcgagatgaccgacgagtaccagcagagcatgcagttggcagacatgaacaccccggggcaaagcctggaggaggtgatggcgatcatccaggaggcgcggaagccaggggacgccatgaaccttgccgggcagctgccctgcctggggagcgtggaccttgacgacattgattttgacgatattgacgacatcgacactgagaacagcggcgacttcgtttgtgcagtgtgactgtgtgaggctcagcagggcaggagctagcttcctttgatcgttggtgtctgtagatccttgttgtgctatgcttccattcgttcctggatcagatatgttgttgtgtaaccgagaaaattggcgttgctgtggacaacagaaacagacccataaacttatgcggaaatctacccccccaaaaaaaaaaaaaaaaa

SEQ ID NO: 73581 - protein, 393 aa, Zea mays
  misc_feature: Ceres CLONE 1557969
  misc_feature (55)..(311): Pfam Name: Pkinase Pfam Description: Protein kinase domain
  misc_feature: SWISSPROT Homolog: EC 2.7.11.1 Non-specific serine/threonine protein kinase
MPSASAHLRLLPDQLTSAPFTPHLLLLLRRRLPLLRLAWPWPPPALRSRAAMERYEVIRDIGSGNFGVTKLVRDVSTKELFAVKFIERGQKIDEHVQREIMNHRSLKHPNIIRFKEVVLTPTHLAIVMEYAAGGELFERICSAGRFSEDEARFFFQQLISGVSYCHSMQVCHRDLKLENTLLDGSVAPRLKICDFGYSKSSVLHSQPKSTVGTPAYIAPEVLSRKEYDGKVADVWSCGVTLYVMLVGAYPFEDPDDPKNFRKTITRILSVQYSIPDYVRVTMECGHLLSRIFVGNPEQRITIPEIKKHPWFLKNLPIEMTDEYQQSMQLADMNTPGQSLEEVMAIIQEARKPGDAMNLAGQLPCLGSVDLDDIDFDDIDDIDTENSGDFVCAV

SEQ ID NO: 73582 - DNA, 1140 bp, Zea mays
  misc_feature: Ceres CLONE 1557971
  misc_feature: Encodes the peptide sequence at SEQ ID NO. 73583
aaacccgcaccgcaccactcgcgcctcgcgatcaccgctccgaactgtaaatcaaatggcgccgtcgccgctgtgctccgcttccccacgaccgcttcgagccccaggcaagcctccccgagacgtccgcccgccgcgggcggtcgtcgtggccgcgggcacccgtgtgagcggagcggaggcccgcgcgtcgctggtgctggccttggcctcgcatgcgctctccgcctcgcagcgccgcttagccgagctcgccgatgaggccgccaagtacgccttcccgtccggccgcttcgagccccgcaccctcgaggaggccctcatgtccgtgcctgatctcgagacagtcccgtttcgcgtactgaagcgcgaggcagagtacgagatcagagaagtggagtcatacttcgttgctgaaacgacgatgcccggaagatctgggttcgatttcaacgggtcatctcagtcgttcaacgtgctggcatcatatttattcggtaagaatactgcctctgagcaaatggaaatgacaacacctgtttttactcggaagggtgagtcaaacggccaatcaatggacatgacgaccccagtgataacaaaaaagtcagctggtacaaataaatggaaaatgtcatttgtgatgccagcgaagtatggttccaatttgcctcgcccaaaagatccttctgtgactatcaaggaggtgcccagcaaaatagttgccgttgcagccttttcaggtttggttactgatgatgatataaaccagagggagtctaaattgcgcgaatctctccgtaaagatgccacgtttagagtgaaagatgattcggtggtggaagtcgcacagtacaatccacctttcacacttccattcacaaggagaaatgaaatagcattggaggttgagaggaacgatatagccttatgatgtcctagattaacaaataaattattggcatttgagagtgtatgcaaatgcccatcgtccctaatgcatatatgtactaatttctatctggcatgttatgtatatatatagacatgttaattatcgcatgcatatattattgtattggaaattaaataataagagcaaaaaatgttgtgcgttcgagccaaaaaaaaaaaaaaaaa

SEQ ID NO: 73583 - protein, 292 aa, Zea mays
  misc_feature: Ceres CLONE 1557971
  misc_feature (94)..(286): Pfam Name: SOUL Pfam Description: SOUL heme-binding protein
MAPSPLCSASPRPLRAPGKPPRDVRPPRAVVVAAGTRVSGAEARASLVLALASHALSASQRRLAELADEAAKYAFPSGRFEPRTLEEALMSVPDLETVPFRVLKREAEYEIREVESYFVAETTMPGRSGFDFNGSSQSFNVLASYLFGKNTASEQMEMTTPVFTRKGESNGQSMDMTTPVITKKSAGTNKWKMSFVMPAKYGSNLPRPKDPSVTIKEVPSKIVAVAAFSGLVTDDDINQRESKLRESLRKDATFRVKDDSVVEVAQYNPPFTLPFTRRNEIALEVERNDIAL

SEQ ID NO: 73584 - DNA, 936 bp, Zea mays
  misc_feature: Ceres CLONE 1557973
  misc_feature: Encodes the peptide sequence at SEQ ID NO. 73585
  misc_feature (909)..(909): n is a, c, t, g, unknown, or other
ctccccgcggtggcggccgctctagaactagtggatcccccgggctgcaggaattcgtctcacccctagaaaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgccagctcttccaccctgagcagctcatcagtggcaaggaggatgccgctaacaatttcgcccgtggccactacacaattggcaaggagattgttgatctgtgccttgaccgtatccgcaagcttgctgacaactgcaccggcctccagggcttcctggtcttcaatgccgttggtggtggcactggctctggccttggttctctcctccttgagcgcctgtctgtggagacggcaagaaatccagctgggcttcactgtgtaccatctcccaggtgtcaacctctggtgtggagccctacacagcgtgctctccactcactcactcctggagcacactgatgtctccatcctgctcgacaacgagccatctatgacatctgcagcgctccctcgacattgagagcccactactccacttggatcgncttggtgctcaggtgactcatcgctgt

SEQ ID NO: 73585 - protein, 196 aa, Zea mays
  misc_feature: Ceres CLONE 1557973
  misc_feature (49)..(194): Pfam Name: Tubulin Pfam Description: Tubulin/FtsZ family, GTPase domain
MRECISVHIGQAGIQVGNACWELYCLEHGIQPDGQVPGDKTAGHHDDAFSTFFSQTGAGKHVPRAIFVDLEPTVIDEVRTGTYRQLFHPEQLISGKEDAANNFARGHYTIGKEIVDLCLDRIRKLADNCTGLQGFLVFNAVGGGTGSGLGSLLLERLSVETARNPAGLHCVPSPRCQPLVWSPTQRALHSLTPGAH

SEQ ID NO: 73586 - DNA, 937 bp, Zea mays
  misc_feature: Ceres CLONE 1557974
  misc_feature: Encodes the peptide sequence at SEQ ID NO. 73587
  misc_feature (729)..(729): n is a, c, t, g, unknown, or other
  misc_feature (908)..(908): n is a, c, t, g, unknown, or other
  misc_feature (911)..(911): n is a, c, t, g, unknown, or other
tccccgcggtggcggccgctctagaactagtggatcccccgggctgcaggaattcgtctcacccctagaaaaaatcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccgcaaggcgcaggtggaggagttctacgtcatcacgtggacgtcccccaaggagcaggtgttcgagatgcccaccggcggcgccgccatcatgcgggagggccccaacctcttgaagctggcgcgcaaggagcagtgcctggcgctcggcaccaggttgcgctccaagtacaagatcacctaccagttctaccgcgtcttccccaacggcgaggtgcagtacctccaccccaaggactgcgtctaccccggagaaggtcaaccccggcagggagggcgtctggcagaacttccgcagcatcggcaagaacgtcaaccccatcgacgtcaagttcaccggcnaggccaccttcgactaatcacacttcacgtacgccgcacgccccagccgggatcaaaattaagaaactcttcttctatgagtacagatattgtaattagctgcctgtacgtggtggcatgatctgagatggcatgaggatccctgtgtattttattaccagtctcatcttaaaaaaagngcnatgaagaataaagaaacatttaggct

SEQ ID NO: 73587 - protein, 234 aa, Zea mays
  misc_feature: Ceres CLONE 1557974
  misc_feature (62)..(201): Pfam Name: PsaD Pfam Description: PsaD
  misc_feature (195)..(195): Xaa is any aa, unknown, or other
MAMATQASAATRHLLAAAWAPAAKPRQLSSQLALPSSSSRGPAPLRASTEEAVEAPKGFVAPQLDPSTPSPIFGGSTGGLLRKAQVEEFYVITWTSPKEQVFEMPTGGAAIMREGPNLLKLARKEQCLALGTRLRSKYKITYQFYRVFPNGEVQYLHPKDCVYPGEGQPRQGGRLAELPQHRQERQPHRRQVHRXGHLRLITLHVRRTPQPGSKLRNSSSMSTDIVISCLYVVA

SEQ ID NO: 73588 - DNA, 965 bp, Zea mays
  misc_feature: Ceres CLONE 1557977
  misc_feature: Encodes the peptide sequence at SEQ ID NO. 73589
  misc_feature (682)..(682): n is a, c, t, g, unknown, or other
  misc_feature (919)..(919): n is a, c, t, g, unknown, or other
  misc_feature (920)..(920): n is a, c, t, g, unknown, or other
ctggagctccccgcggtggcggccgctctagaactagtggatcccccgggctgcaggaattcgtctcacccctagaaaaaactggagagagcatcaatgagaaggaccgctgtccagggtgcaagggtgagaaggtcattcaagagaagaaggttcttgaggttcatgttgagaaggggatgcaacacaaccagaagatcaccttccctggtgaagctgatgaagcgcctgatactgtcactggagacattgtattcgtcctccagcagaaggatcactccaaattcaaaagaaagggtgaagatctcttctatgagcacaccttgtctctgaccgaagcactatgtgggttccaatttgttcttacacatctggacaacaggcagcttctcatcaaatcagaccctggtgaagttgttaaacctgaccaattcaaggcgattaatgatgaggggatgccaatttaccagaggcctttcatgaaggggaagctgtacatccatttcacggtggagttccctgactcgttggcaccagagcagtgcaaggctctcgagacagtacttccaccaaggccttcatccaagctgacagacatggagatagatgaatgcgaggagacgactatgcatgatgtgaacaacatcgaggaagagatgcgcaggaagcaagctcacgctgnccaggaggcgtacgaagaggacgacgagatgccgggcggagccccagagagtgcagtgcgcgcaacagtaagcagactatcatcaggcattgggggaaggggtggtgccctaaagccatgggaatggatcctctggtttttgcctgtcgccgagctggggaaaatagaagctgaatcgacctccccaagcgggggaatggtatccttttttgctgcaacattaaaaatgctacccanngcatagctggggaccccttttaactcccggtttggggggattggt

SEQ ID NO: 73589 - protein, 307 aa, Zea mays
  misc_feature: Ceres CLONE 1557977
  misc_feature (64)..(188): Pfam Name: DnaJ_C Pfam Description: DnaJ C terminal region
  misc_feature (227)..(227): Xaa is any aa, unknown, or other
  misc_feature (306)..(306): Xaa is any aa, unknown, or other
GAPRGGGRSRTSGSPGLQEFVSPLEKTGESINEKDRCPGCKGEKVIQEKKVLEVHVEKGMQHNQKITFPGEADEAPDTVTGDIVFVLQQKDHSKFKRKGEDLFYEHTLSLTEALCGFQFVLTHLDNRQLLIKSDPGEVVKPDQFKAINDEGMPIYQRPFMKGKLYIHFTVEFPDSLAPEQCKALETVLPPRPSSKLTDMEIDECEETTMHDVNNIEEEMRRKQAHAXQEAYEEDDEMPGGAPESAVRATVSRLSSGIGGRGGALKPWEWILWFLPVAELGKIEAESTSPSGGMVSFFAATLKMLPXA

SEQ ID NO: 73590 - DNA, 925 bp, Zea mays
  misc_feature: Ceres CLONE 1557978
  misc_feature: Encodes the peptide sequence at SEQ ID NO. 73591
  misc_feature (732)..(732): n is a, c, t, g, unknown, or other
ctccccgcggtggcggccgctctagaactagtggatcccccgggctgcaggaattcgtctcacccctagaaaaagaattcaccaagtgttggattgttcacccaccaatagggaacgtgagctgggtttagaccgtcgtgagacaggttagttttaccctactgatgaccgcgccgcgatagtaattcaacctagtacgagaggaaccgttgattcacacaattggtcatcgcgcttggttgaaaagccagtggcgcgaagctaccgtgtgccggattatgactgaacgccactcccaccgggctcctccggctccacatctgccgtcgaccaaacccgccctgctaaatactcgctccatacagttctcctcgcaattaacacctccgttagcacgagctgcagggagggagttgggaggagaaacagagctaccggggcgatgggcaccgtgctcgattcgcacttcctggcgctcaccgccatcgttactgtggggtaccagctgctgttcttcatcatcacagctctcctccggttcgataaggtcaccgatttcgcaggcagtacaaattttatcataatcgccatcctaacattagctttgaagggagcatggcatttccgtcagattgtgctgacagtgcttgtcaccatttggggtcttcgtctaggattatttttattgatgaggattttgcaatgggggtgaaagaccgaagtttgacaaantgcgtgataatttgggggaaattggcaggttttttggatttttcagggctgttgttgggtttgggtctgtcagcttgccccgtcactgtttgtgaatgcaagtgacaggaaacccctcgattggaagccggggatattaatcggcgggaataaattgtttggggcggggaatttgggtaggaagccacagctg

SEQ ID NO: 73591 - protein, 89 aa, Zea mays
  misc_feature: Ceres CLONE 1557978
MGTVLDSHFLALTAIVTVGYQLLFFIITALLRFDKVTDFAGSTNFIIIAILTLALKGAWHFRQIVLTVLVTIWGLRLGLFLLMRILQWG

SEQ ID NO: 73592 - DNA, 880 bp, Zea mays
  misc_feature: Ceres CLONE 1557984
  misc_feature: Encodes the peptide sequence at SEQ ID NO. 73593
tggagctccccgcggtggcggccgctcctagaactagtggatcccccgggctgcaggaattcgtctcacccctagaaaaaagaaggtaagttgttctagaacaagtagacgccaccgaagaatctagaatacagcacgcagggcacaaggagaagaagaggggaagaaatattcttcccgtcgaaagacggagagaggaaaagggacaagggcaaggcaagagagaggcgtcgtcgtttgatctgctgccggagtgcgaagaggaagaggaagaggaagaggagcgccggagttgtaaagatgttcctggtggactggttctatggggtgctggcatcgcttgggctgtggcagaaggaggctaagatcctcttccttggcctcgacaacgccggcaagaccaccctcctccacatgctgaaggacgagcggctcgtacagcaccagccaacgcagtaccccacgtcagaagagttgagcatcggcaggatcaagttcaaggcgttcgaccttgggggccaccagatcgcccgccgcgtctggaaggactactacgccaaggttgatgctgttgtgtacttggtggatgctgttgacaaagaacgttttgccgagtcgaagaaggagctcgatgcgcttcttgcagatgactcccttgcaaacgttcctttcctcatactgggcaacaagattgacatcccatacgcggcttcagaggaagaagctgagtactacctcggcctgagcaacttcacaacggggaagggcacgtgaattggccgactcccacgtcgcccccctggagatctccatgtgcagtgtgggcgcaagatgggctatggcgaaggcttcaatggatgctcagtacatcagggaaccc

SEQ ID NO: 73593 - protein, 157 aa, Zea mays
  misc_feature: Ceres CLONE 1557984
  misc_feature (6)..(157): Pfam Name: Arf Pfam Description: ADP-ribosylation factor family
MFLVDWFYGVLASLGLWQKEAKILFLGLDNAGKTTLLHMLKDERLVQHQPTQYPTSEELSIGRIKFKAFDLGGHQIARRVWKDYYAKVDAVVYLVDAVDKERFAESKKELDALLADDSLANVPFLILGNKIDIPYAASEEEAEYYLGLSNFTTGKGT

SEQ ID NO: 73594 - DNA, 990 bp, Zea mays
  misc_feature: Ceres CLONE 1557985
  misc_feature (680)..(680): n is a, c, t, g, unknown, or other
  misc_feature (799)..(799): n is a, c, t, g, unknown, or other
  misc_feature (903)..(903): n is a, c, t, g, unknown, or other
ctggagctccccgcggtggcggccgctctagaactagtggatcccccgtggctgcaggaattcgtctcacccctagaaaaaaaaagtaaatatgttctaaaaaaaataaaacaccaccgaaaaaatctaaaataaaggaaagattgcccgagaaaaaaggatgccggcgggggaaacaagacatgctggaaaatgggtaccattattactggaatgtgccccaactgaagttgattgattgagcctttaaataaataaataaaaaggctggtaaaattaaacctgtatcaggggttgcaaccaaatggtggtccacgtgattccctgcaggatgaggcacctagctagctgttggattcctgcacaaggccaaaaaaaagccgtgcggacaatgcaccaaacgaatgctcgcatgaaattgaatgaacacccacccagggagggaatgaaggaaggaagctccggtattgatccgccggccgacagatgctgtctgatcaacactacactatgatgagtctatgacatgagtggagtggagggacggtgcacatgcatcttgggcagtctgcagtgtgcagcaaggacgatagcatgcggtttgcttttggcggctctattctacctgcaactgcaactgcaactcatcacaggggagggaaggtagaataggagcaacntgtgggaggtactgtaacaacaagctagcatgccaagtaacacactactgtttcctgtcgcgtacagtacgtccattctacgtactgggatctggggaatggggatgctggtgccacantacttaccagagagcagcatgcacctgggggtccagtccaggggccttgcctaccctccctctcttatacgtctgcatctagacgtgcatcttaaggtcaacantaatgaaggtacccattgctgtgcttgcaaaaccaccacggaacccaccaaacagggttttttttgtttagccgatccctaatgcct

SEQ ID NO: 73595 - DNA, 872 bp, Zea mays
  misc_feature: Ceres CLONE 1557986
  misc_feature: Encodes the peptide sequence at SEQ ID NO. 73596
tggagctccccgcggtggcggccgctctagaactagtggatcccccgggctgcaggaattcgtctcacccctagaaaaacaattcaccggcctcctcctcctcccaggccatcgccgtctccggggcttcctacaacttcaaaatggcggctaccaccaccgccatggctataccaactatctcacccaccgctcctattccatccgcgcccttcccataccttcccctccccctcagcctccgcctcagctctcaacccctcctcttcactacttcgcgcccccgacttcctccaaggtcccaaagccacctcctgggacgaatccttcccccaggatggtggagacgcagaggaatccgatgccgctggtgaccaccaagaccacgaggataaccaccctccccagccggtgtcctcactcacgagttccatttcgcggcgccacccgagggctacgtctagcccgaggcgtttgacgagataacgccggactacgcagaagacgtggcggcggcccacaaatctctctacgggccgaacgactgcgacgagacagtgcaggcgaacaatgtctttgaggacgaggtggtcgaccccatctacatggaccgggagcaggacctgaacgaccatctcaccgatcacttcctgcatgacatccccgtcaccaaagtcgtcaagggaaggaagatgctctactaccgcgcaatcgacgatcttagatactcaaaggccacattagcgtcaagcacgggaaaagccaaggaggtctcggaagacatcaactagcccgccctggaacgcctgcggcacctttgtcccaggacagactaggcaatagcccagggttcccaccagaagctcatgtga

SEQ ID NO: 73596 - protein, 61 aa, Zea mays
  misc_feature: Ceres CLONE 1557986
MDREQDLNDHLTDHFLHDIPVTKVVKGRKMLYYRAIDDLRYSKATLASSTGKAKEVSEDIN

SEQ ID NO: 73597 - DNA, 961 bp, Zea mays
  misc_feature: Ceres CLONE 1557987
  misc_feature: Encodes the peptide sequence at SEQ ID NO. 73598
ctccccgcggtggcggccagctctagaactagtggatcccccgggctgcaggaattcgtctcacccctagaaaaaatcgctccctctcagcttcctcattggccatccttcgtcttccatggagaggctccttgccggcctactactcggcttcctattattgatcgcgtcagtaggaagccatgcaactcgtgctccagatcagtactggaagtctgctcttcccgacactcccatgccgagctccctctcccaactcctcaacaccccagctggcaagggcggcgtcggtggaggcagcagcggcaagaagcccggcggcaccacggtgggagttgggaaagggggagtgggcgttaacgttaaccctaccaaacccggcggcgccggtacaaccgttggcgttggcaaaggtggcgtcggcgtcggcgtcaatcccgggtacggcaagccgggtggcaccacggtgggcgttggcaagggcagggttggcgtccacgtgaacccgggcaagaagcccgtccacgtccccgtcggccctttccagtacgagtacgccgcatcggagacgcagttgcacgacgaccccagcgtggcgctcttcttccgagaggaggacctgcagcccggtaagaagacgaccgtccagttctgcaacaccgcgatggccggcgccaagttcctcccgcgtagcgatgccgatgccatcccgttctcctccgagaaggtccccgagatcctcggccgcttctcggtggacccggactccatggatgcggcggagatggcgcatacgctgcacgactgcttagcgccccggccagggtcgaagagtatgcgtgcgccacgtcgctgggatccatggtggacttttgcaccgccagctcgggaccagcacctgaaggccgcgtctacgtccgggggtagggaaggctcccccaagcaggagtacacgtggacg

SEQ ID NO: 73598 - protein, 281 aa, Zea mays
  misc_feature: Ceres CLONE 1557987
  misc_feature (160)..(281): Pfam Name: BURP Pfam Description: BURP domain
MERLLAGLLLGFLLLIASVGSHATRAPDQYWKSALPDTPMPSSLSQLLNTPAGKGGVGGGSSGKKPGGTTVGVGKGGVGVNVNPTKPGGAGTTVGVGKGGVGVGVNPGYGKPGGTTVGVGKGRVGVHVNPGKKPVHVPVGPFQYEYAASETQLHDDPSVALFFREEDLQPGKKTTVQFCNTAMAGAKFLPRSDADAIPFSSEKVPEILGRFSVDPDSMDAAEMAHTLHDCLAPRPGSKSMRAPRRWDPWWTFAPPARDQHLKAASTSGGREGSPKQEYTWT

SEQ ID NO: 73599 - DNA, 987 bp, Zea mays
  misc_feature: Ceres CLONE 1557988
  misc_feature: Translation starting site: 139
ctggagctccccgcggtggcggccgctctagaactagtggatcccccgggctgcaggaattcgtctcacccctagaaaaagcgcactccaccccactcgccgccgccgctgccaccgccgcttgctgccgcagccgccatgggggcgtacaagtacgtgtcggaactatggaggaggaagcagtcggacgtgatgcgcttcgtgcagcgcgtgcgctgctgggagtacaggcagcagccgtccatcgtccgcctcaccaggcccacccgccccgacaaggcccgtcgtctcggctacaaggccaagcagggatatgttgtctaccgtgtccgtgtgaagcgtggtggcaggaagaggcctgtgcccaagggtattgtctatggcaagcccaagcaccagggtatcacccagctcaagttccagaggaacaagaggtctgtcgctgaagagagagctggacgtaagcttggtggactggaggtttcttaactcctactgggtgaatgaggatagtacctacaagtacttcgagatcatccgttgtggacgttgcccacaaagccatcaaaaccgaccccaagatcaactgggtatgcaaacctggtgcccagcaccggcgagcttccgtgggcccacccccacaagggaaaaaattcccgtgggcctgcggggcaagggcccaccccccccccaaaaaaggggccccaagggaacccccctggaagcggaaccaaaccccttcccctcgttcctttccggtgaaaaaccccccgggggcttggaaaaacgcccctgtgccaaactttcccataaagaaaaaaggggggccggcccccggggggattttaaaaattttcgcctttgggtccttggggcctttttttgggaaaaacatatgtggggaattttgcaggaaatttgtgtccccccctttatttttacaaacaagggggggggttttatcgccgcgcccgctgggggaaaaaa

SEQ ID NO: 73600 - DNA, 880 bp, Zea mays
  misc_feature: Ceres CLONE 1557990
  misc_feature: SWISSPROT Homolog: EC 1.10.99.1 Plastoquinol--plastocyanin reductase
  misc_feature (840)..(840): n is a, c, t, g, unknown, or other
  misc_feature (860)..(860): n is a, c, t, g, unknown, or other
ctggagctccccgcggtggcggccgctctagaactagtggatcccccgggctgcaggaattcgtctcacccctagaaaaacacacgcctggggacgccagtgagtgaacaccacccgtattgtcgcaactcctgacccctacggatcctggcctgctgcagacatggctaactacgtggagctctccaccgccgcccatcccactcagctctaccactcccgcgcttccctgggcaagccggcgaacgggcttggcctgagcatgggccgcgagcgcgcccacctgaccattgagtgccatggccgggaacaccatctccgcccaccgcgtcccctacatggagaagcagaagctgatgaacctcctccgcctcggcgccatctcgtgtacccaccgtcggcatggtcgtcccctaaggcgccttctgcctccctgcccgctccgggaacgccggcggcgggacctacgcaaacgacaagctgggccaccacatcacaggggaagcatggctcaacacgcaccggcccaacgaccacacactcgcgcgcgcgctcgacggtgaccccacgtacctggtggcggagcatgacaagacgctggccacctacgggatcaacgccgtgtgcactcaactaggatgcctcgagccatggaaccgcgctgagaacaagttcatctgtccctgtcacggatgacactcaacaaccagggaatggtggctcgatgtaccggagcatctgtccctggccctggttgacgccgacggcgactacggccaagtcctcttcgtcccgtgggtcgagacggactacagaccggcggagacccgggtgacaggnatgaagagatccggaaccancgttgctcttgctcaaactg

SEQ ID NO: 73601 - DNA, 1017 bp, Zea mays
  misc_feature: Ceres CLONE 1557991
  misc_feature: Encodes the peptide sequence at SEQ ID NO. 73602
  misc_feature (935)..(935): n is a, c, t, g, unknown, or other
ctcaccgcggtggcggccgctctagaactagtggatcccccgggctgcaggaattcgtctcacccctagaaaaaaacaagcctgtggactcgagtgagtgaactccagccgtattgtcgcaactcctgacccctacggatcctgggccgccgcagacatggctaactacctggagctctccaggggtgccaatcccacccggctctaccactccctcgcttccctgggcaagccggtgaaggggcttggcctgagcatgggccgcgagcgcgcccagctgaccattgtgtgccatggcggggagcagcatctccgccgacctcgtccgctacatggagaagcagaagctgatgaacctcctcctcctcggcaccatctcgttacccactgtagccacccacggccccttaggtgccttcttcttccctgcccactccgggaacgccgggggcgctacctacgcaaacgacaagctgggcaaccacattcacaagggaaggatggctcaacacgcacgggtccataataccgcactctcgggcagggggttgacgggtgaccaccccttccctggtggtggagccagaacaaaacgctgggcccccttcggggataaaccccgttgtgcaattgaccttaggatccgtcattgcctgtaaaataccgcgctgaaaaacatagttttttctgtcccctttcctccgggttcccactttctaacaacccagggggaatgttggttcctggggaaccggtgacctgttgtcccttggtcccttgctttgacctccgaaacgcttactaaaggcaagggcccccctctctgtaccctgttgtcgggaacccgatcttcaagtaccggccggaaaacccctggggggcaacgggttaaataatattcccggaaaacatctgtggtcccgtgttccaaatcncatccctttgtttcccccctctcccttcgaaaaagaaaatgcgctagtttccttcctccggggagtattttcacaaaatacc

SEQ ID NO: 73602 - protein, 121 aa, Zea mays
  misc_feature: Ceres CLONE 1557991
  misc_feature (9)..(47): Pfam Name: CytB6-F_Fe-S Pfam Description: Cytochrome B6-F complex Fe-S subunit
  misc_feature: SWISSPROT Homolog: EC 1.10.99.1 Plastoquinol--plastocyanin reductase
MAGSSISADLVRYMEKQKLMNLLLLGTISLPTVATHGPLGAFFFPAHSGNAGGATYANDKLGNHIHKGRMAQHARVHNTALSGRGLTGDHPFPGGGARTKRWAPFGDKPRCAIDLRIRHCL

SEQ ID NO: 73603 - DNA, 899 bp, Zea mays
  misc_feature: Ceres CLONE 1557992
  misc_feature: Encodes the peptide sequence at SEQ ID NO. 73604
ctccccgcggtggcggccgctctagaactagtggatcccccgggctgcaggaattcgtctcacccctagaaaaatccccttgcctctctgctcttgcctcgtcctcctgttgccgtgctgcagctgcagtacgccagagcagtggacaggctcagctccagcaggttgtgctcctcgctccgacctcggctccaagcgttctccggcgtccgcttctctagttcgcgccggtcaccgtcgcttgtcttcagctcgttcttctccatgctcggccctaactccagcacgccacgcacaccatgtcgtccggtctcgcctccacctgtgccccacttggcacgtacggcacccctcccagctcggccgtcctagcttcctcgctggtcgtgcctccacgctctgctccgaccaggcgctcccgccagcctgctgttgccatggctgcagctttgctctcgtcgccgtgaagactccaccagcgccttgcagcagcgcgctcctcgccgagctcgtggtcgtgctgttatgcctcgctccctctgtgttcgatgaaatgtcgaactaggaatcgatgacctcgccttgtcctcgcgattgtggttggctagtatcgtcgcctgccccaccgtggtgctcgccaaaacacctgaacccgagtttcatcgtcgtccatgcgaatatcatgccagttcgatcatggtacgtgaattaaccacgtgatgcggaagacccgagccatgtcgaccccatgcgcggaatgattcgcaaggtgatgctgatggacgaactgaagatggatatttaacgagtacatgacaatgatgatcgtccagcagacgtcacctaacaaaactaacctagtgtttattccagaaaagactactcgatcggggctgtat

SEQ ID NO: 73604 - protein, 55 aa, Zea mays
  misc_feature: Ceres CLONE 1557992
MSSGLASTCAPLGTYGTPPSSAVLASSLVVPPRSAPTRRSRQPAVAMAAALLSSP

SEQ ID NO: 73605 - DNA, 1000 bp, Zea mays
  misc_feature: Ceres CLONE 1557993
  misc_feature: Encodes the peptide sequence at SEQ ID NO. 73606
  misc_feature (851)..(851): n is a, c, t, g, unknown, or other
  misc_feature (866)..(866): n is a, c, t, g, unknown, or other
tggagctccccgcggtggcggccgctctagaactagtggatcccccgggctgcaggaattcgtctcacccctagaaaaagacaccctccacaaaccgcgaatttcctccccggctcctctccctcctccccagtcaatccccacacagtctcggccgggccctcgcgaggccgccgtggaaggacccccagcgatgggctccggcgaggaggacacaggaggcggaggaggggcggtgcggggcgcggtgctgaaggcgctcgtggttgtcggcggcgtcctgctgctccgccgcctgcgccgctccactacccgatgggaccacgcgcgagccgtcgccgacgcgctctccggagaaaagttctcgagggagcaggcgaggaaggatcctgacaacttcttcaatttgagaatgctcacatgtcctgcaaccgagatggtggatggttcaagggtgctttactttgagcaggcattttggagatctccagaaaagccttttagacaaagattctacatggtaaagccctgtccgaaggagatgaaatgcgatgttgagttgagttcatatgcaattagggatgctgaagagtacaagaatttctgtgaccgtcaaaaggatcagaggccacaggcagaagaagtaattgcagatatcgcagagcatctgaccaccatacacttgtcacgatgcggacgaagaaagcgttgcttatacgaaggatctacccccacctgaagttttcccaacaacgggagcggcgcgtcgtactggtacgtcggatctgtccatccacaaataacgcgaagtcatatctggggacaaaggttttgacgacgaagggaaccangtttgggggggaccnaggcgtgggcctttacgagtttcagcctgctccccaatccaaatttgacgaactggtcctcgcgttaaatttcttcggctccctggtcgctagagaaaagcctgataaagcatttggtattgtttgacccgtag

SEQ ID NO: 73606 - protein, 181 aa, Zea mays
  misc_feature: Ceres CLONE 1557993
MGSGEEDTGGGGGAVRGAVLKALVVVGGVLLLRRLRRSTTRWDHARAVADALSGEKFSREQARKDPDNFFNLRMLTCPATEMVDGSRVLYFEQAFWRSPEKPFRQRFYMVKPCPKEMKCDVELSSYAIRDAEEYKNFCDRQKDQRPQAEEVIADIAEHLTTIHLSRCGRRKRCLYEGSTPT

SEQ ID NO: 73607 - DNA, 1001 bp, Zea mays
  misc_feature: Ceres CLONE 1557994
  misc_feature: Translation starting site: 145
ctccccgcggtggcggccgctctagaactagtggatcccccgggctgcaggaattcgtctcacccctagaaaaaagctcaaacttccaagaacccgtgaagtgaagtgaggaggtcggcggaaccggaacccaggcgatacgagatgatcgcaaacggcctccgcaaatccagtgctgcctcctcccaggttagcaagctggtgaaatacattgctagtgctggaagcttgcaaggggggcacagtttatcagagccgtctgccagacattacagctctgaaccttcacttcaggcgacagaagaaaatgggtttaaggggcacagcatgctggctccattcacagcgggatggcagagcactgatgtacacccattggttatagagagatcagagggtttcttatgtctatgacagcaatgggaagaagtatattgatgctcttgcaggactgtggtgcacagctttagggtggtaatgagcctcgactagtcaaagcggcaactgagcaattaaacaaaattaccgttctaccattccttttggaaccgtacaaccaaaccctcattggatcccgcaaaatgaaattcccagcatggtccaccgcagggaaatgggggaaaagggttccttcacaaaaagggggttcacaaaacaatggatcccccgggtaaaaacaggggggggaattaaaaaaaggccccggggaaaggcccaaaaaaaaaaaattttttggcccgcccaaaatcgcccccgggggaacaccttttttgggcctttttttaaggggtccccccccctttccaaaaaatttggttcccccccccttttttgtctggcaaaaaaagggccccccaaggggggaatccccctccccaagaaaaaaaaaaaaatttcccccccgcccccccaaatggggagaattctcgccaaaaaagaagcaaaaaatttgtctttttttataaaacagggggggggggtggtgttcccccccacaaaaa

SEQ ID NO: 73608 - DNA, 871 bp, Zea mays
  misc_feature: Ceres CLONE 1557996
  misc_feature: Encodes the peptide sequence at SEQ ID NO. 73609
  misc_feature (705)..(705): n is a, c, t, g, unknown, or other
tggagctccccgcggtggcggccgctctagaactagtggatcccccgggctgcaggaattcgtctcacccctagaaaaaaccagcaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggagaccttcgcgcgcaaccgggagctagaggtgatccactcccggtgggcgatgctgggggcgctgggctgcgtgttcccggagatcctggctaagaacggcgtcaagttcggcgaggcggtgtggttcaaggccggcgcgcagatcttctcggagggcgggctggactacctggggaaccccaacctggtgcacgcgcagagcatcctggccatctgggcgtgccaggtggtgctcatgggcttcgtcgagggctaccgcgtcggcggcggcccgctcggggaaaggctcgacnaggtgtaccccggcggcgccttcgacccgctgggccctcgcgacgacccggacaccgcgccgagctcaaggtgagggagctcagacgggcggctttgcatgttctccatggttctctcctcgtgcaagcatcgtcaccggcagggccccatcgagaacctctcgac

SEQ ID NO: 73609 - protein, 205 aa, Zea mays
  misc_feature: Ceres CLONE 1557996
  misc_feature (59)..(206): Pfam Name: Chloroa_b-bind Pfam Description: Chlorophyll A-B binding protein
  misc_feature (182)..(182): Xaa is any aa, unknown, or other
MAASALHQTTSFLGQALVARAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGERLDXVYPGGAFDPLGPRDDPDTAPSSR

SEQ ID NO: 73610 - DNA, 971 bp, Zea mays
  misc_feature: Ceres CLONE 1557997
  misc_feature: Encodes the peptide sequence at SEQ ID NO. 73611
  misc_feature (730)..(730): n is a, c, t, g, unknown, or other
  misc_feature (766)..(766): n is a, c, t, g, unknown, or other
ctggagctccccgcggtggcggccgctctagaactagtggatcccccgggctgcaggaattcgtctcacccctagaaaaaactccaaagccaacaaacagagctccaactcagaaagcatccgtcccttggcagcagcaacaagctactagctatgtgtgtttagagcgagcgaggggaaaaaaaagaaaacatctaagatatactccatcatcttcgtttgattaacccgcccagtaaagccatgggtactaatgatagagcggtcatttctctagtactcctcgtgtgcatcgctagccgctcgtccttgggtgccgctgaaactgacgttgagcagaagcgctcgtcagtcccgttgatgtttgtgttcggtgattcgctggtcgatgtcggaaacaataacttcctgccgccgcctgcaccccgtgctgcatctccgtacggcatcgacttccctgctggcacccccggcgccgtctcaggacggttcacgaatggctacaaccttgccgatttagtcgcgcgacgtctggggttcaagatgagtccacctgcttacctctcgttgacaccgttatcaaagtttgacctgttcacgtgccgaattggtgccaattacgcgtctggcggatctggcattctcaacaccacgggaaacgggacactcacgctgcagaaacaaatcacgctgttctcgaaaactaaagctagtatgtcgtggggccgcntgcagctcagctctatggtatcgaggtcgttgtccnttatcagcgccggcggcatgtactctccgcctcagctgaatgggctgggcgaacagacgccccagctactcagtagcatgttctcaactatgtcaggatttcgacgcgtgtacagtggggagccgggagttggggatcattaactggcaacgatcgctgaccccatggtccgatcccctgtgccaagttgtatgcagaccctgca

SEQ ID NO: 73611 - protein, 221 aa, Zea mays
  misc_feature: Ceres CLONE 1557997
  misc_feature (163)..(163): Xaa is any aa, unknown, or other
  misc_feature (175)..(175): Xaa is any aa, unknown, or other
MGTNDRAVISLVLLVCIASRSSLGAAETDVEQKRSSVPLMFVFGDSLVDVGNNNFLPPPAPRAASPYGIDFPAGTPGAVSGRFTNGYNLADLVARRLGFKMSPPAYLSLTPLSKFDLFTCRIGANYASGGSGILNTTGNGTLTLQKQITLFSKTKASMSWGRXQLSSMVSRSLSXISAGGMYSPPQLNGLGEQTPQLLSSMFSTMSGFRRVYSGEPGVGDH

SEQ ID NO: 73612 - DNA, 921 bp, Zea mays
  misc_feature: Ceres CLONE 1557998
  misc_feature: Translation starting site: 437
  misc_feature: SWISSPROT Homolog: EC 5.2.1.8 Peptidylprolyl isomerase
  misc_feature (596)..(596): n is a, c, t, g, unknown, or other
  misc_feature (667)..(667): n is a, c, t, g, unknown, or other
  misc_feature (709)..(709): n is a, c, t, g, unknown, or other
  misc_feature (769)..(769): n is a, c, t, g, unknown, or other
acccgcggtggcggccgctctagaactagtggatcccccgggctgcaggaattcgtctcacccctagaaaaactctccgtgctttctcagaggtgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaaggtccgttcagttccattcgtccgttcggcgcgctcgcaccagatccgtccacgtttcatccagatctgtctgacctgccttttctccccccgcagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatactgtggcgggcgccgtgatggaggcggctacggcggtggcggtggaggctacngcggtggtcgtggaggctacggcggcggtgggggatacggtggtgcaaaccgcggcggcggctacggcaancacgacgggaactggaggaactgagcggtggggtccgctgangcctagttatcttggtcgcttctgctaccgtgttcaccctagtctagagggggtttatcntcgtctgtggtcgtctcgtgtccgtatgttttcgtttcgtgttccttgttgttgtttgccatcctgtgtttttgacgaaagctccacccccccgaaggttggtaagtgatggcaccatcgtgccatccccgagcctgcattgagctccacct

SEQ ID NO: 73613 - DNA, 1049 bp, Zea mays
  misc_feature: Ceres CLONE 1557999
  misc_feature: Encodes the peptide sequence at SEQ ID NO. 73614
  misc_feature (215)..(215): n is a, c, t, g, unknown, or other
  misc_feature (665)..(665): n is a, c, t, g, unknown, or other
  misc_feature (812)..(812): n is a, c, t, g, unknown, or other
ctggagctccccgcggtggcggccgctctagaactagtggatcccccgggctgcaggaattcgtctcacccctagaaaaaaattgttggtcttcaacgaggaatgcctagtaagcgcgagtcatcagctcgcgttgactacgtccctgccctttgtacacaccgcccgtcgctcctaccgattgaatggtccggtgaagtgttcgatcgcggcgnaacgggggcggttcgccgcccccgacgtcgcgagaagtccattgaaccttatcatttagaggaaggagaagtcgtaacaaggtttccgtaggtgaacctgcggaaggaaaccttatcggtctatctatccttctatccccattcccatcccgagacaggagaaggcaaggatgctgctcctgagctcccccttcgtgtccgtgtcgccgccgccgccgccgctcagctcccatggcgctcgcccggcgctgcggatcgaggcggccaggcagccgacggtggcgggtggtgacgaccaaggcggacaacgcgggtttgttttataataggtggggccccttgttctccaccccccaagttacaagcgcccgggagccgcatccaagaaaaggtaccaggccgcacgaacccccgacaaaccaggttcaaagggtccggcgacggtcgtcnaagcttcctacccctccccgtcccagttctcctaagacccaaagcactttcgttcacccagtcccgatccccgcccccggggacaactccggcgaagaagtctcaagctccctaccggccgcctccatgcccgtacgaccaaccagnaacccgtccctccccaagagtgaattggattgtgaatttgaatggctgccctggcctatgggcttccggcccaaaagctcctcctccaacaaaaaggggctggcttcccaattccaaaagcgaattccatggggggtgtttgatgaaacaaattccctttttccctttcaatcaaaggttttaccccatttcatccaaaatagctgttgcccttggtgggaaacgaccctgggattt

SEQ ID NO: 73614 - protein, 86 aa, Zea mays
  misc_feature: Ceres CLONE 1557999
  misc_feature (7)..(7): Xaa is any aa, unknown, or other
MPVRPTXNPSLPKSELDCEFEWLPWPMGFRPKSSSSNKKGLASQFQKRIPWGVFDETNSLFPFQSKVLPHFIQNSCCPWWETTLGF

SEQ ID NO: 73615 - DNA, 934 bp, Zea mays
  misc_feature: Ceres CLONE 1558000
  misc_feature: Translation starting site: 187
  misc_feature: SWISSPROT Homolog: EC 3.4.25.1 Proteasome endopeptidase complex
  misc_feature (484)..(484): n is a, c, t, g, unknown, or other
  misc_feature (525)..(525): n is a, c, t, g, unknown, or other
tggagctccccgcggtggcggccgctctagaactagtggatcccccgggctgcaggaattcgtctcacccctagaaaaactggttcttcttttaacgcaagaaagaaagaaagaaaaggggcaggaagaaatcgagcctcactcgatccatcgcctcgccgcagcacacacgaggccggcggcgccatggccatgaagctggacatgtccgcgctcgagaccaacttcgccaacctgaccgcctccgccggcgacgacacgtacttctccgccgaggcccccgacgtgccgtccatggtgctccccatctgcgacgacttcgacggcttccaggcggccaccaaggatatggtgaagaataagaaggggacgaccacgcttgccttcatcttcgacaagggcgtcatcgtcgccgctgattccaggccagcatgggcagttatatatcctcacaaaccgtgaggaaaaatgatgaaataatccntacatgctggggacatgggctgggagtgctgctgattgccnattttgcataggaacctagtaacaagtgtcggtctcatgagctttcaacaagcgaagatctctatgctggtgcttcaaaacggtgggcaacatcctttatcataccggggaagggactgccattggccaaggcccctgaaggaaataaaaggccccggtttaacaattttaacagaaggggcccgccccgggggaaagggtccctgtgggcctggtaacggagccctgggttctgggaaagggtcccctctccctgggcgtggggaaaccccaaattccgcccgggttttgggggcaactccgcgaaccaagggggggtgtttaattttccacccgcccgcgggtggaaacctttggggggagggggggggggcccccccaccccgggtgaaaaacgggtgaaaagagg

SEQ ID NO: 73616 - DNA, 1095 bp, Zea mays
  misc_feature: Ceres CLONE 1558001
  misc_feature (1095)..(1095): n is a, c, t, g, unknown, or other
gcggtggcggacgctctagaactagtggatcccccgggctgcaggaattcgtctcacccctagaaaaactggttcttctgcttcaccgacgaaagaaagaaagaaaaggggcaagaagaaatcgagcctcactcgatacatcgcctcgccgcaccacatcacgaagccggcggcgccatgggccatgaagctggacatgcccgcgctcgataccaacttcgcctacgtgactggcagcactggcgacgacactaagccctaggcagagcccccccacgggcaagagcgggtgcatgtccttccgctacaaatttgagaggctaacacgttgcaccccgcgtattcacactaattgatgcaagagagggacctgcagcgtatcttacgtaggtgagagccccctttgtgccaccgacaccgggatcatgaagatgaccacaatcccgaaacgtctatagagctcgccggtaaacacccaaacaggacaacctaaaactgtcccgtaaatcctcgaggaaaacagccctaccaaacgtggtaatgaaaattttataaataccagagcgtataaccagtgggaaaaagactaaaggacatccccccctggcaggatagaaacccgtatacctgcctttgtcttacacagatcttctcctgttgatcgaaaaaaccaacacatatgggactctacggagcacctcctccgcggaaggactgaaaactcgacgtagctagccccacttaacacacgagactcttacttatggagacggcaacaaacagacccgtaggtctggaatacctccttttaaaaaaaacctccgcctcctctgtattccgcccatcccggaccctagcctgttgttatatattacagtgatgagcgtcgtctctcccctccccacacggtatgcgaacgcatattatttagcggtgcaaaacacccaatatgatttgtggcccatcaaggataccacgtatgaggcggttttcaccgagggagaaacctctccagatcgccaggatctcccaaagcctggtcctctgacccgcattctcatcaggttgtcccatattttgttttccagaaacgcn

SEQ ID NO: 73617 - DNA, 876 bp, Zea mays
  misc_feature: Ceres CLONE 1558002
  misc_feature: Encodes the peptide sequence at SEQ ID NO. 73618
ctccccgcggtggcggccgctctagaactagtggatcccccgggctgcaggaattcgtctcacccctagaaaaaatcctcgcctccgccatggccgccgtcggcatcccctcccctccggcgccacacgtcttcgcgcccgccgcatctccttcctcctccacgtactccacactgggcccccgccgtctccgcctctccacccgactcggactcgccgccgcggcggcgtcgtgccgtacgcggtgcgctgccgctgccgatggcggggccgcggcttcggagggtgcctctgcggtggcggagctggagggggaccccgacgctggcacagacgttgccggaggcgccgcgacctccacgcggccgccctactcgctcatctccgcggacaacgtgcagaaggcgatgcgcggcctcgcaattacagatgctgaccactatgggaggcttggagtcaccaggctagcttctactgatgaggtaaaagctgcgtacgagaagatgtgtgaagaactaaatagcaaagaactagaagaagaggagcttaacaaggaacatgagctcctaaaggaatcatttactatactatcaacggaggaagaacgaagattatatgattggagcttgtcaagaagtggacagcctgagcgatatgtctggccctttgaagttgatccattggagttggcaccagatcccccaaaggaaccagaagaagagttccccaccaagctcgtgggctacgtgctaacagccgtggttcatacctctcttggtgccccctggaggggccccaaaaaaaaaatatttttcccccccagagaaaaagaattgtaatccaatgatctgcccggccaaggccgcaacagaatgt

SEQ ID NO: 73618 - protein, 249 aa, Zea mays
  misc_feature: Ceres CLONE 1558002
  misc_feature (116)..(177): Pfam Name: DnaJ Pfam Description: DnaJ domain
MAAVGIPSPPAPHVFAPAASPSSSTYSTLGPRRLRLSTRLGLAAAAASCRTRCAAAADGGAAASEGASAVAELEGDPDAGTDVAGGAATSTRPPYSLISADNVQKAMRGLAITDADHYGRLGVTRLASTDEVKAAYEKMCEELNSKELEEEELNKEHELLKESFTILSTEEERRLYDWSLSRSGQPERYVWPFEVDPLELAPDPPKEPEEEFPTKLVGYVLTAVVHTSLGAPWRGPKKKIFFPPREKEL

SEQ ID NO: 73619 - DNA, 965 bp, Zea mays
  misc_feature: Ceres CLONE 1558003
  misc_feature: Encodes the peptide sequence at SEQ ID NO. 73620
  misc_feature (597)..(597): n is a, c, t, g, unknown, or other
  misc_feature (656)..(656): n is a, c, t, g, unknown, or other
tgctccccgcggtggcggccgctctagaactagtggatcccccgggctgcaggaattcgtctcacccctagaaaaaatatatccacacctgagtcccctccgccgcctgccgcactctcccgcgacgccaccaccacacgttcacggtagcgagagcttatcgtcgtcggcggcgaagatggtgtcgctgaagctgcagaagcggctcgccgcgagcgtcctcaagtgtgggaaaggcaaagtctggcttgaccccaatgaagtcagcgagatctccatggctaactcccgccagaacatccggaagttggttaaggatgggtttatcatcaggaagcctcagaaggttcactctaggtcccgtgcaagaagggcacatgaggccaagcagaagggaaggcactctggatatggcaagcgcaggggtaccagggaggctaggctccccaccaagattctgtggatgaggaggatgcgtgttctgaggcgcctgctctgcaagtaccgtgaggccaagaagatcgacaagcacatgtatcatgacatgtacatgaaggtcaagggtaatatgtttaagaacaagagggtgcttatggnagagtatccacaagtcaaaggctgagaagggcagagagagacactttctgatcagttgnaggcccaagcggcaatgagccaagcaagcccggagaggaaaaatgctaggagggaaggaaaagcctgcccaggcccaaaaaaaccaaaggacctgttggaaccccagtccttttaagggggggccaaaaagccaaaaagtaatttgggaacaacgcgggccttttgggaaaatataaacaaactttgaacccccgaaaatttgggggtattaatttggggccaaaaattgggggctgggtcctcccccctttgtgaaaaaccccccccaaaaatttttttgaagttttttgtgaaacgccccaaaatgg

SEQ ID NO: 73620 - protein, 147 aa, Zea mays
  misc_feature: Ceres CLONE 1558003
  misc_feature (2)..(146): Pfam Name: Ribosomal_L19e Pfam Description: Ribosomal protein L19e
  misc_feature (140)..(140): Xaa is any aa, unknown, or other
MVSLKLQKRLAASVLKCGKGKVWLDPNEVSEISMANSRQNIRKLVKDGFIIRKPQKVHSRSRARRAHEAKQKGRHSGYGKRRGTREARLPTKILWMRRMRVLRRLLCKYREAKKIDKHMYHDMYMKVKGNMFKNKRVLMXEYPQVKG

SEQ ID NO: 73621 - DNA, 918 bp, Zea mays
  misc_feature: Ceres CLONE 1558004
  misc_feature: Encodes the peptide sequence at SEQ ID NO. 73622
ggagctccccgcggtggcggccgctctagaactagtggatcccccgggctgcaggaattcgtctcacccctagaaaaaagctcgcactcactcacacccgcagcgaaggagggagcttgcacgggccaacgcacacacaacacaagctcgtcgtcgatggcgcggtgggctgcggtgctggcgctggccgcggccacggccatcgccgtggcgtccgtggcgggcggcgacatgaacgcggacaagacggagtgcgcggaccagctggtgggcctggcgccgtgcctgcagtacgtgcaggggcaggcccgcgcgccgccgcccgactgctgcggcggcctgcgccaggtgctggggaagagccccaagtgcctgtgcgtgctcgtcaaggacaaggacgaccccaacctgggcatcaagatcaacgccaccctcgcgctcgcgctccccaacgcctgcggcgccacccgcgccaacgtctcccactgcgctcagctcctgcatattcccccgggctccaaagacgccgccgtcttcagtcccggcagcgacaagggctccactgccgctccagccaaggacaactcgacggcgacgaccgactcccgcgcgctgcaggcgaccaccggacgcggcgtctcctcctcggcggcgaccgccggtgctgcactcgcggtgctgctcgccggctacctcctctgctcgtgccagaactgtcccctagctcgttctagaccctctgtcaagttgtgccacagttagattggaagtggtggttgtcctttccagaaccggacgtgacaaaaatattggcggcgggggcccttgttgttgtaaaaaatgccccggggggttccctgttatgccatgggtacaaaaagtttagggcttgggtttaacctaaccaaagggcaatgt

SEQ ID NO: 73622 - protein, 201 aa, Zea mays
  misc_feature: Ceres CLONE 1558004
  misc_feature (33)..(111): Pfam Name: Tryp_alpha_amyl Pfam Description: Protease inhibitor/seed storage/LTP family
MARWAAVLALAAATAIAVASVAGGDMNADKTECADQLVGLAPCLQYVQGQARAPPPDCCGGLRQVLGKSPKCLCVLVKDKDDPNLGIKINATLALALPNACGATRANVSHCAQLLHIPPGSKDAAVFSPGSDKGSTAAPAKDNSTATTDSRALQATTGRGVSSSAATAGAALAVLLAGYLLCSCQNCPLARSRPSVKLCHS

SEQ ID NO: 73623 - DNA, 961 bp, Zea mays
  misc_feature: Ceres CLONE 1558005
  misc_feature: Encodes the peptide sequence at SEQ ID NO. 73624
ctggagctccccgcggtggcggccgctctagaactagtggatcccccgggctgcaggaattcgtctcacccctagaaaaagtgatcgaaccagactcgagagggagaggaggagggagtccgaggggagagacccaattaactgcagggattggtcgggttcggctccgccttcggagagtcccaagagatgggtggcgcggcggcgggtaccaagtggatccaccacatccagcgcctcagcgcggccaaggtgtcggcggaggcggtggagcggggccagagccgcgtcatcgacgcctccctcaccctaattcgcgagcgcgcaaagctcaaggcagagttgctgcgtgctctgggtggcgtgaaagcttcagcgtcgctcttaggggtccctcttggtcacaactcatcctttttacaaggccctgcatttgctcctccacgcataagagaggccatttggtgtggaagcacaaactctagcacagaggaaggcaaagaattgaatgatcctcgggtgttaactgatgttggagatgtccccattcaagagatccgtgactgtggtgtcgaagatgacagattaatgcatgttattagtgagtctgtccaaacagtgatgggagaaggacctcttccaccgttggtgttaggaggcgatcactcaatatcttatccaggggttagagcggggtcagaaaacatgggggacccggtgaacaacctcacgtgaggcccacccaaaaaccatgcatggtttgaagagaaccctttttccggggcccgggaatggccaatataagggaaggggcgttctcgggaaccagcctagcgggctgcgaacccccccgagcagggtttattattggccagcctgtcgcccaaaatcttccagcggcactcttttacgcacgagggcaatgtgacgtgatgcccggatgtctgttttcctgtttttt

SEQ ID NO: 73624 - protein, 181 aa, Zea mays
  misc_feature: Ceres CLONE 1558005
  misc_feature (59)..(182): Pfam Name: Arginase Pfam Description: Arginase family
  misc_feature: SWISSPROT Homolog: EC 3.5.3.1 Arginase
MGGAAAGTKWIHHIQRLSAAKVSAEAVERGQSRVIDASLTLIRERAKLKAELLRALGGVKASASLLGVPLGHNSSFLQGPAFAPPRIREAIWCGSTNSSTEEGKELNDPRVLTDVGDVPIQEIRDCGVEDDRLMHVISESVQTVMGEGPLPPLVLGGDHSISYPGVRAGSENMGDPVNNLT

SEQ ID NO: 73625 - DNA, 1032 bp, Zea mays
  misc_feature: Ceres CLONE 1558006
  misc_feature: Encodes the peptide sequence at SEQ ID NO. 73626
  misc_feature (356)..(356): n is a, c, t, g, unknown, or other
  misc_feature (370)..(370): n is a, c, t, g, unknown, or other
  misc_feature (371)..(371): n is a, c, t, g, unknown, or other
  misc_feature (378)..(378): n is a, c, t, g, unknown, or other
  misc_feature (379)..(379): n is a, c, t, g, unknown, or other
  misc_feature (385)..(385): n is a, c, t, g, unknown, or other
  misc_feature (387)..(387): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (998)..(998): n is a, c, t, g, unknown, or other
  misc_feature (999)..(999): n is a, c, t, g, unknown, or other
ctccccgcggtggcggccgctctagaactagtggatcccccgggctgcaggaattcgtctcacccctagaaaaaatccaaccagaacccagcgcatcatcgcagcagcggcggcaactcgtcggagcaagcaaagctagcaccttccttctccttcgcacgacaagctcgatcgaccgacatggccgagaggacgaacgcgatggcggcgccacggccgctcctgcgccggatgctctcgttccgggagccgctcctggtcatcccgtacttgctcagcttcctgggcgccgcggcctcggcgctggcgcgcagccactcgtcgctgctgcactcgctcgccaaggcgctgttccnggccgcgccctgcnngcgcaanngctagnangnnngcgcgcccgccgttgcccgttgccgcgcgccgcccccggacggggaggaccccgcgctgaccagggcgaaggggaagccatcatgggccacattggccctcccggcggccgggaaaagcaggggccctcccgggcccccataagcccgcaaagaagggtcccggctcttttaaccccaaaaaacccaattttcccaaaaaggggggggggccttttggctttttttaaacccccacccgaaaaggtttttttgggggccaaagaaactttagggggcccccttgggccggctctcgcttaagggaagaaccccccccccgggcgccccccccttgttttcttcgccgccgggggggggcgggggaacccccgaaaaaaccttcttccccttttgggggggccccaaaaaaagggcggtgttagaaacaccaggggggggaaaaaaaacccccccccctttttttttttctcctccccccccccccggnnnnccccccgggggggggggggggaaaaaaaaaaacacccccccctaaaaaggtgttctcccgggggggctggtgtgttctcccccccccggtgtgggggggggggggccccccccccnncacccccccccctccccacaaaaaaggaatttg

SEQ ID NO: 73626 - protein, 65 aa, Zea mays
  misc_feature: Ceres CLONE 1558006
  misc_feature (59)..(59): Xaa is any aa, unknown, or other
  misc_feature (64)..(64): Xaa is any aa, unknown, or other
MAERTNAMAAPRPLLRRMLSFREPLLVIPYLLSFLGAAASALARSHSSLLHSLAKALFXAAPCXR

SEQ ID NO: 73627 - DNA, 926 bp, Zea mays
  misc_feature: Ceres CLONE 1558007
  misc_feature: Encodes the peptide sequence at SEQ ID NO. 73628
ggagctccccgcggtggcggccgctctagaactagtggatcccccgggctgcaggaattcgtctcacccctagaaaaagtcgccagcccactccttgcacagttgcacttgccaccgtatcgaccaacaactggtacgtacgagcgaccttggctagcaacaaccgggagaggagaggagaggagggatggttcgctcttccgctgccacggaggtgggccaggtgccggacgggaggccgctgccggctcccgtggccaccggcggcggcggcggtaccggcactggaggcgggcgggagccggaggggctgccgtgcccgcgctgcgagtccgccaacaccaagttctgctactacaacaactacaacctgtcccagccgcgctacttctgccgggcctgccgccgctactggacgcggcggggggcgcgctccgacacgtacccgtcggcggcggcacacgcaaaggcacacgcgcccgccgcctctagcgcgccaggcctggtcccgaaccggcaaggcgctaccgggggggcttgctgcgcctccaagtgcctagcgcgcctcctaggctctcttatcccagccttctccggaggggcctgggcttcctttgcccgcgttccctgggccggaaccgctacggcctccgttgaacccccaaagaccctgttgggtgggacctggcgcgcggctcctgcgttcgggggtggaacgccccccgggggggcaggtccttggtcctcctctgtcgggggggggcccgggtagggcggcctaagcccgtgcttggtcttttagggttcccccgcgaaacgggtgtgtctgaaacctaccagggggcgagaaaagcgctcccctcactttttttgtacttcccgggggctccttttttgacccgagacgcccgggggggacgtataca

SEQ ID NO: 73628 - protein, 194 aa, Zea mays
  misc_feature: Ceres CLONE 1558007
  misc_feature (37)..(99): Pfam Name: zf-Dof Pfam Description: Dof domain, zinc finger
MVRSSAATEVGQVPDGRPLPAPVATGGGGGTGTGGGREPEGLPCPRCESANTKFCYYNNYNLSQPRYFCRACRRYWTRRGARSDTYPSAAAHAKAHAPAASSAPGLVPNRQGATGGACCASKCLARLLGSLIPAFSGGAWASFARVPWAGTATASVEPPKTLLGGTWRAAPAFGGGTPPGGAGPWSSSVGGGPG

SEQ ID NO: 73629 - DNA, 902 bp, Zea mays
  misc_feature: Ceres CLONE 1558008
  misc_feature: Encodes the peptide sequence at SEQ ID NO. 73630
ctggagctccccgcggtggcggccgctctagaactagtggatcccccgggctgcaggaattcgtctcacccctagaaaaacccagccgtcatcgtttcgcgtccgcctcagcccgccgcaaggggaggtaagttcatgagacaccttcgagaagctgaaatggctcctaaagctgctcctgccaagaagggtgatgccaagacccaggccttgaaggttgccaaggctgtgaagtctggggcagccaagaagaccaagaagatccgcacatctgtgacatttcaccgccccacgaccctgaagaaggctagggaccccaagtacccacgaatcagcactaccggaaggaacaagcttgatcagtaccaaattctcaagtacccccttaccacagaatcagcgatgaagaagattgaagataacaacactctggtcttcattgttgacctcaaggcagacaagaagaagatcaaggctgccgtcaagaagatgtatgacatccaggcaaagaaagtcaacaccttgatcaggcctgatgggaagaagaaggcttacgtgaagctgactcccgactatgatgctcttgatgtggccaacaaaattggcatcatctaagtgctgcattaggcatctgttgtttcctagttcatctgttgtgtcctagttctatgtgaaaccagagttttgtagctatggctctcaatcgttccattaccatgtgttatgcacacttctgaatttgatatcatccaagtgaccggttgaaactagtttgcgttctgcacttcattacacttggacaccgtcagtctttgtgacccagtatttttgttggtccgtaatgggttgggtttgcactcgaccaataagctgttttgagtattaacggggttggtgtattc

SEQ ID NO: 73630 - protein, 151 aa, Zea mays
  misc_feature: Ceres CLONE 1558008
  misc_feature (69)..(148): Pfam Name: Ribosomal_L23 Pfam Description: Ribosomal protein L23
  misc_feature (11)..(63): Pfam Name: Ribosomal_L23eN Pfam Description: Ribosomal protein L23, N-terminal domain
MAPKAAPAKKGDAKTQALKVAKAVKSGAAKKTKKIRTSVTFHRPTTLKKARDPKYPRISTTGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 73631 - DNA, 933 bp, Zea mays
  misc_feature: Ceres CLONE 1558010
  misc_feature: Encodes the peptide sequence at SEQ ID NO. 73632
ctccccgcggtggcggccgctctagaactagtggatcccccgggctgcaggaattcgtctcacccctagaaaaaatctcctcctcctcctccaatccaattcacaaacacacacgggcaatcaattagcagaacccgcgccacccccccttcctcggagtcggagcgagtcgaggaacggctcgtctgcctctcccgttctccttcctctcctccccagaagatctgatccatcatcgaggactcgccgggaagaatcaaggatatatagataataaacaaacaaaggttcctccagagcccagaggagggaagtcaccggccgtcggcggggaggagatgtcggacggcgcgggctcccggacgggcgtcgctggcgcgctgggcctctcggtcacctcgtcggtggccatcgtcatctgcaacaagtacctcatcagcactctaggcttcttctttgcgacgacgctgacgagctggcacctcatggtgaccttcttcacgctgtacgttgcgcagcggctgcgcttcttcgagccaaagccgatcgacgcgcggaccgtcatctccttcggcctgctcaacggcatctccattggcctcctcaacctctgcctcgggttcaactctgttggcttctaccagatgaccaagctggccatcatacccttcaccatagtcttgggaaccctctttctgagcaagaagttcagccagagcatcaaggcctccctcatggttctgctcttgggagtcgggatcgcgtcggtcacggatctccagctcaaccctctcggctcgatcatcgccgtgctcaccatcgctgcgacatgcgtcgggcaggatctgaccatccaatccagaggaggctgaaggttcgtcgacgcagctgctgtacagtcgtcgccgtacagtccgcggtgctgctcgtacc

SEQ ID NO: 73632 - protein, 177 aa, Zea mays
  misc_feature: Ceres CLONE 1558010
MSDGAGSRTGVAGALGLSVTSSVAIVICNKYLISTLGFFFATTLTSWHLMVTFFTLYVAQRLRFFEPKPIDARTVISFGLLNGISIGLLNLCLGFNSVGFYQMTKLAIIPFTIVLGTLFLSKKFSQSIKASLMVLLLGVGIASVTDLQLNPLGSIIAVLTIAATCVGQDLTIQSRGG

SEQ ID NO: 73633 - DNA, 959 bp, Zea mays
  misc_feature: Ceres CLONE 1558015
  misc_feature: Translation starting site: 156
  misc_feature: SWISSPROT Homolog: EC 1.14.11.15 Gibberellin 3-beta-dioxygenase
  misc_feature: SWISSPROT Homolog: EC 1.14.11.20 Desacetoxyvindoline 4-hydroxylase
  misc_feature (831)..(831): n is a, c, t, g, unknown, or other
ctccccgcggtggcggccgctctagaactagtggatcccccgggctgcaggaattcgtctcacccctagaaaaaacactcgcagctcgcacatctcatggtgtcctaagaacggcaagagccagctctgcctagcagcagcgcacagccacgtccatggacgccagcccgaccccaccgctccccctccgcgccccaactcccagcattgacctccccgctggcaaggacagggccgacgcggcggccagcaaggccgcggccgtgttcgacctgcgccgggagcccaagatcccggagccattcctgtggccgcacgaagaggcgcggccgacctcggccgcggagctggaggtgccggtggtggacgtgagcgtgctgcgcaatggcgacggcgcggggctccgccgcgccgcggcgcaggtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctgtccttcggcttccacgacggcgccgcggcgcccgtcgtcgtggactacttcaccggcaccctcggccaagatttcgagccagtggggcgggtgtaccagaagtactgcgaggagatgaaggagctgtcgctgacgatcatggagctgctggagctgagcctgggcgtgtagcgcggctactaccgggagttcntcgaggacagcgcctcatcatgcggtgaactactaacccgcgtgccccgtggcggaacgcacccttgggacaggcccccactgggaccccacggggctgacaatcctcctgcaagacgacgtcggggg

SEQ ID NO: 73634 - DNA, 952 bp, Zea mays
  misc_feature: Ceres CLONE 1558016
  misc_feature: Encodes the peptide sequence at SEQ ID NO. 73635
agctccccgcggtggcggccgctctagaactagtggatcccccgggctgcaggaattcgtctcacccctagaaaaactctcctcccctccccttccctaatcatctcagcgaatccaatcgaggcgatggaccagcagggtgcgggcggggacgcggaggtgccggcggggctgggtctgacggcggcggagtacgagcagctgcggtcgacggtggacgcgcaccaccgctacgccgtgggggagggtcaatgctcctcgctgctggcgcagcgcatccacgcgccgccggaggccgtctgggccgtcgtccgccgcttcgactgcccgcaggtgtacaagcacttcatccggagctgcgcgctccgcccagaccccgaagccggcgacgccctctgccccggccgcctccgcgaggtcagcgtcatctcgggcctgcccgctagcaccagcaccgagcgcctcgacctactcgacgacgccgctagggtcttcggcttctccatcaccggaggcgagcaccgccttcggaactaccgctccgtcaccaccgtctccgagctcgcagaccccgcgatctgcaccgtcgtgctcgagtcctacgtcgttgacgtccccgacgggcacaacgaggacgacacccgcctcttcgccgaccccgtcatcaggctcaacctccgaagctcaagtccgtcgccgaggccatcgccgcgaagccgccgaaaccacaatttcgtctttttgccccggcgggggaatacggcggctgccctccgaagggaagaaagaaccccaagtttggggggttccggttttcattccccgggaaaagggtccccgaaataaaacggaccgggagggatttggccggaacaggggggcccgggcccccaattttggtgtattaaaggcgcccccttttaaaactccttttctcccaaaatctctgttt

SEQ ID NO: 73635 - protein, 239 aa, Zea mays
  misc_feature: Ceres CLONE 1558016
MDQQGAGGDAEVPAGLGLTAAEYEQLRSTVDAHHRYAVGEGQCSSLLAQRIHAPPEAVWAVVRRFDCPQVYKHFIRSCALRPDPEAGDALCPGRLREVSVISGLPASTSTERLDLLDDAARVFGFSITGGEHRLRNYRSVTTVSELADPAICTVVLESYVVDVPDGHNEDDTRLFADPVIRLNLRSSSPSPRPSPRSRRNHNFVFLPRRGNTAAALRREERTPSLGGSGFHSPGKGSPK

SEQ ID NO: 73636 - DNA, 944 bp, Zea mays
  misc_feature: Ceres CLONE 1558018
  misc_feature: Encodes the peptide sequence at SEQ ID NO. 73637
  misc_feature (678)..(678): n is a, c, t, g, unknown, or other
  misc_feature (783)..(783): n is a, c, t, g, unknown, or other
  misc_feature (799)..(799): n is a, c, t, g, unknown, or other
tccccgcggtggcggccgctctagaactagtggatcccccgggctgcaggaattcgtctcacccctagaaaaagagccttccgcgcgacgctgcacggctccgccagccacccgtaaaaccctagacggctagccggcgcacggaagcgggcagcggagcggaggtgagcctctcctgcatcggattgtccccgcccccgctaggcgccatgaagctgacggtgaagaccctcaagggaacgcacttcgagatccgggtgcagcccaacgacacgattatggctgtgaagaagaatatagaagagatacaagggaaagacagctatccatggggccaacaactgctgattttcaatggaaaggtcttgaaagatgaaagtacattggaagagaataaagtcaatgaggatgggtttctagttgtcatgcttagtaagggtaaaacatctggttcaactggaacttcatcttcccagcactcaaacactcctgcaacaaggcaggcacctcctctagaggccccacaacaagctcctcaacccccggtggcaccaattacaacttctcagcctgaaggacttcctgcacaggcacctaacacacatgacaatgcggcatcaaatcttctgtctggaaggaatgttgacacaataattaaccagctaatggagatgggtngggggcagttgggacaaagataaagtccaaagggctctccgtgccgcttacaacaccccgaacgtgctgttgaatacctctactctggtattccagtaacagctngaatttgctgtcccanttggtggtcaaggggcaaacacaactgatcgagctcctactggggaagctggtctctctgggatcccaacaccgctccactagatttttccgcaaggggctccaatgctgaaggtggtgctggtgggggaccactgatttcttaa

SEQ ID NO: 73637 - protein, 163 aa, Zea mays
  misc_feature: Ceres CLONE 1558018
  misc_feature (6)..(78): Pfam Name: ubiquitin Pfam Description: Ubiquitin family
  misc_feature (157)..(157): Xaa is any aa, unknown, or other
MKLTVKTLKGTHFEIRVQPNDTIMAVKKNIEEIQGKDSYPWGQQLLIFNGKVLKDESTLEENKVNEDGFLVVMLSKGKTSGSTGTSSSQHSNTPATRQAPPLEAPQQAPQPPVAPITTSQPEGLPAQAPNTHDNAASNLLSGRNVDTIINQLMEMGXGQLGQR

SEQ ID NO: 73638 - DNA, 1163 bp, Zea mays
  misc_feature: Ceres CLONE 1558019
  misc_feature: Encodes the peptide sequence at SEQ ID NO. 73639
actcctccttcttcctcccttttgcatttgtgctacctgccctgccctgccccgcgccgccgccgccgccgccgccaacccgccattacctgtgccatgccaccgcgaaaacgcccgccgtcgccgccggaggagccctcccttgcctcgaagcctcgacctgacgcgcagccgtccaaacccgaccccgattccgagcagtcgaccatcaacccgaggatcctcgcccaactccccaaccaggagcgcctggtgtacaagctcatcttcgaggcgggcaacaagggcatgtggatgctggacatccgcaagaagctgctgatggcccccaacgtcgccaccaaggtcgtgcgcaccctcgtggcaagcgggctcctcaaagaggtcagcgacgtgcgccaccgcagcaggaagatcttcatggccaccgacttccagccctccgccgagatcaccgggggcacctggtaccacgacggccgcctggacaccgacgccgtaaccaccgcgcgccgctgctgccaggcgcaggtccagaggctcggcgccgcgaccgcgcagatgatccaccaaggcattctcaaggaagaccccagggccgggtacactatcgacaaggtcagggatatcatcaagaccatggtgctcgacaaggtgctcgaggaggtcaagagcaccggcgcgggggattttagcgccgtcagggccggcacaatgtgctaccggctggtcactggggctccgcagggagggatgatggagggaatcccttgtggggtttgccccaggattcatgagtgctcgccggaggggatcatctcacccagcacctgcgtttactacaagaagtggctgcagatggacttctaggcggtgacggtgagccctcttctgtccgtcacgatgggggtgttggagtccattggagaatttagtttcatattgaccagtcgggacctctgaattctgaaaggttaggtataacaacagttcagttttagattgtgatactcatattaataatcatctctatagttatttctacttattagtccttttagcttggtataatcattcatatgtatttatttcatcaagtttggatgtctttactcagtaccatatcaacttcctaaaaaaaaaaacaaaaaaaaaaaaaaaaa

SEQ ID NO: 73639 - protein, 257 aa, Zea mays
  misc_feature: Ceres CLONE 1558019
  misc_feature (1)..(254): Pfam Name: RNA_pol_Rpc34 Pfam Description: RNA polymerase Rpc34 subunit
MPPRKRPPSPPEEPSLASKPRPDAQPSKPDPDSEQSTINPRILAQLPNQERLVYKLIFEAGNKGMWMLDIRKKLLMAPNVATKVVRTLVASGLLKEVSDVRHRSRKIFMATDFQPSAEITGGTWYHDGRLDTDAVTTARRCCQAQVQRLGAATAQMIHQGILKEDPRAGYTIDKVRDIIKTMVLDKVLEEVKSTGAGDFSAVRAGTMCYRLVTGAPQGGMMEGIPCGVCPRIHECSPEGIISPSTCVYYKKWLQMDF

SEQ ID NO: 73640 - DNA, 789 bp, Zea mays
  misc_feature: Ceres CLONE 1558022
  misc_feature: Encodes the peptide sequence at SEQ ID NO. 73641
  misc_feature (356)..(356): n is a, c, t, g, unknown, or other
  misc_feature (384)..(384): n is a, c, t, g, unknown, or other
acccgcggtggcggccgctctagaactagtggatcccccgggctgcaggaattcgtctcacccctagaaaaaaccgaatcgagtcagatcctgtccgaatccgagctaagggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggatgaaactgctgaggaaaagggatgttcctgatgagaagtacaccaatgccttccttggctttgggccagagaacaccaactttgcagttgaattgacatacnaactatggcgttgacaagtatgacattnggaacggggctttggggcatttccgcaattgctaatgatgatgtgtaccagtagctgaaatatcaaatccaaggtggtagatcacccccaaccctgtcctgcaaggaaagatccatgttattgccttccccaggacccgaagggacctgtttagcttttccaaaggggtaaacccctggccctttttcaagtaatgtctttgggtgggacccttgacggtttctcaatttttttaaaagcccccggagtaaaccccccaaggaaaaagaggtcccctaaaaaaaaacaccctccccttggggggcttctcaaaaaaaaaaaaaaaaattggtgggggggcgggccaacctgtggggggcccaaaaaaaaacagggggggggagtttttttccgggggggccttgt

SEQ ID NO: 73641 - protein, 85 aa, Zea mays
  misc_feature: Ceres CLONE 1558022
  misc_feature: SWISSPROT Homolog: EC 4.4.1.5 Lactoylglutathione lyase
  misc_feature (82)..(82): Xaa is any aa, unknown, or other
MATGSEASKAAEAVVDWHKHDSKRMLHAVYRVGDLDRTIKYYTECFGMKLLRKRDVPDEKYTNAFLGFGPENTNFAVELTYXLWR

SEQ ID NO: 73642 - DNA, 971 bp, Zea mays
  misc_feature: Ceres CLONE 1558023
  misc_feature: Encodes the peptide sequence at SEQ ID NO. 73643
  misc_feature (918)..(918): n is a, c, t, g, unknown, or other
  misc_feature (951)..(951): n is a, c, t, g, unknown, or other
tggagctccccgcggtggcggccgctctagaactagtggatcccccgggctgcaggaattcgtctcacccctagaaaaagacacacacacacacataacagcgagcagcacagctcacgctcggctacgactacgactacgatccgcgcgcgtcgatggcgatgagtgacaccggctcgagcttcgcgcagtgggccgcgctctaccaccaccacgaccccgccggcggcccggtcctgcccgacgacgacgctggcatcggcagcggcagcggcaccgccaccgccgcgagcccgacgtcgggagggtccagcggcgggagccccaccaccaaggcagcgtgggggcagcagcatctgcttcacggggtggaggggccccgggtcgccgggaagccggcggcggcgcggcggctgtcccgcgcgtcgcggcgggcgcccgtgacgctgctcaacacggacgccgccaacttccgcgccatggtgcagcagttcacgggcgtccccgcgcccctcgccggcgcgttcatggtcggggacggggccccggtcatcagcttcgccgccgactacgggttcccgcccgcttcttcttcctcggccgtcaacgtgtccttcttcgaccaccagctccaccggagcgaactacagcctgcagcgccgccggtccacgaggagcatgatcagtccgccggccgcgtcgccgttcggcggctacagaagcggccctggtgctagtcggcgagcgaagcgaattcttccccgcgtcggctgaaggacagatgctcctgcagagcatgctgccctcccaaatgcggaaatggcgccggtgtcccggggcttacacaagggccacagggactcttgcgttgataattaggggcggacagggttctaccacgagcgtcaccatggccgnatgcccattgatggaacaaaaaaaagggggggnattagttttaaccaactttt

SEQ ID NO: 73643 - protein, 193 aa, Zea mays
  misc_feature: Ceres CLONE 1558023
  misc_feature (92)..(122): Pfam Name: VQ Pfam Description: VQ motif
MAMSDTGSSFAQWAALYHHHDPAGGPVLPDDDAGIGSGSGTATAASPTSGGSSGGSPTTKAAWGQQHLLHGVEGPRVAGKPAAARRLSRASRRAPVTLLNTDAANFRAMVQQFTGVPAPLAGAFMVGDGAPVISFAADYGFPPASSSSAVNVSFFDHQLHRSELQPAAPPVHEEHDQSAGRVAVRRLQKRPWC

SEQ ID NO: 73644 - DNA, 942 bp, Zea mays
  misc_feature: Ceres CLONE 1558024
  misc_feature: Translation starting site: 166
ctccccgcggtggcggccgctctagaactagtggatcccccgggctgcaggaattcgtctcacccctagaaaaaattatcacggcggcggtggcggagcggaaggcgaaggagtagcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaagttcaagcctttgcaaggttaggtctgttcagtttgggcagaagggcatcccgtacctgaacacgtatgacggccgcaccatccgctaccctgacccgctcatcaaggccaacgacaccatcaagatcgatctggagaccaacaaaattgtggacttcatcaagtttgatgttggcaacgttgtcatggtgactggcggagggacactggcccgtgtgggtgttatcaagaacagggagaagcacagggcagctttgagacattcacgtggaggactcctggcgcacagttcgccaccggtatgggcaacgtgtcaccatcgcaaggggtaatagcccgtggtgagcctgccagggccaaggaatcagctgacctcttagagaccaaagaagcggatgcgctgccaaggtgctccaac

SEQ ID NO: 73645 - DNA, 955 bp, Zea mays
  misc_feature: Ceres CLONE 1558027
  misc_feature: Encodes the peptide sequence at SEQ ID NO. 73646
  misc_feature (852)..(852): n is a, c, t, g, unknown, or other
  misc_feature (854)..(854): n is a, c, t, g, unknown, or other
ggtgctccccgcggtggcggccgctctagaactagtggatcccccgggctgcaggaattcgtctcacccctagaaaaactacaactgctggaacaagttcgtgggcgaccacacgacgcaggcgttcgtgttcaccgacaaggcagaggacgcgagcgtggtggtggtgtcgttccggggcacggagcccttcaacatgcgggactggtccacggacgtaaacctgtcgtggctgggcatgggcgagctgggccacgtccacgtctgcttcctcaaggcgctgggcctgcaggaggaggacggcaaggacgcctcgcgggcgttccccaaggccgcccccaacgccgtcccgggcaagccgctggcctactacgcgctgcgcgaggaggtccagaagcagctgcagaagcacccgaacgccaacgtcgtggtcaccggccacagcctcggcgccgcgctggcgaccatcttcccggcgctgctggcgttccacggggagcggggcgtcctggaccgcctgctctccgtggtcacctacgggcagccgcgcgtgggcgacaaggtgttcgcgggctacgtgcgcgccaacgtgcccgtggagccgcttccgggtggtgtaccgctacgtagtgggtcccgcgcgtgcccttcgacgcgccgcccgtcgccgacttcgcgcacggcggcacctgcgtctacttcgacggctggtacaagggccgcgagattcgcaaggggcggcgaccgcccaacagaactcttcgtacccaggtacttgctgtcatgttacggaacgccgggggggacctcttccatgggcgctttctgtgggcaagggaggcatgactcccngntaggggccgtctgcttgtctaacggccaccgggctgtcggtggccggattccttccaaaggcccggggattatttaacccttcccctcgaaggggccccct

SEQ ID NO: 73646 - protein, 244 aa, Zea mays
  misc_feature: Ceres CLONE 1558027
  misc_feature (2)..(137): Pfam Name: Lipase_3 Pfam Description: Lipase (class 3)
  misc_feature: SWISSPROT Homolog: EC 3.1.1.3 Triacylglycerol lipase
  misc_feature (219)..(219): Xaa is any aa, unknown, or other
  misc_feature (220)..(220): Xaa is any aa, unknown, or other
MRDWSTDVNLSWLGMGELGHVHVCFLKALGLQEEDGKDASRAFPKAAPNAVPGKPLAYYALREEVQKQLQKHPNANVVVTGHSLGAALATIFPALLAFHGERGVLDRLLSVVTYGQPRVGDKVFAGYVRANVPVEPLPGGVPLRSGSRACPSTRRPSPTSRTAAPASTSTAGTRAARFARGGDRPTELFVPRYLLSCYGTPGGTSSMGAFCGQGRHDSXXGAVCLSNGHRAVGGRIPSKGPGII

SEQ ID NO: 73647 - DNA, 945 bp, Zea mays
  misc_feature: Ceres CLONE 1558028
  misc_feature: Encodes the peptide sequence at SEQ ID NO. 73648
  misc_feature (794)..(794): n is a, c, t, g, unknown, or other
ccccgcggtggcggccgctctagaactagtggatcccccgggctgcaggaattcgtctcacccctagaaaaaagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgaaggctaccgcattgccggcgggccgctcggcgaggtcgtcgacccgctgtaccctggcggcagcttcgaccccctcggcctggccgacgaccccgaggccttcgccgagctcaaagtgaaggagctcaagaacggccgccctcgcatgttttccatgttcggcttcnttcgtcagggcatcgtcaccgggcagggcccgctcgagaaactcgctgaccacatcgctgacccagtcaacactacgcatgggccctacgcacctacttcgtccccggcaactagctcaacggctatgctatgcacttcaatgtctttcgt

SEQ ID NO: 73648 - protein, 274 aa, Zea mays
  misc_feature: Ceres CLONE 1558028
  misc_feature (61)..(229): Pfam Name: Chloroa_b-bind Pfam Description: Chlorophyll A-B binding protein
  misc_feature (225)..(225): Xaa is any aa, unknown, or other
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGGPLGEVVDPLYPGGSFDPLGLADDPEAFAELKVKELKNGRPRMFSMFGFXRQGIVTGQGPLEKLADHIADPVNTTHGPYAPTSSPATSSTAMLCTSMSF

SEQ ID NO: 73649 - DNA, 939 bp, Zea mays
  misc_feature: Ceres CLONE 1558029
  misc_feature: Encodes the peptide sequence at SEQ ID NO. 73650
  misc_feature (780)..(780): n is a, c, t, g, unknown, or other
  misc_feature (782)..(782): n is a, c, t, g, unknown, or other
  misc_feature (783)..(783): n is a, c, t, g, unknown, or other
ctggagctccccgcggtggcggccgctctagaactagtggatcccccgggctgcaggaattcgtctcacccctagaaaaaaagtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggcgcccagcgaccccgccgccgccgcggccatggtggaccgcatgctccgcctgctcgcctcctacgacgtcgtccggtgccagatggaggaccgggacggccggtacgagccgcgctacttccgcgcgcccgtctgcaagtggctcacccccaccgaggacggggtgtccattgggcgccctcgcgctcatgaacaaggacaaggcctcatggagagctgggactacctcaaggaaccggggctgggaaggggcatcccgttcaaaaagggctaacggaatacggggttcaaattccagggaaggaacgcgctttaaaccggggttcaacgggggttgaaaaacccctggtgaaacccccaaaaaatcggggggctttaacgggtttaaggggtttcaaccggggaaaatttggggncnngtttttttcccccccttgtacacatattttccccccccccgaaatttttggggggaatatttcaccgccccctttttcttagggggccctttccccgcgggggccccaggggggggggaatttttttttttgccccccggggaacatcttttttat

SEQ ID NO: 73650 - protein, 158 aa, Zea mays
  misc_feature: Ceres CLONE 1558029
  misc_feature (31)..(87): Pfam Name: Dimerisation Pfam Description: Dimerisation domain
  misc_feature: SWISSPROT Homolog: EC 2.1.1.68 Caffeate O-methyltransferase
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYEPRYFRAPVCKWLTPTEDGVSIGRPRAHEQGQGLMESWDYLKEPGLGRGIPFKKG

SEQ ID NO: 73651 - DNA, 948 bp, Zea mays
  misc_feature: Ceres CLONE 1558030
  misc_feature: Translation starting site: 281
  misc_feature: SWISSPROT Homolog: EC 6.3.2.19 Ubiquitin--protein ligase
ctccccgcggtggcggccgctctagaactagtggatcccccgggctgcaggaattcgtctcacccctagaaaaaaccagagtaccagtcaacagccaccgtttcgatcttcgccacaccgctcggcgctcgcctccgcctgattcccatctttcccgagctccacacctcacgtctataaataaggcgcccgcggtgcccatcaattcgcgtcaccgcgtcccgagagcgcgattcattccgcgcgacgcaaaaccctagcccatccaccgatccttgtcatggcggccaccaccagccaggcgagcctcctcctgcagaagcagctcagagatctcgccaagcacccggtggatgggttctcggctgggctggtcgacgatagtaacgtattcgagtggcaggtcaccatcatcggcccgcccgataccctatatgatggagggtacttcaatgcaataatgagcttcccagaaaattacccaaacagcccgccatcagtcagatttacctctgaaatgtggcatccaaatgtttattcagatgaggctggtgtgtatctctattcttcatccacctggtgaagatccaagtggttatgagctcgcaagtgagcgttggacacctgtgcatacagttgaaagcatagttctgagcattatatcaatgctctctagtccaaatgacgagtctgcagcaaacattgaggcagctaaggaatggagggaaaaggagggtagaatttcagaaaagggtcaggcgcatcgtgcggaatcacagggaattgtttgaagaaaatggaatactggggaaagtcacgtgccatgtcaagctaccaaattttgctttcaactcaaatgctcatctgaaatcctgtgtattttccatttagcgtctggtcatggtgcacaaaaatgatttggacccgtgggttacgtgtggcctgggc

SEQ ID NO: 73652 - DNA, 983 bp, Zea mays
  misc_feature: Ceres CLONE 1558031
  misc_feature: Encodes the peptide sequence at SEQ ID NO. 73653
  misc_feature (663)..(663): n is a, c, t, g, unknown, or other
  misc_feature (770)..(770): n is a, c, t, g, unknown, or other
  misc_feature (805)..(805): n is a, c, t, g, unknown, or other
ggagctccccgcggtggcggccgctctagaactagtggatcccccgggctgcaggaattcgtctcacccctagaaaaagtgacgacggcgacggcaacgactggggcgaccgtcgctgccgccctacttgccggttgctcggatcttcttcggcccgttagccgtcgacgagcaccaccagggcaaccagatacttcagtggcttcgcaaggatgtcctggtgcactattgagtctgatcctggtgtgttcactgagctgattcagcaaatgcaagtgaaaggtgtacaggtggaagagctttactctctcgatgtgggctctcttagtcaactgcggccagtatatgggctaatttttctcttcaagtggatacccggggagaaggatgaacggcctgttgtcagagatcctaacccaaaccttttctttgcgcaccaagtcatcactaatgcatgtgctactcaagctattctctcagttctcatgaatcgccctgaaattgacattggcccagaattatctcaattgaaggaattcacaggagcttttacaccagatctgaagggcttggctattagcaacagcgaatctatccggacagctcataacagctttgcaaggccagagccatttatttctgatgagcagagggccgcactanggatgatgatgtttaccatttcataagctatttacctttttgaaggtgtcctgtatgagctggatggactgaaaggagggcctgtgaatcttgggcagtgcgatggntgcgaatgatcttgattgggctacggatggtgcangccagtattcaagaaaggattgagcgctctcaccaaagcgagatcagggttcatctcatgccatcataaaaaacaggaaaaaaagggttcagggctggagctggaggaaaccggaaaaaaaaaggagccaattttgcagggaaatgaatatgcttcctccacagaaatctttgaagtt

SEQ ID NO: 73653 - protein, 158 aa, Zea mays
  misc_feature: Ceres CLONE 1558031
  misc_feature (2)..(159): Pfam Name: Peptidase_C12 Pfam Description: Ubiquitin carboxyl-terminal hydrolase, family 1
  misc_feature: SWISSPROT Homolog: EC 3.1.2.15 Ubiquitin thiolesterase
  misc_feature (151)..(151): Xaa is any aa, unknown, or other
MSWCTIESDPGVFTELIQQMQVKGVQVEELYSLDVGSLSQLRPVYGLIFLFKWIPGEKDERPVVRDPNPNLFFAHQVITNACATQAILSVLMNRPEIDIGPELSQLKEFTGAFTPDLKGLAISNSESIRTAHNSFARPEPFISDEQRAALXMMMFTIS

SEQ ID NO: 73654 - DNA, 868 bp, Zea mays
  misc_feature: Ceres CLONE 1558032
  misc_feature: Encodes the peptide sequence at SEQ ID NO. 73655
ctggagctccccgcggtggcggccgctctagaactagtggatcccccgggctgcaggaattcgtctcacccctagaaaaaaaaacacccacttcacctccgaccacttcacctccgatcccgccaccactacccaccctttcctttgacgtcccgatggcacctgtagatctaacccccaaacagcccaggaaggcctacggcggcgacggcggcgcctactacgagtggagccccgccgacctgcccatgctcggcgtcgcctccatcggcgcagccaagctctcgctcgccgccggcggtctcgcgctccccagctactctgactcagccaaggtcgcctacgtcctccaaggcacgggcacctgcggcatcgtcctcccagaggcgacgaaggagaaggtggtggccgtgaaggagggcgacgcgctggcgctgcccttcggcgtggtgacgtggtggcacaacggacccgccgcgccgaccccgctcacggtgctcttcctcggcgacacctccaagggccacaggccggggcagttcaccaacttccagctgacgggcgcgaccggcatcttcacgggcttctccaccgagttcgtgtcgcgcgcgtgggacctgccggaggcggacgcggcggcgctggtgtcgagccagccggcgtcggggatcgtccgggcgtcctcgtccccgctgccggcggcgtcgccgcgggaccgcgagggggtggcgatcaactgcctggaggcccgctggacgtggacctccctggcgggggccgcgtcgtggtgctaacacggccaaccggccgctggtcaggaagtcggggctggcgcccaactgggtcgcatcgacgcccacccttgtgt

SEQ ID NO: 73655 - protein, 212 aa, Zea mays
  misc_feature: Ceres CLONE 1558032
  misc_feature (6)..(161): Pfam Name: Cupin_1 Pfam Description: Cupin
MAPVDLTPKQPRKAYGGDGGAYYEWSPADLPMLGVASIGAAKLSLAAGGLALPSYSDSAKVAYVLQGTGTCGIVLPEATKEKVVAVKEGDALALPFGVVTWWHNGPAAPTPLTVLFLGDTSKGHRPGQFTNFQLTGATGIFTGFSTEFVSRAWDLPEADAAALVSSQPASGIVRASSSPLPAASPRDREGVAINCLEARWTWTSLAGAASWC

SEQ ID NO: 73656 - DNA, 968 bp, Zea mays
  misc_feature: Ceres CLONE 1558033
  misc_feature: Encodes the peptide sequence at SEQ ID NO. 73657
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (851)..(851): n is a, c, t, g, unknown, or other
  misc_feature (871)..(871): n is a, c, t, g, unknown, or other
  misc_feature (872)..(872): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (963)..(963): n is a, c, t, g, unknown, or other
  misc_feature (964)..(964): n is a, c, t, g, unknown, or other
ggagctccccgcggtggcggccgctctagaactagtggatcccccgggctgcaggaattcgtctcacccctagaaaaacccggagctgaattcggaaccccagcgcaagcggcgccgccagttcagcaagcaagccacatcagtccctacttggctcgtggcgctgagccacgcgtgcctgtgccgatcgatgggcaactgccaggcggcggaggcggaggccgtggtgatccagcaccccggcggcaaggtggagcggctgtacggggcggccaccgcagcggaggtcatgcgcggcaaccccgggcactacgtggcgctcgtggtgctccgcgtctcggcgggcggcggcaagcagggcgcggatccggacccctccgcgggcgcggtgtccgccggcgccggcgccggcaccaggatcaccaaggtgaagctcctgaagcccagggacgtgctgcttctggggcaggtctaccggctcatcacctcgcaagaggtggcgaaggcgatacagtgcgaggagggaggacaagatgcggcggtgcggggccggcgaggtgggttggtggtggacgaccagcggggtccgggacgacacgccgccgcggcgggcagccaagggcaggggcggtccagcgacgaccaggaagtgaacgtgccggagaagtcggaccggcagcaccggaccggcggtagagccagatggcggcactggcagccgtcgctgctgagcatctccgatgcggcgagctgacgcgacgcactgcagnnnnnnnnnggaaccnnngagggagggggggaacagttatagaatagaagcaggggactgcctgcttgggctaagagtgtancctggctgttggtgtctggnnggannnnnnnnnnnnnnnnnnnnnnnnnnnnnnnnnnnnnnnnnnnnnnnnnnnnnnnnnnnnnnnnnnnnnnnnnnnnnnngtnnnaccnnggct

SEQ ID NO: 73657 - protein, 187 aa, Zea mays
  misc_feature: Ceres CLONE 1558033
MGNCQAAEAEAVVIQHPGGKVERLYGAATAAEVMRGNPGHYVALVVLRVSAGGGKQGADPDPSAGAVSAGAGAGTRITKVKLLKPRDVLLLGQVYRLITSQEVAKAIQCEEGGQDAAVRGRRGGLVVDDQRGPGRHAAAAGSQGQGRSSDDQEVNVPEKSDRQHRTGGRARWRHWQPSLLSISDAAS

SEQ ID NO: 73658 - DNA, 945 bp, Zea mays
  misc_feature: Ceres CLONE 1558034
  misc_feature (781)..(781): n is a, c, t, g, unknown, or other
  misc_feature (904)..(904): n is a, c, t, g, unknown, or other
ggagctccccgcggtggcggccgctctagaactagtggatcccccgggctgcaggaattcgtctcacccctagaaaaacaatttgcatggtatgatggctctgcttatgcaaatggacagcaaagaacgaccacaactaatcgttttccatcctcgtcattcagtggtaatggttcatctgcaatatatcagaacaagagctccaccacgcagcagatgggtatgcagaatagaagacctacaactacatcagcagctcctacctatcccaataggatgtaccctagcccccgaccgtacacccagtatgggaattcagtaaaaactggtcttccctacgggagtaacggttatgattccaggatatatggtcgatgtggtcttggtaatggtatggataacaggtacaggcccagggcatgtagtggatactatggttatggcaatgagagtcaggatggaacaattgagttaaacagaggtcctagatctggccggttcaagaaccagaaattgtacggtcatactgtcactattgctgtgaaagggcagtctctcccttctagtgaaagcaagaatgatagtgctgtgcctgatagagcaaagtacaatagagatgacttccctgttcagtacgatgctgcaaagttctttgtcattaaatcgtacagcgaggatgacatccacaagagcgtaaagtacaatgtgtgggcaagcacaaccaacggaaacaagaagcttgatgctgcttaccaagaactcaggtcaagggatctgcatngcctatatttcttgtcttctcagtgaatacagtgggcaaatttgttggtgttgctgaaatgacgggcgccgttgattttaggaaaaccctagagtatgggcaacaggacaagtggaacggctnccctcctcgtgtaagtgccacaattggtcaagacctggccc

SEQ ID NO: 73659 - DNA, 946 bp, Zea mays
  misc_feature: Ceres CLONE 1558035
  misc_feature: Encodes the peptide sequence at SEQ ID NO. 73660
  misc_feature (825)..(825): n is a, c, t, g, unknown, or other
  misc_feature (938)..(938): n is a, c, t, g, unknown, or other
tggagctccccgcggtggcggccgctctagaactagtggatcccccgggctgcaggaattcgtctcacccctagaaaaagacgcgtctcttccacagccgcaacctctatccctcgtctggtatcgtctcccacacccctctgccccaactcagaaaaaccctcgaaaagcggcggcggcgcgacatggcggaggtcgaggctccagctgctgcggttgcggcggcaacccctgaggtggcgacggtgaccgagggcggagccgctacggaggcgaagggtccgcacaagctgcaccgccagtggaccttctggtacgacatccagtccaagcccaaacccggcgctgcgtggggcacctccctcaaaaaggcgtacaccttcgacaccgtcgaggagttttggggcttgtatgatcatgttttccgtccaagcaagttgcctgggactgctgattttcacctattcaaggctggagtagagccaaaatgggaagacccagagtgtgcaaatggtggcaaatggactgtcccatgcaacagaaagccaacctttgagaccatgtggcttgaaacgttgatggctcttgttggggagcagtttgatgaaacagatgacatttgtggaattgttgctagtgtccgtccaagaggagataagcttgcattgtggactaggactgccagcaatgaagctgtccaggtaaacattggcaagaaatggaaggatgtcatcgactacaatgactagatcatctacactttccatgacgactcgagaatggatagccaagcagatgtgacggtacaccgtgtaagtgcacacnaagaaggtcgttgttgttcgactgacagagggtgaaaaatggagtttttgtgctgagatcggcacagctttcatttatacaggctcagcttactgagggcattccgcacccgnttaggatg

SEQ ID NO: 73660 - protein, 187 aa, Zea mays
  misc_feature: Ceres CLONE 1558035
  misc_feature (6)..(188): Pfam Name: IF4E Pfam Description: Eukaryotic initiation factor 4E
MAEVEAPAAAVAAATPEVATVTEGGAATEAKGPHKLHRQWTFWYDIQSKPKPGAAWGTSLKKAYTFDTVEEFWGLYDHVFRPSKLPGTADFHLFKAGVEPKWEDPECANGGKWTVPCNRKPTFETMWLETLMALVGEQFDETDDICGIVASVRPRGDKLALWTRTASNEAVQVNIGKKWKDVIDYND

SEQ ID NO: 73661 - DNA, 954 bp, Zea mays
  misc_feature: Ceres CLONE 1558037
  misc_feature: Encodes the peptide sequence at SEQ ID NO. 73662
ctggagctccccgcggtggcggccgctctagaactagtggatcccccgggctgcaggaattcgtctcacccctagaaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaccttcccgcccttcgaccgcctcggcggcggcgcgtccccggcgttcggcggcctccccggcggcagcattcctggcagcagcattcccgggttcagcatgcccggcagcggcagcagcctacccgggttcagcttgcccggcagcggcagcatgcccctcttttcggcggcggctccccgggcttcagcggcttcggcggcatgcccgggtcgcccaccgccggctccgtccccgagcacgccaacaagccctgaacgccaacaagcgtgggtagtagagtggtgctactgttactgtagtacgtcgtcgtcttcatgcatgcatgggttcgtggtttcccctagctccatacgagcagtagttgggccttgcacgtaccgtacgtctagctagctatatatatagcttgtgttctactgctttttagtttaattactgcttgcattggagaagtggatctgtttccttttgggtgtggttgctttactattaggccagtatctggtggtgtggagacctggtgttaaatttatttacccctttttgaactggtgtactaacccggggt

SEQ ID NO: 73662 - protein, 175 aa, Zea mays
  misc_feature: Ceres CLONE 1558037
MARSSKMMVAAALLALALAVSTAEARNIKTTTTEKKDDAVVQPQTFPPFDRLGGGASPAFGGLPGGSIPGSSIPGFSMPGSGSSLPGFSLPGSGSMPLFSAAAPRASAASAACPGRPPPAPSPSTPTSPERQQAWVVEWCYCYCSTSSSSCMHGFVVSPSSIRAVVGPCTYRTSS

SEQ ID NO: 73663 - DNA, 874 bp, Zea mays
  misc_feature: Ceres CLONE 1558038
  misc_feature: Translation starting site: 123
  misc_feature: SWISSPROT Homolog: EC 1.14.11.20 Desacetoxyvindoline 4-hydroxylase
ctccccgcggtggcggccgctctagaactagtggatcccccgggctgcaggaattcgtctcacccctagaaaaaacatccttattggaagggcagctaataaggtaataaggggcgacgaaaatggctccaacgaccgccaccaaggacgacagtggctacggcgacgagcgccggcgcgagctgcaggcgttcgacgacacgaagctgggggtgaaaggcctggtggactccggcgtcaagtccatcccgtccatcttccaccacccgccggaagccctgagcgacataatttctccggcgcctctgccgccgtcgtcgtcgccctccgccgccgccatcccggtggtggacctctcggtgacgcgccgcgaggacctagtcgagcaggtgaggcacgcggccgggacggtgggcttcttctggctggtgaaccacggcgtggcggaggagctgatgggcggcatgctccgcggggtgcgccagttcaacgagggcccccgtggaggcgaagcaggcgctctactcgagggacctcgctcgcaacctgcgcttcgcctccaacttcgacctcttcaaggctgctgcggccgactggcgcgacacgctcttctgcgaggtggctccgaacccgccgccgcgggaggagctgccggagccactcaagaacgtgatgctggaatacggcgcggcggtgacgaagctggcgcggttcgtgttcgagctgcggtccgagtccctcgggatgcccagcgaccacctgtacaagatggagtgcacgcacaaaccggaacgtggtggtgcagtactacccgccgtggcccgggccgcaccgccccggggggggtcagaaggacacggaccccggtcttcta

SEQ ID NO: 73664 - DNA, 922 bp, Zea mays
  misc_feature: Ceres CLONE 1558040
  misc_feature: Encodes the peptide sequence at SEQ ID NO. 73665
ctccccgcggtggcggccgctctagaactagtggatcccccgggctgcaggaattcgtctcacccctagaaaaagcgccgccgctcctctcacaacccagtcgctcaaaaccctagagctgtcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggatggctactctggcgtggaggtgcgcgtcacgccgatgcgcacggagatcatcatccgcgccacgcgcacgcagaacgtgctcggcgagaagggccgcaggatcagggagcttacctccgtcgtccagaagaggttcaacttccctgagaatggcgtcgagctttacgccgagaaggtcgtcaaccgtgggctctgtgccatcgcgcaggccgagtccctccgttacaagctcctcggaggccttgccgtccgcagggcttgctatggtgttcttcgttatgttatggagagtggtgccaagggttgtgaggtgattgtgagtggaaagctcacggcccaaagagccaagtccatgaagttcaatgatggctacatgatctcatctggtcagccagtgaacgagtacattgactcggctgtgagacacgttcctctcagacagggtgttctcggtatctacgtcgagatcatgcttgacggggacccgaagggctatgctggcccgatcactcctcatcccgaactggtgaccatccacaccccgaagacgaggactaccccggccctcccgtcttggcacctcatgaggggtaagtaccaaccgtgcccttgaaaggaacctggacgggcccaaataggcctcctcccacaaa

SEQ ID NO: 73665 - protein, 235 aa, Zea mays
  misc_feature: Ceres CLONE 1558040
  misc_feature (104)..(188): Pfam Name: Ribosomal_S3_C Pfam Description: Ribosomal protein S3, C-terminal domain
  misc_feature (45)..(102): Pfam Name: KH_2 Pfam Description: KH domain
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRYVMESGAKGCEVIVSGKLTAQRAKSMKFNDGYMISSGQPVNEYIDSAVRHVPLRQGVLGIYVEIMLDGDPKGYAGPITPHPELVTIHTPKTRTTPALPSWHLMRGKYQPCP

SEQ ID NO: 73666 - DNA, 965 bp, Zea mays
  misc_feature: Ceres CLONE 1558041
  misc_feature: Encodes the peptide sequence at SEQ ID NO. 73667
  misc_feature (940)..(940): n is a, c, t, g, unknown, or other
  misc_feature (957)..(957): n is a, c, t, g, unknown, or other
ggagctccccgcggtggcggccgctctagaactagtggatcccccgggctgcaggaattcgtctcacccctagaaaaaatttttgctatttctggtttgcggtcactctatgtgctcatttctgaaagcatgagtgaattggagtatctacagcctgccattggtattgtgttgggcttcatagggacaaagatgatctttgacttctttggttatcatataccaacagaagcttcgcttgctgtagtaactacctgtcttagtggaggcgtcatattaagtcttaggaaagcatcaaaagttgagggggacaagtagactgatgcaacaacacatgcaggtaaaggaatggatcagcttgctccattttttgggcagataatgaagttacaaaagaaattatgataaacatggcttaaggtgccacttcccttagcgtctgaaatgggttcactttgagctctagaattaggggttgaatatcatcaccatggcttggggtgccacctccctttaccgaatttcaatcatccagacatcatccacatagagcattgtgttgctaatactccctccgtttctttttagttgtcgttggatagttcaatttcgcactatccagcgacaactaaaacgaaacggagggagtaccataataagcataagttactgcgatttccagatgtgtcaagtgacagccatgtttgaaacctacggcgacttaccattgctcggagttttactgattttgttttctgcccttttctttctggtgtttcccagattctcattgcatccgtgtccactagttaattcacaaatgctgcattgtccatgccatatgcattttccctttgatactcatgacatgaatcgtgagaaaagaatgccatatgtatttacctttgaatactttatggctgccaactcggtatagatnccgaaaatggtaagggncattggct

SEQ ID NO: 73667 - protein, 105 aa, Zea mays
  misc_feature: Ceres CLONE 1558041
GAPRGGGRSRTSGSPGLQEFVSPLEKIFAISGLRSLYVLISESMSELEYLQPAIGIVLGFIGTKMIFDFFGYHIPTEASLAVVTTCLSGGVILSLRKASKVEGDK

SEQ ID NO: 73668 - DNA, 934 bp, Zea mays
  misc_feature: Ceres CLONE 1558042
  misc_feature (547)..(547): n is a, c, t, g, unknown, or other
ctccccgcggtggcggccgctctagaactagtggatcccccgggctgcaggaattcgtctcacccctagaaaaaccccgttctgtcccagcccaggccgacgacagctgacagcgagccgccgccgccgccgcaccctcgtgcctggttacacagtgtgaaaatgtcatgaatggctttgaaatatctcatatgttatctcagtcaacatacctggagaactgaaaagacaattctgtgaaatcctgcatcaccaagcctgtgttgaatggctaccaatgtgcctactaggaagaaaacgctccgtctgcttgcctcgacgctgtgactaatggaaatgctgctgcgcttgctgatgtggagtacattgattctgaaaatctaggagatctcccagatgtcgatgcaactctaagtaccttagctaagacattggattcgatggagtggcttatgacatgtgatgctctgatcattgctctgcagtaggctatgtatcaccagtaacgattgcgggtacatcttggagcctctagtccctctcaacngtgaaccttcggagaaacccaggaagtcttttatgcaaactggcctttggacttggctgaaatcttaaaggctattgggactttattgttaaccccaccaatcccctgcagtacaagggtttctggaagctccaaaataaactttttttttattaaagcaaaaaacgggccctttttccaaaaaaggtggatcccccctttttaacattcccaaaaaggcgccctcgcccaacattaattcccgggtccgaaaaaatctcctttgtttccccaaaaatcccccccctttttttggggggacaaaaaatatggggtaaaaaacacaaaatgggggcgccccttttaacaacccctctagatagaggggcggcgccccccccccgctcc

SEQ ID NO: 73669 - DNA, 872 bp, Zea mays
  misc_feature: Ceres CLONE 1558044
  misc_feature: Encodes the peptide sequence at SEQ ID NO. 73670
  misc_feature (648)..(648): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (661)..(661): n is a, c, t, g, unknown, or other
ctccccgcggtggcggccgctctagaactagtggatcccccgggctgcaggaattcgtctcacccctagaaaaaaaaagagggatagagaagagatacacgcagaccagtagcaagccaagcagcgcccacgcccccacgagggccacgaccaccaccacccccgccgccgccgcggcaaactgctactgcccaaccgcgggatggaggtggacgccactgccttctgcccgccgccccagcccgcgcctgccgcctccccggcttcaaagccgcctgcgccggtgctgggcgccggtggagcggtcgcgccggtggcagggcacggccgcggcggagggaggcagtaccgcggcgtccggatgcgcaagtggggcaagtgggtggcggagatccgcgagtcgaacaagcggtcgcggatctggctcgggtcctactccaccgccgtcgccgccgcgtgcgcctacgacacggcagtcttctgcctccgcggccgctccgcgcggctcaacttccccgaccagctcgacggcgcggcggtggccgacaaccccgaggggcacaaggacggcgcggggctcacagccgccgccatccgcaagaaggcggccgaggtcggcgcccgcgtcgacgcgctccactgcgcgcngnnnngnnngggnggcggctgcacctctccgcagccgctgtcgttccatcgccgccgccccaagaaccccgacctcaaccgggagccaaccccggaaacctcagacgacgagtaaagcgcgctgattagggtagctagctagctaggcaggcaggcaggcagcagtagcaagtaatgcaagcaaccggtggcggcggcggggcaccaaacggatgagcgtgggc

SEQ ID NO: 73670 - protein, 186 aa, Zea mays
  misc_feature: Ceres CLONE 1558044
  misc_feature (47)..(98): Pfam Name: AP2 Pfam Description: AP2 domain
  misc_feature (149)..(149): Xaa is any aa, unknown, or other
  misc_feature (150)..(150): Xaa is any aa, unknown, or other
  misc_feature (151)..(151): Xaa is any aa, unknown, or other
  misc_feature (152)..(152): Xaa is any aa, unknown, or other
MEVDATAFCPPPQPAPAASPASKPPAPVLGAGGAVAPVAGHGRGGGRQYRGVRMRKWGKWVAEIRESNKRSRIWLGSYSTAVAAACAYDTAVFCLRGRSARLNFPDQLDGAAVADNPEGHKDGAGLTAAAIRKKAAEVGARVDALHCAXXXXGGGCTSPQPLSFHRRRPKNPDLNREPTPETSDDE

SEQ ID NO: 73671 - DNA, 948 bp, Zea mays
  misc_feature: Ceres CLONE 1558046
  misc_feature: Encodes the peptide sequence at SEQ ID NO. 73672
  misc_feature (568)..(568): n is a, c, t, g, unknown, or other
tccccgcggtggcggccgctctagaactagtggatcccccgggctgcaggaattcgtctcacccctagaaaaagtggtcagtcggtcctccacgtcgctcgttcgcgccgaagacccgcccaggccgccccacacggccacagctcaaatcctgagcagagtgggaaagcttggctgagaatcgcttcgtcccgacagccactactaggaattgccgagcgagcgagcttgcgccgtgcgcgatggagggtgacgagaagtcggcgggcggggcccctgcttactggggggcctgggcgcgcggccctgcgacgcgtgcggcgccgaggcggcgcgcctctactgccgcgcggacgctgcgttcctgtgcgcggggtgcgacgcgcgggcgcacggcgccgggtcgcgccacgcgcgggtctggctctgcgaggtctgcgagcacgcgccggcggcggtcacgtgccgcgcggacgctgccgcgctctgcgcctcctgcgacgccgacatccactcggcgatcccgctcgcgcgccgccacgagcgcctccacgtggcgccctacttncgctcgctgcccgaacgcgcccagcccttcggctcggggtgcgccgcccaagccaccctcgacaacaggaccaactaggatcagccggcttcgtggctcctccccaggcccaaacacggggcataaaaaagggcccccacggaaggttccttccgggacccgaacccgtcccaaacccatatttcccgggttcggggaagaaaagagaaccttgggggcctgatgggcggggcacagatgtttggccccccggggccaaaggctttaacccccattaagcgttttaaaccgatgagtattcggggaagaacagggttttccccaacccccccttggagtgggcccccgtgtggaaagatcaaaagggcgtgaaaaaaaat

SEQ ID NO: 73672 - protein, 49 aa, Zea mays
  misc_feature: Ceres CLONE 1558046
MGGAQMFGPPGPKALTPIKRFKPMSIRGRTGFSPTPPWSGPPCGKIKRA

SEQ ID NO: 73673 - DNA, 1628 bp, Zea mays
  misc_feature: Ceres CLONE 1558047
  misc_feature: Encodes the peptide sequence at SEQ ID NO. 73674
aaccgcgcttccgcttgcgcctcgcccgctcgccatcggcgcctctcctcgcgacctcgcctgttgctgacccacccaaccggtcacctcctagagagagcctctgcgtggttgcctcctactgcctccggcccttcgaagctttgcacccgcgcgggatccccaggcggatagcctagcggccagcagtagcgccccagcacgccagcagccagtgaccacgccagctcggccagcatggagctgtcttgcatgatactaatattttcgaggataacagcaagaagcattcataaagccatacacatttctcattcatattcttcaagctttcgaaataaagaattctctagctataagccaacgtttcagcatcttaacactaacaacccgatgaggccaaatgattcgttggaggctcaagacatggttcctgctgagggaaaccacagttgcttctcaagtgttcagtccactccagaaattgagaaaaagtatgtgcatcgtgtctatgatgccatagctccccatttcagtgcaacaagatttgctaaatggcccaaggttgcaggattcttgaattccttgaggccagggtcggttgtactggatgctggctgtggtaatggcaagtatttgggtttcaacactgattgtttattcataggatgtgatataagcccaccgcttattgagatatgtgctgggagagggcatgaggtgttggttgctgatgctgtcaacctcccatacagggatgattttggcgatgcagcaatttcaattgctgtgttgcatcatttgagtactgatgataggcggaggagggccatagaagagctaatccgtgttgttcgaagaggtggtctggtgcttataacagtctgggctagggagcaggaagacaagtctttgctcaacaagtggactcccctctgcgagaaatatactgaagagtgggttgaacagagcagtcctccagtacgcagtaaatctggaactcttctggaaagcattgcagaaactgatgaagatgctggtttcacgaagcaaacagatgaccgattgaaaaactgtcatggtgaggtggaggacaagaccattgactgtagtaattcaaagactgatgaaaatgagaaaaaccagcaggagtactttgttccatggcatctaccatttcaccgagctgaaattggtggtgcatctgctgctctggaaaatggatttgcaaagaaagatgagaagaagggtacagtggtctacaatcgctattatcatgtttttgttgaaggagaacttcagagattggtttctggcataaagaatgctgctattattgaccagttctatgacaaatccaactggtgcattgttctcgagaagctttgagctgcagaaaaaggaatggcacaagaagccatcagaatctgatatttgtggggattcagtggtaggcaagccaaatgtgtttatcccgaagtgtatgatgcattgttaagacttatgtcagattgcccaatattttgagggccatctggacttgtagaaatatttgctgtcaatctggtcaacaccgtgaattagcatgattgctagtactgttttttatacaaaaaaaaaaaaaaaaa

SEQ ID NO: 73674 - protein, 383 aa, Zea mays
  misc_feature: Ceres CLONE 1558047
  misc_feature (124)..(214): Pfam Name: Methyltransf_11 Pfam Description: Methyltransferase domain
MELSCMILIFSRITARSIHKAIHISHSYSSSFRNKEFSSYKPTFQHLNTNNPMRPNDSLEAQDMVPAEGNHSCFSSVQSTPEIEKKYVHRVYDAIAPHFSATRFAKWPKVAGFLNSLRPGSVVLDAGCGNGKYLGFNTDCLFIGCDISPPLIEICAGRGHEVLVADAVNLPYRDDFGDAAISIAVLHHLSTDDRRRRAIEELIRVVRRGGLVLITVWAREQEDKSLLNKWTPLCEKYTEEWVEQSSPPVRSKSGTLLESIAETDEDAGFTKQTDDRLKNCHGEVEDKTIDCSNSKTDENEKNQQEYFVPWHLPFHRAEIGGASAALENGFAKKDEKKGTVVYNRYYHVFVEGELQRLVSGIKNAAIIDQFYDKSNWCIVLEKL

SEQ ID NO: 73675 - DNA, 892 bp, Zea mays
  misc_feature: Ceres CLONE 1558048
  misc_feature: Encodes the peptide sequence at SEQ ID NO. 73676
ggagctccccgcggtggcggccgctctagaactagtggatcccccgggctgcaggaattcgtctcacccctagaaaaacctctcacttctcatcgccgggatccagatcgttcttcctcttgcccgccgattcgttccaccaccgcgaaagccacacagagagcaggagagacaatccagagagatcggcgccatgaacgacctcatgactaagtccttcatgagctacgtcgacctgaagaaggcggcgatgaaggacctggaggcggggggcgacgggatcgagctcccggagtcgggcgccggcggcgtcacggacgagcgcctgcgcggattcttccaggaggccgaggcggtgaaggcggagatggcggccatccgcgacgcgctcgaccgcctgcacgccgcctacgaggagggcaagtcgctgcaccaggtcgacgccctccgcgcgcaccggggccgcgtcaacgccgacatcgtcgccgtgctccggccgcgccgcgacatccgggccaggctggagtccctgtaccgcgccacgccgcgcagcggaagctcttccccggggggccgcaagggcaccccgttgggccggaaggggaaccggcgttaacttgggggctcccggaaaaacctcagggacctcatggctcaattttcagggcctggggaaacgatttaattcccaaataaagggacccggtgagggggcctacaaaccccctcccgggggaggcccccaaggaagaggggattgaagcccttttccccaaaggggcggggaaaagacccccggaaaaaccccccccggaaaccgaaaaggggcccttttctcccccccgttttaaaattactagaccccccaacccgcgggcccgggggggagaaa

SEQ ID NO: 73676 - protein, 140 aa, Zea mays
  misc_feature: Ceres CLONE 1558048
MNDLMTKSFMSYVDLKKAAMKDLEAGGDGIELPESGAGGVTDERLRGFFQEAEAVKAEMAAIRDALDRLHAAYEEGKSLHQVDALRAHRGRVNADIVAVLRPRRDIRARLESLYRATPRSGSSSPGGRKGTPLGRKGNRR

SEQ ID NO: 73677 - DNA, 952 bp, Zea mays
  misc_feature: Ceres CLONE 1558049
  misc_feature: Encodes the peptide sequence at SEQ ID NO. 73678
ctggagctcaccgcggtggcggccgctctagaactagtggatcccccgggctgcaggaattcgtctcacccctagaaaaagatcggcacagccacaacctccttctccaatactctctccctcgccgccggccacctccgcctcctcccacgcgccacctccgcctcctcccacgcgccacctccgcgacaaaccactgaaggagggagaggactcgctcatatcgtccgatggaggaggactcgatcaaggggatgatctccgcgatatcctgggtgcccaggggcgccgccaagagcgtgcccgtcgttgccgacccgcccactcaggaggagatcgccgaggccatgaagaccttcgacctgggcagagactccgggagcgacgctgacgaggatgatgatgctgccaccatggaactcgacggtgcggcggaaacggtggaggaggttgatgaggctgcccgagccaaggccgtagccaaggcgctctgcaagggctctagcaaggcggacgacgtcgctgatgagctccgcgaactcaacatggacgcgtacgatgatgaagatgaagaggtcgatattttcggctctgggctgggggacttgtactatccgagcaacgcaatggacccatatctgaagaagaacaatgaggatgatgaggaggacgacgatgatgatgaggaaatcgaagattagatgatcatgcctactgattttgttattgtctgtgcacatagtgaggacgatatcttctctcttcaggtcaacattgctgaagaaacaaatgatggtgaaccaaatatctttgtgcatcatgacgtccctctcgctgattttcgccatgcccacgcttggatggattttatccggaagtggggtaaaagggattttgtagcgtttggaaccctggatcctgcctaaaaaatggaacttaaaatgggggatga

SEQ ID NO: 73678 - protein, 156 aa, Zea mays
  misc_feature: Ceres CLONE 1558049
MEEDSIKGMISAISWVPRGAAKSVPVVADPPTQEEIAEAMKTFDLGRDSGSDADEDDDAATMELDGAAETVEEVDEAARAKAVAKALCKGSSKADDVADELRELNMDAYDDEDEEVDIFGSGLGDLYYPSNAMDPYLKKNNEDDEEDDDDDEEIED

SEQ ID NO: 73679 - DNA, 868 bp, Zea mays
  misc_feature: Ceres CLONE 1558050
  misc_feature: Translation starting site: 136
  misc_feature (672)..(672): n is a, c, t, g, unknown, or other
  misc_feature (760)..(760): n is a, c, t, g, unknown, or other
  misc_feature (810)..(810): n is a, c, t, g, unknown, or other
ccccgcggtggcggccgctctagaactagtggatcccccgggctgcaggaattcgtctcacccctagaaaaaagccatcacacgcatactgcatacacaacgcagagcatcagaagcagctgcgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggcgagttccccggcgactacgggtgggacaccgcggggctgtcggcggacccggataccttcgccaagaaccgcgagctggaggtgatccactgccgctgggccatgctcggcgcgctcgggtgcgtgttcccggagctgctcgcccgcaacggcgtcaagttcggcgaggcggtgtggttcaaggcgggctcccagatcttcagcgagggcgggctcgactacctcggcaacccgagcctggtccacgcgcagagcatcctggccatctgggcgtgccaggtggtgctcatgggcgccgtcgaggggtaccgcgtcgccggcggcccngctcggggaggtggtcgacccgctgtaccctggcggcagcttcgacccgctcgggctcgccgacgaccccggagcgttcgccgagctncaggtgaaggagatcaagaacggccccgcctcgcatggtctccatgttcngctttctcgtgcaggctatcgtcaacgggcagggccccctcgaggacctcgccgacct

SEQ ID NO: 73680 - DNA, 943 bp, Zea mays
  misc_feature: Ceres CLONE 1558052
  misc_feature: Encodes the peptide sequence at SEQ ID NO. 73681
  misc_feature (777)..(777): n is a, c, t, g, unknown, or other
  misc_feature (779)..(779): n is a, c, t, g, unknown, or other
  misc_feature (780)..(780): n is a, c, t, g, unknown, or other
  misc_feature (803)..(803): n is a, c, t, g, unknown, or other
  misc_feature (843)..(843): n is a, c, t, g, unknown, or other
acccgcggtggcggccgctctagaactagtggatcccccgggctgcaggaattcgtctcacccctagaaaaaagacccccgcccacgaccacacgcaggcagcaagcagcagccgcgcgctcgcctaggactaccgactacgagtagtgctcagctagcctccatcctcagcgcgcgagtggctgctgcgcattcctctctttatccgtctctgtgcttgtttaatttgtgttcgttcgtgagtaggcggccggcacatatggcagcgcagtccatgctcatgtcgaccagcgtcaacggcggccgcgcgctgccgtctcttcaggccgtccggccggctccatacccgcggctaccgctgccgtcgtcgtcatcctcgtcaggctacaggcactccaagtccgtctccgtgaagacgctcgccctgttcggcaaatccaaggtcaagaccgcgccggcgaagaaggctgctgcgcccaagcccaagccgaaggttgaggatggtatcttcggcacgtccgggcgggatcggtttcaccaaggagaacgagctgttcgtcggccgcgttgccatgcttggctttgccgcatcgctacttggagaagccattaccgggaagggcatccttgcccagctgaacctcgagacgggcatccccatctacgaagcggagcctctcctcctgttcatcatcctcatcaccctccttggcgccatcggcgctctcggtgaacgcggtcgcttcgtcgacgaagaaggtcacggctcgaaaaggncnnttcatccacctgggcatggcttncgcggcgccctcggcctcagcgagggaaggccgcttgtcnggtcacaagtcaaaacaactgtttcgtgggccgatggccaactggggctggcttcccatcatcgcgagattatcacgggaaaggccgctggccaactaaa

SEQ ID NO: 73681 - protein, 147 aa, Zea mays
  misc_feature: Ceres CLONE 1558052
  misc_feature (93)..(93): Xaa is any aa, unknown, or other
  misc_feature (94)..(94): Xaa is any aa, unknown, or other
  misc_feature (101)..(101): Xaa is any aa, unknown, or other
  misc_feature (115)..(115): Xaa is any aa, unknown, or other
MVSSARPGGIGFTKENELFVGRVAMLGFAASLLGEAITGKGILAQLNLETGIPIYEAEPLLLFIILITLLGAIGALGERGRFVDEEGHGSKRXXHPPGHGXRGALGLSEGRPLVXSQVKTTVSWADGQLGLASHHREIITGKAAGQL

SEQ ID NO: 73682 - DNA, 936 bp, Zea mays
  misc_feature: Ceres CLONE 1558053
  misc_feature: SWISSPROT Homolog: EC 3.2.1.51 Alpha-L-fucosidase
  misc_feature (511)..(511): n is a, c, t, g, unknown, or other
  misc_feature (562)..(562): n is a, c, t, g, unknown, or other
ggagctccccgcggtggcggccgctctagaactagtggatcccccgggctgcaggaattcgtctcacccctagaaaaaagcgccacgggcatgccaagccagttcacgagcccggccaagaacccaagcacggccaagccaaaccgcccttctcctcctcctggctcctcgtgcctcgcttgactcctcgcgccaatttcgggaaacatgccatgccgggagacgggtagcagctggaagcgcgaggtgggtttgcgcggtcctttcggtgttcccgcttctagcggcggctgcggctgcggcggcccatggaaggtaccgcgcggtgttcagtttcggggactcgctggtggacgccagcaacctggtcacggagggcatcccggactacctcgccaccgcgcgcccgccctacggccagacctacttcggctaccccaccggcaggtgctccgacggccgcctcgtcttcgatttcatcgcgcaggagttggggctcccgctgcccgcngacgtcaaggtctagaaacgcagcttcgagcaggtcgcaacttctcaatcncgggcgccagcgtgctcgaaacggacttcttctggatggagggctcggcaacacgtcctggaaatccgattcctccggaggctaatacaggcctgcaaaactcaagccttgctttgcagtccccggaaggccaccttccccccagtaaacaaattgtcccggaaacatcccccatttcgtagctttttttttaaaaaaaaaaaaaatgtgggggaacgcctaacctttttccccccctcttttcttggcccgaaaaaaaaaaagatttttcccaaatgcctttcctagagagaatttgggggaaaaaaaaaaacccccctttcccggggaaacccgggggggaaaaatagtcccctttattccacccccgtaat

SEQ ID NO: 73683 - DNA, 924 bp, Zea mays
  misc_feature: Ceres CLONE 1558054
  misc_feature: Encodes the peptide sequence at SEQ ID NO. 73684
  misc_feature (891)..(891): n is a, c, t, g, unknown, or other
tggagctccccgcggtggcggccgctctagaactagtggatcccccgggctgcaggaattcgtctcacccctagaaaaatgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagtcgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcgggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttctgggggggtattcatgtttggcatatgccagctctgaccgaatctttggagatgattcgtattacaatttggtggaggaactttagacatccttgggaaaatgcactgggcagcagctaatcggtggcttttagagcctgtgtacagctcgtaacgaaggcgcgatcttgctcgtgaagtatgaattatcaagcagcttgcaatgantgctgaactaccgcacttgtgaaaattggaaga

SEQ ID NO: 73684 - protein, 156 aa, Zea mays
  misc_feature: Ceres CLONE 1558054
  misc_feature (1)..(152): Pfam Name: RuBisCO_large Pfam Description: Ribulose bisphosphate carboxylase large chain, catalytic domain
  misc_feature: SWISSPROT Homolog: EC 4.1.1.39 Ribulose-bisphosphate carboxylase
MGLSAKNYGRACYECLRGGLDFTKDDENVNSQPFMRWRDRFVFCAEAIYKAQVETGEIKGHYLNATAGTCEEMIKRAVFARELGVPIVMHDYLTGGFTANTTLSHYCRDNGLLLHIHRAMHAVIDRQKNHGMHFRVLAKALRMSGGRSYPLRYSSR

SEQ ID NO: 73685 - DNA, 932 bp, Zea mays
  misc_feature: Ceres CLONE 1558055
  misc_feature: Encodes the peptide sequence at SEQ ID NO. 73686
ctccccgcggtggcggccgctctagaactagtggatcccccgggctgcaggaattcgtctcacccctagaaaaaagaacgcgcgggtacggggcgtccttgccatttcccaccctacttgagctaggcggcttgactgacgcggactggcgggggaggagaacacccgacctctacggactcgcgaggggtatgcgacgctaggccaggcggcgaccgtgggaggagcattcaagctgagcgtatggggcgcgagggatggactccaactggtgcggcgagaatgacgacgctcgggcgccgctcctgtccggggctgggcggcggccctactccgtcgcgtccctgctcggggagttcatgtcgcggttgccctactttgtgctcttctccgtccacccccagcgcccgtctctcgtctacttctcccgctcctggggcctcctctaaagggagagagagtgctatgagtttccatttgccacactgaggtcctttgatgacgttgactcgctcgtataatcccctgaactctacgaggatgatgagcttgcggacccaatccagattgaatttgctatgaagatatcgaattatgctttcattgttctcttagcgttgaaggtatctgctacactcaggagctgatcatttgctctagctgcctcaacactggattcactgcgtgatctcgtggctggtggcatccctctgatcacacttctgtcgatgattacatctatgtcttcgagtacgcactggcagactgacgtgacagactgtacgcatgtcatcttcgctgctgtcatggtcaacttctgcttccaagtattattcaggctgtgaaaagctggtgagggatgagctccagaaaactgatccaagtcgattgttgtgctacctcactttgatacttgcacgaattcgaatggg

SEQ ID NO: 73686 - protein, 63 aa, Zea mays
  misc_feature: Ceres CLONE 1558055
MDSNWCGENDDARAPLLSGAGRRPYSVASLLGEFMSRLPYFVLFSVHPQRPSLVYFSRSWGLL

SEQ ID NO: 73687 - DNA, 940 bp, Zea mays
  misc_feature: Ceres CLONE 1558057
  misc_feature: Encodes the peptide sequence at SEQ ID NO. 73688
ggagctccccgcggtggcggccgctctagaactagtggatcccccgggctgcaggaattcgtctcacccctagaaaaaaattcgaacgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctaaactcacccgatcgcgcctgcagtcttgcatagcaggcttttgacgagccatctcgaaactggacacccctgagcgaggagtcctacaatgacagcactttgatcatggcagctccctcgtggatacttgaccctatggacttctgacatctcggaggacccttgcgaaaaaatatcagggtagccgccaagcccgactctgaggatgggt

SEQ ID NO: 73688 - protein, 201 aa, Zea mays
  misc_feature: Ceres CLONE 1558057
  misc_feature (8)..(202): Pfam Name: 14-3-3 Pfam Description: 14-3-3 protein
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLA

SEQ ID NO: 73689 - DNA, 917 bp, Zea mays
  misc_feature: Ceres CLONE 1558058
  misc_feature: Encodes the peptide sequence at SEQ ID NO. 73690
  misc_feature (801)..(801): n is a, c, t, g, unknown, or other
  misc_feature (860)..(860): n is a, c, t, g, unknown, or other
ctccccgcggtggcggccgctctagaactagtggatcccccgggctgcaggaattcgtctcacccctagaaaaaagctcagaggcaaaaacccacaccacacttcgttccccttgtcccaattgctcctccacttcccccaccgcccaccagtgatctcgccgccgcgacgcgaggcaccacggccggcgccggccgccttcctccagaaagtatcccccgtgcgcccgaatcacctcttaatttcgttcttagccgctgcgtttcacagaggtcgcgacatgcccgcctcggcggctcctcctgcccagcccgcggcaccgccccctcctcctcctcccgcttctcctgcccctccggaggatgtggaggcgactgccggttcaccttcgagggcttcagcagtggggacggtgaactggggaacggccaccctcgttggcgtcttcgctgggctgctatacggggggagcagggaggcctccgcttccgtcagtaaggatgccgaggtgatgctgaagatgggaagcacaactgacaagcgtgaacagtatagattgatgagagatgctatggagaaaaggttcattcgggttgccaaaggttcactagtcgggggtgttcggctggagatgtttactgcgactttctttggcatacagaaccttcttatcgatactcgtggagtacatgatgtattcaacattgccgctgctggctctgctactgcagctgcttttggccctatattgccagggtcaatgatgtggcgtgcaaggaatgtattgggtgggatctgctnctggtgctggcatctgctatcaactgggctgggtacagttaaagctggcagaaaggccnatcttgagattgcaaattcaaaacatcatccgatttgacgagggaaagaaaatcaag

SEQ ID NO: 73690 - protein, 205 aa, Zea mays
  misc_feature: Ceres CLONE 1558058
  misc_feature (174)..(174): Xaa is any aa, unknown, or other
  misc_feature (194)..(194): Xaa is any aa, unknown, or other
MPASAAPPAQPAAPPPPPPPASPAPPEDVEATAGSPSRASAVGTVNWGTATLVGVFAGLLYGGSREASASVSKDAEVMLKMGSTTDKREQYRLMRDAMEKRFIRVAKGSLVGGVRLEMFTATFFGIQNLLIDTRGVHDVFNIAAAGSATAAAFGPILPGSMMWRARNVLGGICXWCWHLLSTGLGTVKAGRKAXLEIANSKHHPI

SEQ ID NO: 73691 - DNA, 947 bp, Zea mays
  misc_feature: Ceres CLONE 1558059
  misc_feature: Encodes the peptide sequence at SEQ ID NO. 73692
  misc_feature (936)..(936): n is a, c, t, g, unknown, or other
ctggagctccccgcggtggcggccgctctagaactagtggatcccccgggctgcaggaattcgtctcacccctagaaaaaggagtcctggtccgttttagtgccgaaaaccctaatccccgtggccattttgggcacgtagccgccgtcgccgcctcgctttctcctcttccgccccaccccggtgaggcgctgatccatcgcctcggacagcggctccagaacctccgcgttgcagtggttggggttggcttcgtgctattcagaaacacagtagcgagaactattcggtggggccgaagatggtgtcgctgaaggtgccaaagcgcctcgccgcaagcgttctcaagtgtgggaaaggcaaagtgtggcttgaccccaatgaagttagtgagatctccatggcgaactcccgccataacatccggaagttggttaaggatgggtttatcatcaagaagcctcagaaaatccactctagatctcgtgcaagaagggcgcacgaggctaagcagaagggacggcactcaggatatgggaagcgtagaggtaccagggaggctaggctccccaccaaggtactgtggatgaggaggatgcgcgtgctgaggcgcctgctccgcaagtaccgcgaggccaagaagatcgacaagcacatgtaccacgatatgtacatgaaggtcataggtaactcgttcaagaacaagacggtgcttatggagagcatccacaagtccaaggctgagaatgccagggagaagacgctctccgatcagttcgaggccaggcgcgccaaggagcaaggcgagtcgcgagaggaagaatgctaggacggaagagatgctgggccagtggccaagaaaataccacccacagtctcagccacagctcccactaccgggggcacgaagaagggcaagaagtgaagtatggaacnaagctgcagct

SEQ ID NO: 73692 - protein, 175 aa, Zea mays
  misc_feature: Ceres CLONE 1558059
  misc_feature (2)..(149): Pfam Name: Ribosomal_L19e Pfam Description: Ribosomal protein L19e
MVSLKVPKRLAASVLKCGKGKVWLDPNEVSEISMANSRHNIRKLVKDGFIIKKPQKIHSRSRARRAHEAKQKGRHSGYGKRRGTREARLPTKVLWMRRMRVLRRLLRKYREAKKIDKHMYHDMYMKVIGNSFKNKTVLMESIHKSKAENAREKTLSDQFEARRAKEQGESREEEC

SEQ ID NO: 73693 - DNA, 926 bp, Zea mays
  misc_feature: Ceres CLONE 1558061
  misc_feature: Encodes the peptide sequence at SEQ ID NO. 73694
  misc_feature (741)..(741): n is a, c, t, g, unknown, or other
  misc_feature (891)..(891): n is a, c, t, g, unknown, or other
  misc_feature (901)..(901): n is a, c, t, g, unknown, or other
ctccccgcggtggcggccgctctagaactagtggatcccccgggctgcaggaattcgtctcacccctagaaaaaaaaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatccactcccggtgggcgatgctgggcgcgctgggctgcgtgttcccggagatcctggccaagaacggcgtcaagttcggcgaggcggtgtggttcaaggccggcgcgcagatcttctcggagggcgggctggactacctggggaaccccaacctggtgcacgcacagagcatcctggccatctgggcgtgccatgtggtgctcatgggcttcatcgagtgctaccgcgtcagctgcagcccgctcggggaaggctcgacaaggtgtaccccggcgagcgcttcgacgcgctgggcctcgacgacgacccngacatcgccgccgagctcaaagtgaaggagctcaagaagggctgccttgcatgttctccatgatcagctgcttcgttgcaggcatcatcactggcaaaggccccatcgagaaactcttctaccaggtcgccgtacccgtcgcaataacgnctgggcatcngccacgaacttcgtcccatgcacta

SEQ ID NO: 73694 - protein, 205 aa, Zea mays
  misc_feature: Ceres CLONE 1558061
  misc_feature (59)..(194): Pfam Name: Chloroa_b-bind Pfam Description: Chlorophyll A-B binding protein
  misc_feature (198)..(198): Xaa is any aa, unknown, or other
MAASALHQTTSFLGQALVSRAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACHVVLMGFIECYRVSCSPLGEGSTRCTPASASTRWASTTTXTSPPSSK

SEQ ID NO: 73695 - DNA, 931 bp, Zea mays
  misc_feature: Ceres CLONE 1558062
  misc_feature: Encodes the peptide sequence at SEQ ID NO. 73696
  misc_feature (825)..(825): n is a, c, t, g, unknown, or other
  misc_feature (827)..(827): n is a, c, t, g, unknown, or other
  misc_feature (870)..(870): n is a, c, t, g, unknown, or other
  misc_feature (871)..(871): n is a, c, t, g, unknown, or other
  misc_feature (881)..(881): n is a, c, t, g, unknown, or other
ctggagctccccgcggtggcggccgctctagaactagtggatcccccgggctgcaggaattcgtctcacccctagaaaaaatcttcgccatccgttgcctcgcgagctcgccgccatggcattggctctccccctcgcccgcctcgtccccgcctgccagtgccagccttggccccacctgcgctttcggaagcgccacgtctccttcgccgctcacgccagttctcgcgccgccttcgctgcctgcgcggcggcccctgccctccaggtccaggcgccggaggcggaggcggaggcggagacggtcgagcaagtgggcccgaagacacgcctcgtcgcgcagaacatcccgtgggactgcacggccgacgaaatgcgcgcgctcttcgagagccacggctccgtcgtcggcgtcgagctttcaatgtacagcgccaataaaaacagagggttggcgtttgtaaccatgggttcagaagaggaggctcttgcagctctcacccatctcaattcaactattttaaatgataggaaaattaaggtggacttcgcaaggcctagaaagaagcaacctaagcaacctgctgtggtatcggatgacacggaaaagtatgttgtgtttgtcgggaatttgacatggagggtaagaaatcgtcaccttcgggaattatttgcctctgccccaggtgtggtatcagctgaagttatcttccataccaccactccgagacgatctgctggctacgcgtttgtttctttttcttcgaaagagagcgcaggggccgccatatctgctttcaacgaaagatattgatgggacggccnantaacgtgatgttcaaagatgaaaatggtgaaaaagatgaaccnntctctgtccnaaagaaggccgagggtgaaacatctgatgaccagagtgataagctaagca

SEQ ID NO: 73696 - protein, 232 aa, Zea mays
  misc_feature: Ceres CLONE 1558062
  misc_feature (73)..(143): Pfam Name: RRM_1 Pfam Description: RNA recognition motif. (a.k.a. RRM, RBD, or RNP domain)
  misc_feature (168)..(232): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MALALPLARLVPACQCQPWPHLRFRKRHVSFAAHASSRAAFAACAAAPALQVQAPEAEAEAETVEQVGPKTRLVAQNIPWDCTADEMRALFESHGSVVGVELSMYSANKNRGLAFVTMGSEEEALAALTHLNSTILNDRKIKVDFARPRKKQPKQPAVVSDDTEKYVVFVGNLTWRVRNRHLRELFASAPGVVSAEVIFHTTTPRRSAGYAFVSFSSKESAGAAISAFNERY

SEQ ID NO: 73697 - DNA, 936 bp, Zea mays
  misc_feature: Ceres CLONE 1558064
  misc_feature: Encodes the peptide sequence at SEQ ID NO. 73698
ctccccgcggtggcggccgctctagaactagtggatcccccgggctgcaggaattcgtctcacccctagaaaaattcttctgtcttccccctctctggccctctctctcattttctctgctgacaagttgttgaattaatcgtccccgttcttgtagtgacccatgtgccacccaccccacatctgctctcctcactccctactccctgggctccacggtaccggccaacctccattctctggcgacatgtctactgctgggcgccgacgcgcggccgccctgcgggttccccagatccgggaacgggggcatctgctgctggcatgcgaacgacgacgacatggccgccgtcttaaagacgatgagcgactgcttcttcttacacgaggtggcccatgaatacgtgctgaccgatacctcctccgtcgaggcgccatctccgtctggctcgtccatgctcgagaactcttccccggacgcccgaggtgaccacggagaccaggatgtccatagccatcttaaagaagacgacgctctcgattgcttggacgcgcttgaggactccttgccctctaagaaaggcctctccagcttctactccagctagtccatgtcgttcaccagcctcgcctacgacacgtcgacggaggcggcggcagtcaaggagctcgcgtattcagataaccgttctacaagctgctgctgcatctggccaactggtccatgtcagcctcctgcagctcgctggacatcgtcgtcctacgtgcgcccgctcgtgggccccgaccacactgtcgcctagggggacatagagcaagaagacgattctgactcgtaccacatgtaatggaagcaaatgtcgccgccacatcctggcaagacgtcggggactccgggggcactgcaccccgtagaatcggggggtcgggatgtcg

SEQ ID NO: 73698 - protein, 88 aa, Zea mays
  misc_feature: Ceres CLONE 1558064
MAAVLKTMSDCFFLHEVAHEYVLTDTSSVEAPSPSGSSMLENSSPDARGDHGDQDVHSHLKEDDALDCLDALEDSLPSKKGLSSFYSS

SEQ ID NO: 73699 - DNA, 909 bp, Zea mays
  misc_feature: Ceres CLONE 1558068
  misc_feature: Encodes the peptide sequence at SEQ ID NO. 73700
  misc_feature (322)..(322): n is a, c, t, g, unknown, or other
  misc_feature (326)..(326): n is a, c, t, g, unknown, or other
  misc_feature (327)..(327): n is a, c, t, g, unknown, or other
tggagctccccgcggtggcggccgctctagaactagtggatcccccgggctgcaggaattcgtctcacccctagaaaaagctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgctcccatggcgagccaggtgatgaagagcagcctcgtcgtgcactcgaggccgaaggggctgtcaggcgctgctgcgctcacgaggcgggccggccggttcaccgtcnaggnncatcagccggagaaagcaacggtaccaggtgttggaagcaatcaaacggggaacccctttatcgggaggcctggaaaacgccgggtcacctttaaaccccctctgtgggggtgggaaccttttcaaaacttttgggccttacccaaacccccttgagcccccctttctcggggggcgccaaagggtgggccttcccccccggggtttcccctctcggggggggctttttggctttacagggggccccctccccaaaaaacccccccttttagggagaaagggggggggctttttttggccccccccggccttttttccccaattcttaaaggggtgggcccccaaaaagaggggggggggcccccccctctataaaagaggggggggacccttccgggggggcctctctttttttttttttttcccccggaaaaaaaaaagaagggccaaaaattttgtgccccccccccccggggggggggggggtatttccgggggggggggttttcttttttggggggggacctccggggggggggggtgggggagattttttttttttctccttggtgtggagcgcct

SEQ ID NO: 73700 - protein, 87 aa, Zea mays
  misc_feature: Ceres CLONE 1558068
  misc_feature (35)..(35): Xaa is any aa, unknown, or other
  misc_feature (36)..(36): Xaa is any aa, unknown, or other
MASQVMKSSLVVHSRPKGLSGAAALTRRAGRFTVXXHQPEKATVPGVGSNQTGNPFIGRPGKRRVTFKPPLWGWEPFQNFWALPKPP

SEQ ID NO: 73701 - DNA, 942 bp, Zea mays
  misc_feature: Ceres CLONE 1558071
  misc_feature: Encodes the peptide sequence at SEQ ID NO. 73702
ctggagctccccgcggtggcggccgctctagaactagtggatcccccgggctgcaggaattcgtctcacccctagaaaaattgggctatctctttggcagtgacgaagctccaaaatcatttgagaagcctgcaccagttcaaaagccaactcctccatcctctgcagagagactaaaagatatcgctgctggtattcaaagtagtaaatcaaacaattacaaaagatctgaaggccagaactgtggaaatttccttacggtcagtatccaatgacacctgtgaacattttgattatgctattttggagcaccagttgagtgctgtgcaggtggagcaagaaaaagtttatacttgctctcattcatagtttgttcttagcctatgatctataagtacttgtttaggttttgctgcaagaagcacccttcataatatgattacggtgctgtgttctgtatttacattaatatgacatggaacatggttatgatgacaagttctctctactgatctcaccttgttgtacttctatggtttgcccttcttctctgtggtagatgaagtcatactaaatcatttgcagttataagagcctggtatttgacattatgacaataaatacttgtagcattttatcggaatcatggttgttaatcctatagtatgtcattagtgccagccagaataatctctgttgtctgttggtatgtgttgagctttggtatttgacaagagctctacttgtgggtttacatttgactgtgctttcagtaatcaaaactcccaactgtgcttccatgctgatgcatttgcgtaaatatcctggctgctgtctgtcctagatatcctgatgatagcccctcgattgttcaatcttgctttgccctctcccacaaggatagttgccaatacctttaatgaaacggatcttgtgcattta

SEQ ID NO: 73702 - protein, 90 aa, Zea mays
  misc_feature: Ceres CLONE 1558071
GAPRGGGRSRTSGSPGLQEFVSPLEKLGYLFGSDEAPKSFEKPAPVQKPTPPSSAERLKDIAAGIQSSKSNNYKRSEGQNCGNFLTVSIQ

SEQ ID NO: 73703 - DNA, 940 bp, Zea mays
  misc_feature: Ceres CLONE 1558072
  misc_feature: Encodes the peptide sequence at SEQ ID NO. 73704
  misc_feature (831)..(831): n is a, c, t, g, unknown, or other
  misc_feature (864)..(864): n is a, c, t, g, unknown, or other
  misc_feature (865)..(865): n is a, c, t, g, unknown, or other
  misc_feature (893)..(893): n is a, c, t, g, unknown, or other
ctccccgcggtggcggccgctctagaactagtggatcccccgggctgcaggaattcgtctcacccctagaaaaaccttttttgtcgcctccgtgcgtgccccgggggccttgatcgcgcgcaccggtcagctcagcccgtctgattcgcgtgctgccagccctccgccgatcgtgaaacacaaccgtcggtggtttgcttgcttgatcgctgatcctcgcggacgctcacggtcatggcgcctcagcctttgcgcgctccgaggctgagcgcccccgctggccacgcggcgtgcaggtgctcggccgcgccgctattcgggaagcgggcgccccccgtcgtcgcgttcccccgcgcccgtagcggcggcgccgtcgcctcgtgctcggccgtgcaggagtcgtccacctccaccactgttagcaagaagaaggatgccgcggacggggccaaggaggccacagcggaggcggcgaagccggccgcggccgccaagccaaagaaggccgcggcgctgccgctgccggagatgatgcagcaggagatcatcccaccgctgaaggatgccttggaggcggaggacgacgtgtcccaggtgcagctcgccttccaaaacaacacgctggagggatccttcataaagaacgacgtcccttattatttttgggccttctttccaaaggagacctcacaggaccgaagggctttgcgctatcgtcctacagcaacgaagtgagcaccatcgagccgttcctgatcgatgagaagaggaaacggccaagtacgtggtgttctgggtctaacagagctggctggggcaggcatccttccngtctggaagaaaagaagggggaagaagaagccnncaaattataggttgcgcaagcccatacnatacccatacacaaggttgctggcctgaaaatacccggtaaccctgg

SEQ ID NO: 73704 - protein, 166 aa, Zea mays
  misc_feature: Ceres CLONE 1558072
MAPQPLRAPRLSAPAGHAACRCSAAPLFGKRAPPVVAFPRARSGGAVASCSAVQESSTSTTVSKKKDAADGAKEATAEAAKPAAAAKPKKAAALPLPEMMQQEIIPPLKDALEAEDDVSQVQLAFQNNTLEGSFIKNDVPYYFWAFFPKETSQDRRALRYRPTATK

SEQ ID NO: 73705 - DNA, 951 bp, Zea mays
  misc_feature: Ceres CLONE 1558073
  misc_feature: Translation starting site: 355
  misc_feature: SWISSPROT Homolog: EC 1.7.3.3 Urate oxidase
tggagctccccgcggtggcggccgctctagaactagtggatcccccgggctgcaggaattcgtctcacccctagaaaaaatcacagaccagatccctgcgggtgcggcggccatggtccgagaacttccaactccagggccggcacggcaagtcccgcgtccgcgtctcccgcgtctggcgccgcccggccgcggcggggggcgacgtcatcgttgagtaggaacgtcgccgtcagtatcgtctccgactgcctcccctcctacacctccagcgacaactccgccatcgtcgccacagattccatcgagaacaccgtgtatgtcaaggcgaaagagtgcacggaagtggtgtccatggaggaattcgccgtgattcttggaaggcatttcacctcgctgtaccctcaggtttcagaggccacggtgactatcgtggagcgcccatgggagcgtgtgactgtcgacggaaagcctcattcgcatgggttcaaagttggtgttgagaagcacagcacagaggtcattgtaaaaaaatctggaagcctgcttataaattctggaattcaaagatactcgctgctaaagacaactcactctgggtttgaagggttcgtgacggatcgctataggcttcttcctgatacaaggaaaggatagagcaacagaagtaactgcttggtggaggtatcccttctgacatgtttcgcagctcccatcgatagcattctgcttcacgcagagatatccggatgtgacagaagtccttgcagagacgttcattggtcctccggatgttggtgtgtatagtccatccgtgcaaaatacgctatgcctcatggccaagtaatccctacaagggttcccagatatatcgtccgtcccacttagatggccaacccttcactttctgcctggtcaactgggggagcaggaacctccccctggggaaat

SEQ ID NO: 73706 - DNA, 920 bp, Zea mays
  misc_feature: Ceres CLONE 1558074
  misc_feature: Encodes the peptide sequence at SEQ ID NO. 73707
agctccccgcggtggcggccgctctagaactagtggatcccccgggctgcaggaattcgtctcacccctagaaaaagcctgccgtttccatctccatccagttctccgcacccacccacccacccactcctttccccaacccatggccgccgccgccgccggcacccgggaggagatggtctacatggccaagctagcggagcaggcggagcggtacgaggagatggtggagttcatggagaaggtcgcggccgccgccgagctcaccgtcgaggagcgcaacctgctctccgtcgcctacaagaacgtcatcggcgcgcgccgcgcctcctggcgcatcgtctcctccatcgagcacaaggaggagacgcggggcgcggcggggcacgccgccgccgccagggggtaccgcgcgcgcgtggaggccgagctctccgggatctgcgcggggatcctgcgcctcctcgacgagcgcctcgtgccggcggcggcggccgtggacgccagggtcttctacctcaagatgaagggggactaccaccgctacctcgccgagttcaagaccggcgccgagcgcaaggacgccgcggactccacgctcgccgcctaccaggccgcgcaggacatcgccgtcaaggagctgccgcccacgcatcccatcatgctcggcctcgccctacacttctccgtcttctactacgagatcctcagctcgccagaccgcgcctgctcgctgggcaagcaggccttcgacgaagctatttcagagctggatagtcttgggggagagtcgtaccaggatagcaccctcatcatgcagcttcctcgtgacaccctcacttgtgggacttccgacatgcaagaggataggtggccaatgaatgccggatgcaattagccctgacaaggaaccgtatttt

SEQ ID NO: 73707 - protein, 251 aa, Zea mays
  misc_feature: Ceres CLONE 1558074
  misc_feature (9)..(243): Pfam Name: 14-3-3 Pfam Description: 14-3-3 protein
MAAAAAGTREEMVYMAKLAEQAERYEEMVEFMEKVAAAAELTVEERNLLSVAYKNVIGARRASWRIVSSIEHKEETRGAAGHAAAARGYRARVEAELSGICAGILRLLDERLVPAAAAVDARVFYLKMKGDYHRYLAEFKTGAERKDAADSTLAAYQAAQDIAVKELPPTHPIMLGLALHFSVFYYEILSSPDRACSLGKQAFDEAISELDSLGGESYQDSTLIMQLPRDTLTCGTSDMQEDRWPMNAGCN

SEQ ID NO: 73708 - DNA, 929 bp, Zea mays
  misc_feature: Ceres CLONE 1558075
  misc_feature: Encodes the peptide sequence at SEQ ID NO. 73709
  misc_feature (651)..(651): n is a, c, t, g, unknown, or other
ctggagctccccgcggtggcggccgctctagaactagtggatcccccgggctgcaggaattcgtctcacccctagaaaaaaacctacgacgagcggctaccttaattagctaagctagaattcttggggggcgcacgcggcagcgtctagctccgaggcgcggcggccatggcgaagccgcaggaggtgcgcagcgtctactccttctcgctgctgccgttcatccggccggccccgcccccggctccggcgcagccgatggacgccaccatccggctcttcggctgcgacttctccaacgacgaccagcagcagcggctggccaagcagcagcagcagcaccgccaggacgccgccgcggccgactcccccgacgccgccaacggcagctcgatcacgtccgagagcaacaacggagccaacaagagcggcggcggcggcggcggcggcgccgacaggaagttcgagtgccactactgctgccgcaacttcccgacgtcgcaggcgctgggcgggcaccagaacgcgcacaagcgcgagcggcagcacgccaagcgggcccacctccaggcctccctcgccatgcaccgctacgtgcccggccacatgtactgcctcttcaactaccaccagcagcagagcaccacctcntgccgctgctgcggctgccgctttcactaccccgcgtcgctgcagttgtctcccccgccggctgctcgctacccgatgtggacgagcgcctgccccgcggggccctaacgcgtaggccatgctccatgtcgcaccaatcaaccgtagcccggtgccgctgggtttttggaagttgccgccccccgttccacgacaccaccactacgcatggaaaattccggggggccggcgcaggcacgcccctttggaggcacgcgctgtcctggcccgggacggtt

SEQ ID NO: 73709 - protein, 196 aa, Zea mays
  misc_feature: Ceres CLONE 1558075
  misc_feature: The sequence is a functional homolog of SEQ ID NO 1094 in the 10/412,699 US patent application
  misc_feature: The sequence is a functional homolog of SEQ ID NO 639 in the 10/374,780 US patent application
  misc_feature: The sequence is a functional homolog of SEQ ID NO 763 in the 10/666,642 US patent application
MAKPQEVRSVYSFSLLPFIRPAPPPAPAQPMDATIRLFGCDFSNDDQQQRLAKQQQQHRQDAAAADSPDAANGSSITSESNNGANKSGGGGGGGADRKFECHYCCRNFPTSQALGGHQNAHKRERQHAKRAHLQASLAMHRYVPGHMYCLFNYHQQQSTTSCRCCGCRFHYPASLQLSPPPAARYPMWTSACPAGP

SEQ ID NO: 73710 - DNA, 951 bp, Zea mays
  misc_feature: Ceres CLONE 1558076
  misc_feature: Encodes the peptide sequence at SEQ ID NO. 73711
  misc_feature (804)..(804): n is a, c, t, g, unknown, or other
  misc_feature (805)..(805): n is a, c, t, g, unknown, or other
  misc_feature (812)..(812): n is a, c, t, g, unknown, or other
  misc_feature (814)..(814): n is a, c, t, g, unknown, or other
ctccccgcggtggcggccgctctagaactagtggatcccccgggctgcaggaattcgtctcacccctagaaaaaactacacacaaacacacaatggcaccagaaaggatgctcctcggcgtctgtgccgtgctgatggtggtcggcgtcacgaacgcggcggagggccaggtggcgtcggtcgtcgtgggcctggcgaggtgcgccgacagcacgaggaagaacatgaaggctgaggccggtttcaagggtcttcaggtggcgatcaagtgcaagaacagcaacggcgagtacgagacaaaggccgtgagtgagatccaaagctccggagccttcagcgtcccactcgccgccgacctccacggcgccgactgccacgcgcagctccacagcgccgccaataacgcgccttgccctgggcaggagccgtccaggatcgcgcccatgtcaggcggcaccttcgtcgccgtgcctggcaagatgcactacccgtccgcggagtgcgcgtccgcgtttctctgctccccgatcaagaagcacttgttagatcacttccacaaggcacccctgccggtgccggagtaccacccggtgcctgaccacagcaagccgccggtgccggagtaccacccggtgcctgagcacagcaagcctgcgccggagtaccaccctcccacgccggtataccaccctcccactccagtgtacgggcagccaaaagcctctccgatctaccatcctcccgctgagcactgagttcgatcaaacacgaacgccagagctagaagaacggcagggcttctgnntagtatnantccagtactgcacgtgtttactagtgcgctcatgcatggaggaataaatgggtgtgaatataagcggggagcttgtacttatttagttatcgaatggtggtttacctttactggcttaccgaattccggttggggct

SEQ ID NO: 73711 - protein, 220 aa, Zea mays
  misc_feature: Ceres CLONE 1558076
  misc_feature (31)..(217): Pfam Name: DUF1210 Pfam Description: Protein of unknown function (DUF1210)
MAPERMLLGVCAVLMVVGVTNAAEGQVASVVVGLARCADSTRKNMKAEAGFKGLQVAIKCKNSNGEYETKAVSEIQSSGAFSVPLAADLHGADCHAQLHSAANNAPCPGQEPSRIAPMSGGTFVAVPGKMHYPSAECASAFLCSPIKKHLLDHFHKAPLPVPEYHPVPDHSKPPVPEYHPVPEHSKPAPEYHPPTPVYHPPTPVYGQPKASPIYHPPAEH

SEQ ID NO: 73712 - DNA, 957 bp, Zea mays
  misc_feature: Ceres CLONE 1558077
  misc_feature (775)..(775): n is a, c, t, g, unknown, or other
  misc_feature (805)..(805): n is a, c, t, g, unknown, or other
ggagctccccgcggtggcggccgctctagaactagtggatcccccgggctgcaggaattcgtctcacccctagaaaaactatatttaatacagggacatacttctgcattaggttgtcttaaaaatgcattacgtagagcaagtacaaaatttttattagctataattgatgtttagtacatatagtataaaaggcaaggtttttgttacaaagaaaatattctctgtttgtgtgtgtgtttgcttaagtgttatggattattcattttttgtaaatttagtgatacttttatttgacctgctgcacacctagctagttcatttctctgttggcatagcaagaagtggtacacaggttgcatttggacaaggaaactcttattatgcaagaaattttcccatgcccaaaaaggattcttcagcaggtggagcttcgaagttaccaaaagaatatgcagaaccatgggactatagccatgattatcctgttactctcccactaaggaagccctactctggaaatcctgaaattctggatgaggaagaatttggagaatcttctgccagcaggacccaagatgatgaattatctgcagcagagcagcttggattaatggatatgtcgtcggaatcacagttcctcttcttccagttgccatcctctcttcctttaccgagcagccacaatcagttgctgaccctaacgaagtccgcgatgagaaatgtgagggcatgaggccatcatcgcacatggctcgaaactcaaagaggtccntgaagctatatgggggaaatgtccgtattnaagagtggtaaagtgagatgaagaaggaacaactcccttgatgttcatttggcccgaaatgcatgttttccccggaggtgcagcattcactccggagaaaaacttgctgttcgggggaaaaaaacaacaaggtgaatctcacccccaattta

SEQ ID NO: 73713 - DNA, 945 bp, Zea mays
  misc_feature: Ceres CLONE 1558078
  misc_feature: Translation starting site: 466
  misc_feature (873)..(873): n is a, c, t, g, unknown, or other
  misc_feature (880)..(880): n is a, c, t, g, unknown, or other
ctccccgcggtggcggccgctctagaactagtggatcccccgggctgcaggaattcgtctcacccctagaaaaagtgggaactgcatgctgagagcaaacccagaaaggaaaaaggaaaaaaagaaaacagagagaggggagagtgggagacggtcggagacagaggcctcactcctccacactctcagtcgtcttccagtcccagcgctttcttggatcgcgaggaaaccactcggggagtttgcagttgcagagaactgtatcggccgaagtggttgcacggtgtgttggccttggccatgcgccacggcagggaacagagacgagcagcagggaggcagcaatggaggcgctcattgaccctgctctcgctgtaaagatagtcccgcggtgccctccgaattccacttgatccaactctcgacatgaagcggccacgcggcgctactccctccctgtctgcgatgcccaatcatcaggaagatgacggctacggcgtggtcgggatggaggcggacgtggacgtggacgtggacgaggagatgatggcgttcggcggcggcggcggcggggagaagaagcggcgcctgagcgccgagcaggtgcgcgcgctggagcggagcttcgaggtggagaacaagctggagccggagcgcaaggcgcggctggcgcgcgacctcggcctgcagccccgccaggtcgccgtctgggttcagaaccgccgcgcccgctggaagacaagcagctggagcgcgactacggcgcgctgcgccgctcctacgacgcgctttcgctcgaccacgacgcgctccgccgcgacaagacgccctcctcgccgagatcagggagctcagggcgaactgggggagacnagacccncgggcgagctcccctcggtcaaggggagccgcggcctcggacggcggccccccgggggggggggc

SEQ ID NO: 73714 - DNA, 918 bp, Zea mays
  misc_feature: Ceres CLONE 1558079
  misc_feature: Translation starting site: 265
  misc_feature (801)..(801): n is a, c, t, g, unknown, or other
ggagctccccgcggtggcggccgctcttaactagtggatcccccgggctgcattgattcgtctcacccctagaaaaaagacccccgcccacgaccacacgcaggcagcaagcagcagccgcgcgctcgcctaggactaccgactacgagtagtgctcagctagcctccatcctcagcgcgcgagtggctgctgcgcattcctctctttatccgtctctgtgcttgtttaatttgtgttcgttcgtgagtaggcggccggcacatatggcagcgcagtccatgctcatgtcgaccagcgtcaacggcggccgcgcgctgccgtctcttcaggccgtccggccggctccatacccgcggctaccgctgccgtcgtcgtcatcctcgtcaggctacaggcactccaagtccgtctccgtgaagacgctcgccctgttcggcaaatccaaggtcaagaccgcgccggcgaagaaggctgctgcgcccaagcccaagccgaaggttgaggatggtatcttcggcacgtccggcgggatcggtttcaccaaggagaacgagctgttcgtcggccgcgttgccatgcttggctttgccgcatcgctacttggagaggccattacgggaaaggcatccttgcccagctgaacctcgagacgggcatccgcatctacgaggcggagcctctgctcctgttcttcatcctcttcaccctcttggcgccatcggcgctctcgtggaacgccgccgcttcgtcgacgagaagtcaccggcctcgacaaggcgtcatccaactggcaaggcttncgcggcgccctggcctcaacgaaggaggcccgcgttctgggttcacaagtcaaacaagctgttcgtggggggatggcgccaacggcggggccttctccatatcgggagatctaacgg

SEQ ID NO: 73715 - DNA, 949 bp, Zea mays
  misc_feature: Ceres CLONE 1558081
  misc_feature: Encodes the peptide sequence at SEQ ID NO. 73716
ctccccgcggtggcggccgctctagaactagtggatcccccgggctgcaggaattcgtctcacccctagaaaaagtacgcgaaatctctctctctcgtggtcgtgcgcttccttcccgagactccaatgcccctgcctcccctgctcccgcgcctttaccccacgccgcctccacttcgcgccggggacaggggtaacgccgtccctctctctcctggaagaagaaggccggcgcttctcgctgtcgtccgcgcaaagagaaaggacgaggcaagcttcaccgaccgcatccttgactacatcgagggagggccaaagttaaggagatggtatggagcacccgatttgcttcccaaggatggggctgcggaggatgaggaggacgagtctcaaggtacatagagaaagcactctgtaaatttgaactccttggcggctgtgtcttcttatttgttggcagatctggggtgacaaatagatattgaggagtctcgggacgctgtgctagtcaccaatggcgacagtgagattggacagatggtgatattagcactaattctgaaaagggctagaacaaaagcacttgttaaggataaacgaaccactgaagaagcttttggaacttatgtggagtgcatggttggtgatatcggagataagtccttcacaaagagagcactaaggggcgttcgtgctataatttgtccagctgatgatggttttttctctgaaccgatcgacctcaaggtgttcaacacattgttctgctatcacagaaatagtggtggtttgcaagctattatgaacagcaagctgatacgctagcagagaaagatgaagaagtggtcttgcatctggcatccatgtacattatcagaacaggtctctgcaagcactcctggtcgcgagagaggtttgattttactgaggcatagcaagcaggaagaat

SEQ ID NO: 73716 - protein, 91 aa, Zea mays
  misc_feature: Ceres CLONE 1558081
MPLPPLLPRLYPTPPPLRAGDRGNAVPLSPGRRRPALLAVVRAKRKDEASFTDRILDYIEGGPKLRRWYGAPDLLPKDGAAEDEEDESQGT

SEQ ID NO: 73717 - DNA, 917 bp, Zea mays
  misc_feature: Ceres CLONE 1558082
ctccccgcggtggcggccgctctagaactagtggatcccccgggctgcaggaattcgtctcacccctagaaaaaccctagaaaaatcacagcacgatcgagccagttgcaatcacacagcgcagacgatgccgaccatcatcgtctcggtggacctggaatgctgccgctgccgcgccaagatccagagggtgctcaacaggatccaagagaagggcgagttctgcatcgatgacatcgacttcgactagaagaacaacaaggtgaaggtcacggggcccttctacccggacaagctcgccgactagctgtgctgcaaggcgtgcaagatcatcaagcagatcgagatcgtcgagccccctgccccgccgccgccctagccctaggaggagccgaagaaggaggagcaagccccgccgccgccggagaagaaggaggaggccgccccgcccccgccggcgaaggtggagccgcccaaggaggagcctcccgatggatattcccccgccacccatggaggagccgcccgatgagaagcctcccccgcccacagaggagaagcccgccccggcaccgcactagggattagaagccagccccggcgccgcgcaatgtggtcgaggtcacctacacgcggccgtactcgtacccataccctgcgcggccggcatactgctgctgccaccactggcacggtgagtgccactgctcgctcctgcggcaagggccccgagaccggctcggttccccgccctgtaccaacctccaccctcagttcttcgcgcaggatctgccccgatcagtacccccttccacccctgatgggtgccgggataccggaattgtgccgcgaacaatgacccctccctaacccccggccccacgttggtgacccgggttttcaacaatcagacgcct

SEQ ID NO: 73718 - DNA, 945 bp, Zea mays
  misc_feature: Ceres CLONE 1558083
  misc_feature: Encodes the peptide sequence at SEQ ID NO. 73719
ctccccgcggtggcggccgctctagaactagtggatcccccgggctgcaggaattcgtctcacccctagaaaaaggatcgaggaaaccaatccattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgcgcctcgcggaggaggccggcgcgtgcgccgtgatggcgctggagcgggtccccgccgacatccgcgcgcagggcggcgtggcgcgcatgtcggacccgggcctcatccgcgacatcaagcgcgccgtcaccatcccggtcatggccaaggcccgcatcgggcacttcgtggaggcccagatcctggaggccctgggcgtcgactacgtggacgagagcgaggtgctgacccccgccaacgacgcgcaccacatcaacaagcacaacttccgcgtccccttcgtctgcggctgccgcgacctcggcgaggcgctccgcagggtgcgcgagggcgccgccatgatccgcaccaagggggaggccggcacgggcaacgtcgtcgaggccgtgcgccacgtgcgctccgtcatgggcgacgtccgcgcgctccgcagcatggacgacgacgaggtcttcgcctacgccagcgcatcgccgcgccctacgacctcgtcatgcagacaagcagctgggccgcctccccgtcgtgcagttcgcccgcggggggtgtccccacgcccgccgacgcgcgctcatgaagcaactgggatgcaaaggcgtctcctccggtcgggctcttcaaaagcggcgaccccgcgggcccgcc

SEQ ID NO: 73719 - protein, 270 aa, Zea mays
  misc_feature: Ceres CLONE 1558083
  misc_feature (29)..(234): Pfam Name: SOR_SNZ Pfam Description: SOR/SNZ family
MASDGSGVVTVYGSNGAELLEPSKQPKSATFSVKVGLAQMLRGGVIMDVVTPEQARLAEEAGACAVMALERVPADIRAQGGVARMSDPGLIRDIKRAVTIPVMAKARIGHFVEAQILEALGVDYVDESEVLTPANDAHHINKHNFRVPFVCGCRDLGEALRRVREGAAMIRTKGEAGTGNVVEAVRHVRSVMGDVRALRSMDDDEVFAYASASPRPTTSSCRQAAGPPPRRAVRPRGVSPRPPTRAHEATGMQRRLLRSGSSKAATPRAR

SEQ ID NO: 73720 - DNA, 959 bp, Zea mays
  misc_feature: Ceres CLONE 1558087
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (703)..(703): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (713)..(713): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
tggagctccccgcggtggcggccgctctagaactagtggatcccccgggctgcaggaattcgtctcacccctagaaaaagcgaccccaggtcagtcgggactacccgctgagtttaagcatataaataagcggaggagaaaggcggtgcagctccttgagcgaatgagcagattcctggttcggcaacaagagggtatcaattcccatgagcagatgttggacgagctcgaacgtcaacttgatgccttcggacctggagttacagaggccgatatccttgaacaatctggacttctttaacccacggttgcatgatgatgatgatgaatctatcttcgccacaatactatcaaaagaggtcttgttttggggatagtactaccaaaaaagttcatgctgaaccagagttcttttatggcgacgttctatcggtactgatgcttatctgtccgtccggcttggtttcttccatgcttgtgtgctgaagctcccatcgctccatcagtttctgggaacgtaaggtagcacagaatgatgagatgtgtacagtctactatgtatgctgctccagaggtcatatagctatgatatgagtagaacatgtacattttttttcactatgttactataaaaaatgtggagttttagcggcggactcgatcagtaaaacttatttcgtgcaaannnnannnannnnnntanannnannngntnnngaaaacnnnnaaaaaaaaaaaaaannnnggtccttcaggcatcaagcttaagcaagcagatctaggctccgggcacgtcgcgacagagtgagtgagtacacgacacaacatggcttccctgaaggccgcaaacccaacggattgcggccatggcaaggaccggcgcctagctcacgagacgcaacaaccttcagcgcaatagcggcgcgttaaaagctgagcaaagcccgtaaacctaagaa

SEQ ID NO: 73721 - DNA, 935 bp, Zea mays
  misc_feature: Ceres CLONE 1558088
  misc_feature: Translation starting site: 150
  misc_feature (433)..(433): n is a, c, t, g, unknown, or other
  misc_feature (464)..(464): n is a, c, t, g, unknown, or other
  misc_feature (465)..(465): n is a, c, t, g, unknown, or other
ctccccgcggtggcggccgctctagaactagtggatcccccgggctgcaggaattcgtctcacccctagaaaaaaacgcacatctccaccgtcgtccgccgccgccgaaggacggaaggagaagagggtacggccgtctccttgcccccatggcccacgagaagaagctgtccaacccgatgcgggagatcaaggtgcagaagctcgtcctcaatatctccgtcggggagagcggcgaccgtctcacccgcgccgcaaaggtgctcgagcagctcagcggccagacccccgtcttctccaaggcgaggtacacggtgcggtcgttcggcatccggcgtaacgagaagatcgcctgctacgtcacggtgaggggcgagaaggccatgcagctgcttgagagcggcctcaaggtcaaggagtacgagctgctcangaggaacttcagcgacaccgggtgctttggnnttcggtatccaggagcacatcgaccttgttatcaagtacgatcccgtcacaagcatctacgggatggacttctacgtcgtggctggagcgtgccggctacggttgtggcccgccccaggaggtgcaagtcccccgtcgggatttcagccagggtgaccagggaggaccccttgaaggggtcccaggcaaagtccaaggggttatcccaaaaaagggtcagccaaccctttggaaaccccccccggggggaaaaaagctctggtggtcgcccccctttccgtggaaaacaaaaaacccccccccccgggggttttttggggtaatttgggggccacaccacttaattttccccccaaacccttggggggtcgtcccccaaaatccccccttggatatattttcccgccctgggccaccggtgggggttggaaaaaaaaaggtggagagaattttttggggaaaaaaaaact

SEQ ID NO: 73722 - DNA, 997 bp, Zea mays
  misc_feature: Ceres CLONE 1558089
  misc_feature (508)..(508): n is a, c, t, g, unknown, or other
  misc_feature (513)..(513): n is a, c, t, g, unknown, or other
  misc_feature (518)..(518): n is a, c, t, g, unknown, or other
ggagctccccgcggtggcggccgctctagaactagtggatcccccgggctgcaggaattcgtctcacccctagaaaaaattgccaaggaaatttcagaggcggaattgagatagaggagggagtgggaagggagacagggaggggtcagtcgtcttcctttgtccccgtgctgctcctttgcttcggagtcttgccaagcctagattcgaggagagggctccctctctttccttgcttggcctgcatcggaaggtgcgattggcgctctctgtcctacagtgcaggccgaaaattattttacgcaggattctgatttttctgttggaggaatgtcctcaaccacatctattcagccctcagcatcttcaggtggtgcatctacttcagctgatgagaatgcaaggcctcctgattcaagcactaattcttctggaccagcacgaagcatattgtctctacagttggaccagcggtcattacattttttctgttagtgcttgggttccntatgntgccntgattggcatccttccatttggcaccacattccctttcagtataagaatatccgtttggtcactctttgcacaaacatttctaccggctatgcctttgtttgctttggacaaggctacccccagccggggaaatgccgggttgttcagggtggggtgcccccctgtaacggcccccaaagattttttccccttcctggcccggcctaatgtttttccaccccaaacctcccctttaaccttggtttggaccccctttttttggggcccctttaaaagtgcccccatttttctacccccccttttttataaccctttttttttgcgggaaatctggggagaaccccttgttaggggttgtagaaaaacacaaaggggcccccttttctctttttaatagaaaattttttgggggattttttttacaaccccccgtgttccgcgccggaattttttgtaaaattttttggttgggggggcg

SEQ ID NO: 73723 - DNA, 876 bp, Zea mays
  misc_feature: Ceres CLONE 1558090
  misc_feature: Translation starting site: 218
  misc_feature: SWISSPROT Homolog: EC 3.6.1.1 Inorganic diphosphatase
ctccccgcggtggcggccgctctagaactagtggatcccccgggctgcaggaattcgtctcacccctagaaaaaatcacatttgattcgagccagtcagccagccccggagccctggacagcagcagcgaactcgaggccgctccgccacctcgccactcgcctcttctcgctctcgccaccgggccagggaagggaccatccggatcggctccgtcatggctggagctgctgctctcaatgagggtatcctttcttccgtgtccgagaaaaatgttgctgctcacccatggcatgatttggagataggaccagaggctcctgaagtgttcaattgtgtggctgagattcctagacgcagcaacgttaagtatgacgtggacaagatatctggatctgatcaacgtggatcgtgtccctttactcctctgttgtttacccacataactatggtttcattccacgcacactctgtgaggatagcgaccccaatgaacgtccctcgtactgatgcaggaacaaggtggtccctgggtggtttcttgcgcagctcgggctattgggcctctcgcctttgatccaatcagggtgggaaaaatgaaaaaaaccatacctgtccgggggggatgacccctaaaattccggccctcccaagggaaatttgggaagcccccccccggaaatgcctttttaaaaaaaccccccccccttttttggggatatttttttaacccgggtggaaaacccccaaaaaattctcgcgggggaaaagattttctcccccccccgcgcccaaaaaattaccctcttcagaaggaaccccacggcgcccccccgggggggggagggtttttgttcccccccctaaaggagaacg

SEQ ID NO: 73724 - DNA, 890 bp, Zea mays
  misc_feature: Ceres CLONE 1558091
  misc_feature: Translation starting site: 174
  misc_feature (788)..(788): n is a, c, t, g, unknown, or other
  misc_feature (874)..(874): n is a, c, t, g, unknown, or other
ctggagctccccgcggtggcggccgctctagaactagtggatcccccgggctgcaggaattcgtctcacccctagaaaaaaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggcccatggtggtgcgcaagccggcgcacctgttcctggacgagctgggcgtggcgtacgacgaggccgaggactacgtggtcatcaagcacgccgcgctcttcacgtccacggtcatgagcctgctcctggcgcgccccaacgtcaagctgttcaacgccgtgggccgtggaggacctcatcgtcaggggaaggcgcgtcggcngcgtcgtcaccaactggggcgctcgtgtccatgaaccacgacacgcagtcctgcatgggaccccacgtcatgggaggccaagtccntggtcagctcctgcgg

SEQ ID NO: 73725 - DNA, 886 bp, Zea mays
  misc_feature: Ceres CLONE 1558092
  misc_feature: Encodes the peptide sequence at SEQ ID NO. 73726
ctggagctccccgcggtggcggccgctctagaactagtggatcccccgggctgcaggaattcgtctcacccctagaaaaactcctctcccgtctgcgttcccgtggcgcacatctagccgtcgtcgtcgtcaagaaaggaggcgacaatgacgaggaggcgccgcatccgcagccactgccgctggcacagccgccgccggcgttcggggacaccacgctcaccaaggtgttcgtgggcgggctggcgtgggagacccacgagggcgccctccgcgggcacttccagcgctacggcgacatcctcgaggccgtcatcatctccgacaagctcaccggccgctccaagggctacggcttcgtgacgttcaaggaggcggacgcagccaagaaggcgtgcgaggatgccacccccgtcatcaacggccgtcgcgccaactgcaacctcgcctccctcggcgccaagccgcgggcccagccgctgcagcacgtcctccgcccctcgccgccgcacgcgcatgcgctcccctctcctcaccagcccacgccagccatcgcggtgggatccaggagcgtgtcgccggtgccatggtactaccacccctccacgacgcgccctccgccgccgccggccgcgcaccagcagtaccacggcgtgctcccgttctaccccgccgccgccacctacgggtactccccgaactacgtcacggacctgagctacaatgcgaaggtaggccaagcggcagctgcgggcacggcggccgggtcctacctacagctacagggccactttggcgtaccaggcggcggcagcgcagggcggcatggtggcgccccggcgcatggtgcccgtgtacccgtttctacactacccgtacacgcctc

SEQ ID NO: 73726 - protein, 294 aa, Zea mays
  misc_feature: Ceres CLONE 1558092
  misc_feature (76)..(146): Pfam Name: RRM_1 Pfam Description: RNA recognition motif. (a.k.a. RRM, RBD, or RNP domain)
GAPRGGGRSRTSGSPGLQEFVSPLEKLLSRLRSRGAHLAVVVVKKGGDNDEEAPHPQPLPLAQPPPAFGDTTLTKVFVGGLAWETHEGALRGHFQRYGDILEAVIISDKLTGRSKGYGFVTFKEADAAKKACEDATPVINGRRANCNLASLGAKPRAQPLQHVLRPSPPHAHALPSPHQPTPAIAVGSRSVSPVPWYYHPSTTRPPPPPAAHQQYHGVLPFYPAAATYGYSPNYVTDLSYNAKVGQAAAAGTAAGSYLQLQGHFGVPGGGSAGRHGGAPAHGARVPVSTLPVHA

SEQ ID NO: 73727 - DNA, 992 bp, Zea mays
  misc_feature: Ceres CLONE 1558093
  misc_feature: Encodes the peptide sequence at SEQ ID NO. 73728
  misc_feature (632)..(632): n is a, c, t, g, unknown, or other
  misc_feature (693)..(693): n is a, c, t, g, unknown, or other
  misc_feature (705)..(705): n is a, c, t, g, unknown, or other
  misc_feature (836)..(836): n is a, c, t, g, unknown, or other
ggagctccccgcggtggcggccgctctagaactagtggatcccccgggctgcaggaattcgtctcacccctagaaaaaacgagcacatgccaagcggctctctggacaggcatctgttcgatcgggaccagcagccgggtgtcctgagctgggacgccaggtaccagatcgctctcggggtcgcgagggggctggactacctgcacgagaaatgcagggactgcatcatccactgtgacatcaagcccgagaacatcctcctggacgacgcgttcgtccccagagtcgccgacttcgggctcgccaagctcatgggtcgcgacttcagccgcgtgctcaccaccatgcggggcacggtggggtacctggcgcccgagtggatcgccggcacggccgtcaccaccaaggcggacgtgttcagctacggcatgatgctgttcgagatcatctcgggccggaggaatgtcggccagcgggcggacggcacggtggacttcttcccgtccacggccgtcaaccggctcctcgacggcgacgtgaggagcgcggtggacagccagctcggcggcaacgcggacgtggccgatgtggagcgcgcctgcaaggtggcgtgctggtgcgtgcaggacgcngagagcttgcgccgagtatggggaatggtggtgcaaggtcccgggaaggggctggtcaacntcaatgccccgncccgtcccgaggtcgctcatggtgctcgacgatccgtcccagtacgccgttgagtgctttctaaggtttgccgtcaacctgagattggggccctgccctctgcctgtatggggcactcactttggtccgcnagtccatgggggattatccaaccaatgggttcggtaaagaacttatccctgccccgaacccgggggggggttaaaattcctgccgtgccaaaaaaattcggaatctgttgggcttttcggtcccccccaccagggggaaaaaaagagaggttaatt

SEQ ID NO: 73728 - protein, 223 aa, Zea mays
  misc_feature: Ceres CLONE 1558093
  misc_feature (1)..(190): Pfam Name: Pkinase Pfam Description: Protein kinase domain
  misc_feature: SWISSPROT Homolog: EC 2.7.11.1 Non-specific serine/threonine protein kinase
  misc_feature (203)..(203): Xaa is any aa, unknown, or other
  misc_feature (207)..(207): Xaa is any aa, unknown, or other
MPSGSLDRHLFDRDQQPGVLSWDARYQIALGVARGLDYLHEKCRDCIIHCDIKPENILLDDAFVPRVADFGLAKLMGRDFSRVLTTMRGTVGYLAPEWIAGTAVTTKADVFSYGMMLFEIISGRRNVGQRADGTVDFFPSTAVNRLLDGDVRSAVDSQLGGNADVADVERACKVACWCVQDAESLRRVWGMVVQGPGKGLVNXNAPXRPEVAHGARRSVPVRR

SEQ ID NO: 73729 - DNA, 931 bp, Zea mays
  misc_feature: Ceres CLONE 1558094
  misc_feature: Encodes the peptide sequence at SEQ ID NO. 73730
  misc_feature (658)..(658): n is a, c, t, g, unknown, or other
ctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtctgcgccggcgccagcgaggcgggtcttcaagcccgttgccatcgcggtgtcatcggagtacgggaccgagggcgcggagcagcacgacggggagttctccgaggacctcaagctgttcgtcggtaacctgccgttcagcgtctacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtctagcaattcaacggttatacatttcaagtaagacctctgagggtgaactgggggccaccgccacctagagatggatcccgcccaagagcaccaaggggtggtggttggtggccgcnagcgccatcagctttggcaattcagggaacaaggataccgtggggaaaccttcatggggcgttgacaaccccaacccggaaaaaccttttcatgggaaagggacgggggctggaagcctaaaggcctccacccacaaggataccggccgggtaaagggggtttggtttctcccccaagggctccgcccaggaaggaaacaaaggccataacaaaccttggtggggaaaacactgcaggggagaaaaaaccccaccccgggtggcaaatacaaa

SEQ ID NO: 73730 - protein, 135 aa, Zea mays
  misc_feature: Ceres CLONE 1558094
  misc_feature (79)..(136): Pfam Name: RRM_1 Pfam Description: RNA recognition motif. (a.k.a. RRM, RBD, or RNP domain)
MAAALFSTSLSPRFLALSSPKPAAPAASAFLPFTLPLRSVSAPAPARRVFKPVAIAVSSEYGTEGAEQHDGEFSEDLKLFVGNLPFSVYSAQLAGLFEQAGSVEMVEVVYDRMTGRSRGFGFVTMSSAEEAGAAV

SEQ ID NO: 73731 - DNA, 1007 bp, Zea mays
  misc_feature: Ceres CLONE 1558095
  misc_feature: Encodes the peptide sequence at SEQ ID NO. 73732
tggagctccccgcggtggcggccgctctagaactagtggatcccccgggctgcaggaattcgtctcacccctagaaaaaacagcgggagtcctccccgactccccgagagatttgctgcccagagccttcgaatcgggttcaatcccgtcgatctttctgcccgccgccgccacgggactccagaagttgccttcgattcggccggggccgtggaagcggggatggggctcggagaggcggcggggcggctcctggcggcgtgggactgggagcgcgaggcctaccctgcgtacgacgacttcctcgcgctccccgccttcgttctcttcttccctaccgtccgcttcctcctcgaccgcttcgtcttcaagtgggttgcaatgaggcttatacatgggcagggacatcagagagctaataatgaaacagaagaggcaaggaagaagataagaaaattcaaggaatcagcttgcgaaatgtgtttatgtccctgtctgggagagcttttatctttgtctgtcacatattatgagcctgggttcacccaatacagatattttttgggtaggaccaggagaacaggtcctggcctgacccaaaggaaaaattgaaaccttagggtgtattatttgtatgcctgctggaatccttcccatttttccatattggcccttttgtttttggggaaaaaaaggcttccaaaactttggaatggggaaggtcccccccagggtgggccccgggtggtccgaaatggccaaacctaacgggtcaaaattggcaaagggtggggccctaaaatagggcaatttccggagtgaaagtgcacgttcccgggagaggggggaaataccccaactccccccttgggagagggggctgcccaagggtccctctccgtttttgttatatttgggggggttcttcccccccccaatttttcctttctgggctcgaaaagacaccactaagaggtttgtgtgttgtgaaaaaaaaaacaactttt

SEQ ID NO: 73732 - protein, 129 aa, Zea mays
  misc_feature: Ceres CLONE 1558095
MGLGEAAGRLLAAWDWEREAYPAYDDFLALPAFVLFFPTVRFLLDRFVFKWVAMRLIHGQGHQRANNETEEARKKIRKFKESACEMCLCPCLGELLSLSVTYYEPGFTQYRYFLGRTRRTGPGLTQRKN

SEQ ID NO: 73733 - DNA, 951 bp, Zea mays
  misc_feature: Ceres CLONE 1558096
  misc_feature: Encodes the peptide sequence at SEQ ID NO. 73734
  misc_feature (470)..(470): n is a, c, t, g, unknown, or other
  misc_feature (477)..(477): n is a, c, t, g, unknown, or other
ctccccgcggtggcggccgctctagaactagtggatcccccgggctgcaggaattcgtctcacccctagaaaaaattccattccatcccatcccattttgcagctcctccttccgtgctcgctgcgccctcctgcttccacccccggcagcggcaggggcaggaggagacgacggtcgccaccggcgccctgcaccggcggatgtcggatcgggagctccgccccctgcgctccatcagaatcacaggggacggtcgatgcctgttcaggtccgtcgcctacggcgcctgcctgaggagaggaaagcatgcgcccagcgacagcgcccagaaggaactggccgacgagctccgagccaaagtagctgatgagttcgtcaagcgaagaggagacaccgaatggttccttgaacgcagctttgagagttatgtgagacagatgagaaagcctcatgctttgggagggaaccntgagctngtcatgtgttcccacgttctcaggatgcccatcaccgtctacatgtatacgggcagctccgacgggccaaggatcatagcggattacgggccaggaatcggaaaggacgatccggtccgggttctctacgaaggctacgggccctacgacgcacttcagccattttttggtaagaacccatcctcgaaacggccagggttttagggccaccggggggtggcctcccaaacctctttctagggaaagcgtcctattggaaacccttcccaaaaatttgccacccttttttttttcccgccccaccaacccggaggccaaaaaaaaaagggcgggggtttaagggccccccccttggtgtcgtaaaggggttggtttaaaaccccccccaaaaaaaccccccccccgccaaaaaaaatgggggccccccgggcccccccccttttgggacccccgttatatttctctttttttttt

SEQ ID NO: 73734 - protein, 159 aa, Zea mays
  misc_feature: Ceres CLONE 1558096
  misc_feature (15)..(138): Pfam Name: OTU Pfam Description: OTU-like cysteine protease
  misc_feature (90)..(90): Xaa is any aa, unknown, or other
MSDRELRPLRSIRITGDGRCLFRSVAYGACLRRGKHAPSDSAQKELADELRAKVADEFVKRRGDTEWFLERSFESYVRQMRKPHALGGNXELVMCSHVLRMPITVYMYTGSSDGPRIIADYGPGIGKDDPVRVLYEGYGPYDALQPFFGKNPSSKRPGF

SEQ ID NO: 73735 - DNA, 882 bp, Zea mays
  misc_feature: Ceres CLONE 1558097
  misc_feature: Encodes the peptide sequence at SEQ ID NO. 73736
ggagctccccgcggtggcggccgctctagaactagtggatcccccgggctgcaggaattcgtctcacccctagaaaaagctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggaggtgctggagaagtgggtgcgcgtggacttcaaggagcccgtgtggttcaaggccggcgcgcagatcttctcggagggcgggctggactacctgggcaaccccaacctggtgcacgcgcagagcatcctggccgtgctcggcttccaggtcatcctcatgggcctcgtcgagggcttccgcatcaacggcctcgacggcgtcggcgagggcaacaacctctaccccggcggccagtacttcgacccgctgggcctcgccgacgaacccgtcaccttcgccgagctcaaggtcaaggaaatcaaaaaagggcgcctcgccatggtcttcatgttcgggcttctcgtccaggccatcgtcaccggcaagggggccctctagaaactggttcaacaactcgaagaacccgtggccaa

SEQ ID NO: 73736 - protein, 246 aa, Zea mays
  misc_feature: Ceres CLONE 1558097
  misc_feature (69)..(239): Pfam Name: Chloroa_b-bind Pfam Description: Chlorophyll A-B binding protein
MASTIMAATSRIVAAKTPFLGQGRAAAAAANASPLRDVAAAAAGGRITMGNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVILMGLVEGFRINGLDGVGEGNNLYPGGQYFDPLGLADEPVTFAELKVKEIKKGRLAMVFMFGLLVQAIVTGKGAL

SEQ ID NO: 73737 - DNA, 878 bp, Zea mays
  misc_feature: Ceres CLONE 1558098
  misc_feature: Encodes the peptide sequence at SEQ ID NO. 73738
  misc_feature (745)..(745): n is a, c, t, g, unknown, or other
tccccgcggtggcggccgctctagaactagtggatcccccgggctgcaggaattcgtctcacccctagaaaaaaggttccaaactcgcgcatcggtcggcaggcgcgtcgtgtggaccagaaagggagcgaaatcctactcggcgcacggggtccgcaagcttttcgtcgcctcgattcgcttccgccccatcctccttcccgacgcctcacatggcaacggccgtgcccgccgcctgcctccgcgcgccgtgctcctctccagcggccgtcgcacgccgacttggggccggtggcccgtcgctgcgcaagcggcattgcgccgtcgcgcccgtcgctgccgcctgcggccccgcgccgccgcggctgcttgacaacgaggaggcggtctgctccgtacggcggcgtgtgctggttgccggtgccgccgcgttcctctcccggcctaatccggcggcattcgcagcagaggctaagaaagggttcctgcccgtcgtcgacaagaaggctggctactctttcctctacccgttcggatgggaggaagtggctgtgcaagggcaagacaaggtgtacaaagatgtgatagagcctctcgagagtgtgagcgtcaactctattccaactagcaaggaggatatccgtgatcttggtcctccggataaggttgccgaggctctgattaaaaaggttttggcaccatcaacacagaagacaaagttaattgaggcgaaagagaatgatgnttgatgggagggcttactacacttttgagttcacagctcaggctcccaactacaccagacatgcactttggtgctattgtaattgcaaatggcaaattttacacattgaccactgggagcaacgtagaggagt

SEQ ID NO: 73738 - protein, 177 aa, Zea mays
  misc_feature: Ceres CLONE 1558098
MATAVPAACLRAPCSSPAAVARRLGAGGPSLRKRHCAVAPVAAACGPAPPRLLDNEEAVCSVRRRVLVAGAAAFLSRPNPAAFAAEAKKGFLPVVDKKAGYSFLYPFGWEEVAVQGQDKVYKDVIEPLESVSVNSIPTSKEDIRDLGPPDKVAEALIKKVLAPSTQKTKLIEAKEND

SEQ ID NO: 73739 - DNA, 984 bp, Zea mays
  misc_feature: Ceres CLONE 1558099
  misc_feature: Encodes the peptide sequence at SEQ ID NO. 73740
ctggagctccccgcggtggcggccgctctagaactagtggatcccccgggctgcaggaattcgtctcacccctagaaaaaatacctgtcactcacgctaccgccgtgaccgatcatctctcactctctcgtcagatcctctcggctagctagctagctaggacagaggagggaggggaaggcgctggctatggcgactgcggcggcggcggcggcggcggccatggaggagccggacgtcgtcaacggccgcgacgtggtgagctgggtggcgtccggggtggtgctgtggtcgaccgccttcttgctggtgcgggcgctgttccccaagcgctcctacgacttctgcaaccgcgccgtctccaccatgcacgccgtcgccgccgtgtgcctcgcctgcctctccgtcgacgactggtcgtgccccgtctgcccgctcgccgccgcatcctcccgtcgccagatgaaggcgctggcggttacgctggcgtacatggtgtacgacgcggcgtgctgccacctcaacggcgacacgcggctggacaacgccgtgcaccacctggtcagcatcgtcggcatcggcgcggggctcgcctaccagaggtgcgggacggagatggtggccagcatgctcgtgacggagatgtccagcccgctgctgcacctgcgggagatgctcaggtagctgggcgtgcgggacacggagctgaacctcctcgtcgacgtgctcttcgccgccaactttctccgcgcccggaatgggcgtcgggccgttacctcacctacgtcaccgtgacgggcgaacacccccttcctcattaagccaatggcaaacgggcctgcaacttggggacccccctccgggtcctggggattcccccggagtggcagggtccaacccccccgaaaaaaaaagccaaccccggccaaatttcccccccccccccccccaatgaaatataatagccccccgaaccaccttcct

SEQ ID NO: 73740 - protein, 164 aa, Zea mays
  misc_feature: Ceres CLONE 1558099
MATAAAAAAAAMEEPDVVNGRDVVSWVASGVVLWSTAFLLVRALFPKRSYDFCNRAVSTMHAVAAVCLACLSVDDWSCPVCPLAAASSRRQMKALAVTLAYMVYDAACCHLNGDTRLDNAVHHLVSIVGIGAGLAYQRCGTEMVASMLVTEMSSPLLHLREMLR

SEQ ID NO: 73741 - DNA, 928 bp, Zea mays
  misc_feature: Ceres CLONE 1558100
  misc_feature: Encodes the peptide sequence at SEQ ID NO. 73742
  misc_feature (482)..(482): n is a, c, t, g, unknown, or other
agctccccgcggtggcggccgctctagaactagtggatcccccgggctgcaggaattcgtctcacccctagaaaaaagccgcatcccttctttcattcgccgccgccgcctgctctctgctgccgtcgccatggggagaaggcctgcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaagaaaggatgccttccaccttcgggtccgggttcacccctttcatgtccttcgtatcaacaagatgctttcgtgtgctggggctgataggctccagactggaatgaggggtngcctttggcagcctcagggcacctgtgctagggtgaacattggtcaagtcctccctttctggtcgattgcaagaccacaatgctgcacatgccagttgaagctctgcctcccgccaagtgcaagtttcccgtggccgccaaaaaattttgaaaggcagaagtggggcctccaccaatttagccgttgccgactacccgaaagacaaaaggggggggtaaaattgtccccgaagggggccaaccaaaggggccccgggaccctggaaaaatttgaaaaggcggccccgggaaaaggtttcccccggggcctttgctaaagcccaacccacgtgggaatggaaccccaacgttttgtgtggaccccctcttttttttttttgccccaaaattataggtggtggggggtaaacacccccttttgaaaaaccgatttttcggggagaaaa

SEQ ID NO: 73742 - protein, 222 aa, Zea mays
  misc_feature: Ceres CLONE 1558100
  misc_feature (5)..(162): Pfam Name: Ribosomal_L16 Pfam Description: Ribosomal protein L16
  misc_feature (118)..(118): Xaa is any aa, unknown, or other
MGRRPARCYRQIKNKPYPKSRYCRGVPDPKIRIYDVGMKRKGVDEFPYCVHLVSWEKENVSSEALEAARIACNKYMTKSARKDAFHLRVRVHPFHVLRINKMLSCAGADRLQTGMRGXLWQPQGTCARVNIGQVLPFWSIARPQCCTCQLKLCLPPSASFPWPPKNFERQKWGLHQFSRCRLPERQKGGVKLSPKGANQRGPGTLEKFEKAAPGKGFPRGLC

SEQ ID NO: 73743 - DNA, 984 bp, Zea mays
  misc_feature: Ceres CLONE 1558101
  misc_feature: Encodes the peptide sequence at SEQ ID NO. 73744
  misc_feature (960)..(960): n is a, c, t, g, unknown, or other
  misc_feature (961)..(961): n is a, c, t, g, unknown, or other
gcggtggcggccgctctagaactagtggatcccccgggctgcaggaattcgtctcacccctagaaaaaagggttccgccgcgcctctccaaccaggcgccactcgccagggcctaggctggtcatggaaggaaacgccgcagccgggaagaggtcccggacggagacggcgaacggggctgccggcggcgggaagcgctccaaagacatggagtcatttcaaactggtctatcaagcaaatcgaagccttgcaacaagtttttcagtacgattgggtgcccgtttggtgagggatgtcgttttctgcactttgtccctggcggttacccggcagttgcaaaaatgctcaatctaggtagccctgctgtatctgcgcccatcagaactcatgtggatcacgccgctcttactggcgcctctcattcagcttcgtcaggcaagacacgcatgtgcaccaagtacaatactacagaaagctgcagatttggtgattagtgccactttgctcatagcgaaagaaaacttgggaaaacagcgtacatgcctttaggaaaaactccttatgggcggtcgaatttggaggccaacctgaaccggtggacccaggctgcactgggccccccccgaaggaaactttgggggcccccgcgaacgcccaaaaaacgggggggagcgccttcctggccggggggtataatgtggtagggggggggggccacccttaccctataaaccaattttggggggtaatctttttttcccccaacccatttttctcccccaccgagaaaaaaatttggggggagaggtttttttaccaataaaacacccccgcaaaaattgtgggggacctctccccccacccaaagggaggtggggggaaaaaaattttttgtggggggcccccatagggaaaaaaagggggggtggggggagaggggcaaccaacaaaaatttgtnnaacactgggggagaggggttcct

SEQ ID NO: 73744 - protein, 123 aa, Zea mays
  misc_feature: Ceres CLONE 1558101
  misc_feature (38)..(64): Pfam Name: zf-CCCH Pfam Description: Zinc finger C-x8-C-x5-C-x3-H type (and similar)
MEGNAAAGKRSRTETANGAAGGGKRSKDMESFQTGLSSKSKPCNKFFSTIGCPFGEGCRFLHFVPGGYPAVAKMLNLGSPAVSAPIRTHVDHAALTGASHSASSGKTRMCTKYNTTESCRFGD

SEQ ID NO: 73745 - DNA, 950 bp, Zea mays
  misc_feature: Ceres CLONE 1558102
  misc_feature: Encodes the peptide sequence at SEQ ID NO. 73746
  misc_feature (682)..(682): n is a, c, t, g, unknown, or other
  misc_feature (738)..(738): n is a, c, t, g, unknown, or other
  misc_feature (814)..(814): n is a, c, t, g, unknown, or other
  misc_feature (870)..(870): n is a, c, t, g, unknown, or other
  misc_feature (875)..(875): n is a, c, t, g, unknown, or other
  misc_feature (883)..(883): n is a, c, t, g, unknown, or other
  misc_feature (942)..(942): n is a, c, t, g, unknown, or other
ctccccgcggtggcggccgctctagaactagtggatcccccgggctgcaggaattcgtctcacccctagaaaaaatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtacacctcggatgttaacattgtttccaatgctagctgcaccacaaactgccttgctccccttgctaaggtcattcatgacaacttcggcattgttgagggtttgatgancaactgtcatgccatcactgccacccagataactgttgacggaccctcagccaggnactggagaggtggcagggctgccagcttttacatcattcctagcagcaccggtgctgccaaggctgttggtaaagntcttcctgatctgaatggcaagctcactggtatgtccttccgtgtccctacgtggnatgtntcggttgntgacctccacgtcagaatcgagaagggggcctcctatgaggtattcagaaagcttttanggctgctc

SEQ ID NO: 73746 - protein, 267 aa, Zea mays
  misc_feature: Ceres CLONE 1558102
  misc_feature (4)..(154): Pfam Name: Gp_dh_N Pfam Description: Glyceraldehyde 3-phosphate dehydrogenase, NAD binding domain
  misc_feature (159)..(267): Pfam Name: Gp_dh_C Pfam Description: Glyceraldehyde 3-phosphate dehydrogenase, C-terminal domain
  misc_feature: SWISSPROT Homolog: EC 1.2.1.12 Glyceraldehyde-3-phosphate dehydrogenase (phosphorylating)
  misc_feature (178)..(178): Xaa is any aa, unknown, or other
  misc_feature (197)..(197): Xaa is any aa, unknown, or other
  misc_feature (222)..(222): Xaa is any aa, unknown, or other
  misc_feature (241)..(241): Xaa is any aa, unknown, or other
  misc_feature (245)..(245): Xaa is any aa, unknown, or other
  misc_feature (265)..(265): Xaa is any aa, unknown, or other
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMXNCHAITATQITVDGPSARXWRGGRAASFYIIPSSTGAAKAVGKXLPDLNGKLTGMSFRVPTWXVSVXDLHVRIEKGASYEVFRKLLXLL

SEQ ID NO: 73747 - DNA, 949 bp, Zea mays
  misc_feature: Ceres CLONE 1558105
  misc_feature: Encodes the peptide sequence at SEQ ID NO. 73748
ggagctccccgcggtggcggccgctctagaactagtggatcccccgggctgcaggaattcgtctcacccctagaaaaaaccagaagctcactcgctgctcgttgccggctgcccccgcccactccaccgctgatatttgtcatcgtctcgttcctgccctctgccctccccaactccagcaggcagatcagatacatccattcgcggaccggaagtaatcatcaggaaaggaaagggttgaaccatgagcgccgtggctgtttcgtcttctctgaacccggacgcgccgctcttcatcccggcggcgctgctgcaggtggaggacttctcgccgcagtggtgggacctcatcaccaccactgcctggttccgcgaccactggtcccgcgagcgcgcccacctggacgagatggccgagcagatcgacgctgccggcctccccgacgacgaagacctcttctacgacgaccagcccgagcagggccccgtcgctgccgcccttaagacagattcggtgctcaaggcgctgaacatgacctccccgaagggcggcggcgacgccccgcgggggttccgggagaaacccttgaacgccgagaagccgaccaagtacgcctgcagccccaagagcagcgccccccgcgtgatccaccagcctcgctaggttcgctgggggaactcatcaggaatgctgctgaccctcttgcagccttgctcctagatgccgacgctgtcgtggtctgctccttcaaggcaaagtacgggtgggtcgagtcagtggatagcgtggctccgactgtagaagtgcctcttgtatagcaagcaagtaataaaacgaccaagatataacaaaatgcagctgttagttactgctgctctctaagcgtggtcagtcatccggtgtgtctgggaaccccttaaaaagggtgaggtggatcccatccatggg

SEQ ID NO: 73748 - protein, 139 aa, Zea mays
  misc_feature: Ceres CLONE 1558105
MSAVAVSSSLNPDAPLFIPAALLQVEDFSPQWWDLITTTAWFRDHWSRERAHLDEMAEQIDAAGLPDDEDLFYDDQPEQGPVAAALKTDSVLKALNMTSPKGGGDAPRGFREKPLNAEKPTKYACSPKSSAPRVIHQPR

SEQ ID NO: 73749 - DNA, 959 bp, Zea mays
  misc_feature: Ceres CLONE 1558107
  misc_feature: Encodes the peptide sequence at SEQ ID NO. 73750
  misc_feature (959)..(959): n is a, c, t, g, unknown, or other
agctcaccgcggtggcggccgctctagaactagtggatcccccgggctgcaggaattcgtctcacccctagaaaaaaagtttctctagccaggcctcaaacaatgatacaacacctcacttacaaaacatgacctttaacgctaccactatatgagcgagaacgaggaggcaggagaaatatatagtgagaggaatcaataccaccatactgtgacgtcctctcctcctccgatgagaaagagatgatgagggagggcgatgcatgtgttacgcttctaagaagcaagctccatggcctggtcgagaggaaccgtgctctggaagaggagaacaagcaactgagacaccaagtgagccgactaaaaggtcagatctcttctctcgaaggccaggacactgacaagaggatgctatggaagaagctgctggagagttctgcgaccagcatcagctactccaaggagaagcagtttgtccaaagcaacgatgacgcgaaggaagccacggatctcagcagctcactgtgtcacagaaggcagcagcagttctccagggtagcactcgtgagatcaagggcgccaagggttccgaatccaccgcccaatccgacatgcacccagccaaagacaaccgtccgaaaggaaggatgcatggcccctcctcctcctccaccacctgcgctacctttccagttgcagaggagcgcataggcgatacaaagggtgcccgaggtagtcgagctgtaccggtcgttggtgcggcctgaacgcaaaacgatgcgaagtcctggatccgtaggaattccagcagcgacgagcagcagagagatcgattgggggagatgagtacagatcagcttatgttgttagcctgtaagtacatgttttatttattttcctgccatgtcaaaccatattctgttgttagcgaattggtctaacttttctgccgaatcccn

SEQ ID NO: 73750 - protein, 155 aa, Zea mays
  misc_feature: Ceres CLONE 1558107
MMREGDACVTLLRSKLHGLVERNRALEEENKQLRHQVSRLKGQISSLEGQDTDKRMLWKKLLESSATSISYSKEKQFVQSNDDAKEATDLSSSLCHRRQQQFSRVALVRSRAPRVPNPPPNPTCTQPKTTVRKEGCMAPPPPPPPALPFQLQRSA

SEQ ID NO: 73751 - DNA, 946 bp, Zea mays
  misc_feature: Ceres CLONE 1558109
  misc_feature: Encodes the peptide sequence at SEQ ID NO. 73752
  misc_feature (799)..(799): n is a, c, t, g, unknown, or other
  misc_feature (806)..(806): n is a, c, t, g, unknown, or other
ggagctccccgcggtggcggccgctctagaactagtggatcccccgggctgcaggaattcgtctcacccctagaaaaaaacacgtcgcggcctcgctaacgcgcccgcgctagcgcgagtggtggcacccacgcacactcttctccccccagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggacgccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaagcccaaggcgagcacggagtacatcgcgtacagcggcgacggcttcaagctgctgatcccgtccaagtggaaccccagcaaggagcgggagttccccgggcaggtgctccgctacgaggacaacttcgacgccaacagcaacgtgtccgtcatcatccagcccacgtccaagaagaccatcgccgactacggctctcccgaggagttcctctcccaggtcgactacctgctcggcaggcaggcctacggcggcaagaccgactccgagggcgggttcgagaccggcgccgtggccaccgccaacgtcctggagagctccacccccgtgatcgacagctagcagtactacaccatgtccgggctcaccangacggcngacggcgacgaaggcggcaagcaccagctcatcgcgggcaccgtctccggacggcagctctacatctgctaggcgcaggccggcgaatagaggtgggtcaagggcgccaggaagggagtcgaggatgccgcctcctcctt

SEQ ID NO: 73752 - protein, 197 aa, Zea mays
  misc_feature: Ceres CLONE 1558109
  misc_feature (57)..(198): Pfam Name: PsbP Pfam Description: PsbP
MASTSCCLLHQSTARLGASPRLAAAPPRSAQLLVCKARKQDAAADQSDVSRRAALALLAGVTAAAGAKVGPAAAAYGEAANVFGKPKASTEYIAYSGDGFKLLIPSKWNPSKEREFPGQVLRYEDNFDANSNVSVIIQPTSKKTIADYGSPEEFLSQVDYLLGRQAYGGKTDSEGGFETGAVATANVLESSTPVIDS

SEQ ID NO: 73753 - DNA, 907 bp, Zea mays
  misc_feature: Ceres CLONE 1558110
  misc_feature: Encodes the peptide sequence at SEQ ID NO. 73754
  misc_feature (833)..(833): n is a, c, t, g, unknown, or other
ctccccgcggtggcggccgctctagaactagtggatcccccgggctgcaggaattcgtctcacccctagaaaaaaaccaacaaatgcacatcgtctgttctctctcttcttaacctccccaccctcttcctccactcaaatcatcttcctcctcttctctcctctcctcttactcttccccaccaacgccaccaaaaccaacactccgatggatgttttcaccaagcaactcctccccatgcctcaccagcgggaccccaactacccttcctcttccacctcttcctcctcgtcgtcgtcctcctccacgcccccatctcgccctcaccaccgtgcgcaaccccagccccacaacctcccccagtcccccagacccgtcccgcgcaccatcgacaccaccccgttccccaccaccttcgtccaggccgacaccacctcgttcaagcaggtcgtccagatgctcaccggcgccgagcagccggccaacaacgacgcgacgacggcgggcgcagccgctgccgctgccgccaacggcggtggcgccggcgcccaggcggccagcggtggaccgtgctgccggcccaagaagccgtcgttcaagctgtacgagcggcggagcagcctgaagaacctgaagatgatcgcgccgctggggatggggtcgccgccgtcgccgtcgccgcggagggcggcgccggagatcctgtcgccgagggtgttggactttccgtccctcaagctcagcccggggacgccgctcggcgggaaacccctttaacgcctggccgggggtcggggtcgtccctcgggggggggcgaacggcgccgccatngggcgaaaggggcctcttctcctcctacgggtacggaagggggggcccgaagcccccggcgacctggttccggt

SEQ ID NO: 73754 - protein, 189 aa, Zea mays
  misc_feature: Ceres CLONE 1558110
  misc_feature (64)..(94): Pfam Name: VQ Pfam Description: VQ motif
MDVFTKQLLPMPHQRDPNYPSSSTSSSSSSSSSTPPSRPHHRAQPQPHNLPQSPRPVPRTIDTTPFPTTFVQADTTSFKQVVQMLTGAEQPANNDATTAGAAAAAAANGGGAGAQAASGGPCCRPKKPSFKLYERRSSLKNLKMIAPLGMGSPPSPSPRRAAPEILSPRVLDFPSLKLSPGTPLGGKPL

SEQ ID NO: 73755 - DNA, 1126 bp, Zea mays
  misc_feature: Ceres CLONE 1558111
  misc_feature: Encodes the peptide sequence at SEQ ID NO. 73756
cctttgcgcaaaagagtactctctccctcctaccacacacagcctccggactgctccggacgcgcgcctcagatctactccaacacctgtaaggattcctctggccgtgtggcctttccggcaactatagctagcggcggcgcccgcgggtggaggagcaggagcaggagcggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaatccttgacgagatcagcggtctggaaagaaagagaacgcagctgatcgaggagaactcaaggctgaaggagcaagtgacacggatgtcgaggatggagacgcagcttggcgccgatccagagttcgtgtacgaggaagggcagtcgtctgaatccgtgacgaacacgtcctatccgcgcccgtccaccgacaccgacgactgctccgacacatcgctcaggctcgggctaccactcttcagctccaagtgacggagatttgacatgtccggtagcggagcggtgccgattgcttgcccttctccactctagataggtctggattgggggagagcaagcactgctggatcgggaagacccaagtgaccaacgcgtcgcatcagaataaggcattttgagtgctgtatgatgtgtgtattctggctctgaaagtgagacctgcttttgttataatacatacatacaggcagcatggcaataaaaaaaaaaaaaaaaa

SEQ ID NO: 73756 - protein, 233 aa, Zea mays
  misc_feature: Ceres CLONE 1558111
  misc_feature (13)..(63): Pfam Name: SRF-TF Pfam Description: SRF-type transcription factor (DNA-binding and dimerisation domain)
  misc_feature (73)..(178): Pfam Name: K-box Pfam Description: K-box region
MVGTGKRERIAIRRIDNLAARQVTFSKRRRGLFKKAEELSILCDAEVGLVVFSATGKLFHFASSSMKQVIDRYDSHSKTLQRSEPQSSQLQSHMDDGTCARLKEELAETSLKLRQMRGEELQRLSVEQLQELEKTLESGLGSVLKTKSQKILDEISGLERKRTQLIEENSRLKEQVTRMSRMETQLGADPEFVYEEGQSSESVTNTSYPRPSTDTDDCSDTSLRLGLPLFSSK

SEQ ID NO: 73757 - DNA, 953 bp, Zea mays
  misc_feature: Ceres CLONE 1558115
  misc_feature: Encodes the peptide sequence at SEQ ID NO. 73758
  misc_feature (885)..(885): n is a, c, t, g, unknown, or other
  misc_feature (901)..(901): n is a, c, t, g, unknown, or other
  misc_feature (939)..(939): n is a, c, t, g, unknown, or other
ctggagctccccgcggtggcggccgctctagaactagtggatcccccgggctgcaggaattcgtctcacccctagaaaaactctctgtccctccgctccagccgccgccgccgcctccgccctccgaatcccaatggcgtccgcggccgctcctccaacctccctctccctcgcggcccgcgcggccaccagggcagccgccgccgccgccgccccgctgcgcaagggaggcctcgccacggcgtgccagccggcatggtctctggctttcgcggcgggcgacgcgcggctcgcggtccacgttgcgtcgcgatgccggcaggcgttctccgggcgtggcacgcgggccatggccaccatggcgaagaagagcgtaggggaactcacggaggccgacctcgaggggaagcgcgtcttcgtgcgcgccgacctcaacgtgccgctcgacgagaaccagaacatcaccgacgacacccgcatccgggccgccatcaccaccatccagtacatcctcagcaagggcgccaaggtcatcctctcaagccacttgggtcgccctaagggttttacacccaagtttagcttagctccccttgtaggacagatgtctgagcttcttggcattcaggtgcaaaaagccgacgatgttattggccctgaagttgagaagctggtggcggccttgcccaacggtggggttctgctgcttgagaacgtaagattctacaaggaagaggagaagaatgacccagagtttgcacagaagcatgcctccctagcagatctttatagttacgatgcatttggatcagcccacagggcgcatgcatcggacgaggggtagtacaagtttttgcagcctactgttgcaagtctccttctgcngaaggactcgactacnttgttcgaagctgttcaaccctaaacgccttttgctgncatccggggtggtt

SEQ ID NO: 73758 - protein, 236 aa, Zea mays
  misc_feature: Ceres CLONE 1558115
  misc_feature (77)..(236): Pfam Name: PGK Pfam Description: Phosphoglycerate kinase
  misc_feature: SWISSPROT Homolog: EC 2.7.2.3 Phosphoglycerate kinase
MASAAAPPTSLSLAARAATRAAAAAAAPLRKGGLATACQPAWSLAFAAGDARLAVHVASRCRQAFSGRGTRAMATMAKKSVGELTEADLEGKRVFVRADLNVPLDENQNITDDTRIRAAITTIQYILSKGAKVILSSHLGRPKGFTPKFSLAPLVGQMSELLGIQVQKADDVIGPEVEKLVAALPNGGVLLLENVRFYKEEEKNDPEFAQKHASLADLYSYDAFGSAHRAHASDEG

SEQ ID NO: 73759 - DNA, 971 bp, Zea mays
  misc_feature: Ceres CLONE 1558117
  misc_feature: Encodes the peptide sequence at SEQ ID NO. 73760
  misc_feature (781)..(781): n is a, c, t, g, unknown, or other
  misc_feature (914)..(914): n is a, c, t, g, unknown, or other
ctggagctccccgcggtggcggccgctctagaactagtggatcccccgggctgcaggaattcgtctcacccctagaaaaaacctgcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctcctgcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctcggcctggccgacgaccccgaggccttcgccgagctcaaagtgaaggagctcatgaacggccgcctcngcatgttttccattgtcgagctcctcgtccaggccatcgtcaccggcaaagggcccgctcgagaacctcgctgaacacatcgctgacccagtctacacacgcattgtcctacgccacctaactcgtccccggnaactagctcaacgctatgctatgcacttcatttgcttcggaaacgaaaggtggacct

SEQ ID NO: 73760 - protein, 240 aa, Zea mays
  misc_feature: Ceres CLONE 1558117
  misc_feature (61)..(229): Pfam Name: Chloroa_b-bind Pfam Description: Chlorophyll A-B binding protein
  misc_feature (217)..(217): Xaa is any aa, unknown, or other
MAASTMAISSTAMAGTPIKVGSFGEGRITMRKTVGKPKVAASGSPWYGPDRVKYLGPFSCEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGGPLGEVVDPLYPGGSFDPLGLADDPEAFAELKVKELMNGRLXMFSIVELLVQAIVTGKGPAREPR

SEQ ID NO: 73761 - DNA, 942 bp, Zea mays
  misc_feature: Ceres CLONE 1558119
  misc_feature (908)..(908): n is a, c, t, g, unknown, or other
ctccccgcggtggcggccgctctagaactagtggatcccccgggctgcaggaattcgtctcacccctagaaaaaacgagcacgagactgctcggccgacgaaataataaagcgcgcgcgcgcacgcggagaggctcggagagctgagtgagatggcacaagccatggcgtccatgaccggcctctcgcagggcgttctgcccagcaggcgcgccgccaacagggccaggacggccgccgtcgtcagggcgtccgccgaggcgcaggcgcaggcgcaggcgggccgccgcgccgtgctcgggctggtggccactggcatcgtcggcggcgccttgtcgcacgcggtgcacgccgagaccgtcaagaccatcaagatcggagccccgccgccgccctccggtggactccccgggactctgaactctgaccaggcgagggacttcgacctccccttgaaggagcggttctacctgcagcctctgcctccggcggacgccgtggcgagggtgaagacatctgcgcagagacatcatcgacctcaagccactcatcgactagaaggcgtgggcgtacgtgcagaacgacctccgcctacggggctcctacctgcgatacgacctcaagaccggcatcgcttcctagcgctacgaggagaagcagagcctgcacgagctcaccggcgagctcttcagcaacgtcgacgatcctgaccatgccggaagatctagagccccccggaggccgacgaatactccgcagcaccaaagagcgctcgccgacgtcatcacaagcgagcccagatgaaggctatagatgggtgacaatgcccggcaatttcgaactgtgttggtcatatggagccggaaatagtacgtttccagtcatataaatcacaagtgctggacaaanaaaaatacagcccgggaagggactaggcctatca

SEQ ID NO: 73762 - DNA, 957 bp, Zea mays
  misc_feature: Ceres CLONE 1558120
  misc_feature: Encodes the peptide sequence at SEQ ID NO. 73763
  misc_feature (641)..(641): n is a, c, t, g, unknown, or other
ctccccgcggtggcggccgctctagaactagtggatcccccgggctgcaggaattcgtctcacccctagaaaaattcccacacccctcaccgcgtccgcctcccctaccatctagggtttctagggttttcgaggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttacggcggcggcggtgacccgcggctacggggggaggaagcgaccgtggctacggcggcggcgaccgtggttacggtggaggtggcgaccgcggctacggcggcgaccgcggctgcttcaagtgcggcgaggagggcacatggcaagggactgctcccagggcggcggctacggagggggaggccgccgccgcccccncaccaaatgcttacactgggggcaggaagggcaccttttccgggattgccccaaaaaaggggttaggggcgggccccccgttcgttggatccgggggatccccttttgcctttggccgtttccttaccccccaaaggtatccccggggaactcttggggaaagccccgggaaaaatctttttcattttccccccggcgcctttctttttgccctcgccgggggggtttaaaaaaaggggggggccccccccttctttcctcttaaaaactttaaaagcctcttggtgtgttggcctccccatttttttttatgaat

SEQ ID NO: 73763 - protein, 187 aa, Zea mays
  misc_feature: Ceres CLONE 1558120
  misc_feature (5)..(72): Pfam Name: CSD Pfam Description: 'Cold-shock' DNA-binding domain
MASDRVLGTVKWFNGTKGFGFITPDDGSEDLFVHQSSIKSDGYRSLNDGDAVEYTVGSGNDGRAKALDVTAPGGGPLAGGERPDGGNGGGRGGYGGGDRGYGGGGDPRLRGEEATVATAAATVVTVEVATAATAATAAASSAARRAHGKGLLPGRRLRRGRPPPPPHQMLTLGAGRAPFPGLPQKRG

SEQ ID NO: 73764 - DNA, 958 bp, Zea mays
  misc_feature: Ceres CLONE 1558121
  misc_feature: Encodes the peptide sequence at SEQ ID NO. 73765
ctggagctccccgcggtggcggccgctctagaactagtggatcccccgggctgcaggaattcgtctcacccctagaaaaaaatcaccacacgagagaagagaagctagcgttcaacagaggaagaagcgagagagctgacaagaatcgactgccatcaatggctctggcgccggcgcctctccagtgcttcctcacgagcagcagaccggccgtatgcacggcgacgccgcccaataagcgcgcgaggaggccgtcgaggatctcgtgcagggcgtccggcgatgacaaggacaaggtcccgtcgtcaggagggagcgatcttggggtcaagcagctcgggaagctggccatggtcgcgctggccgccggcgtgctggtgctcggccccgtcaacggtgccatggcggccaagtccggcggcaaggtcggcgggcaggcgttccggtccgcgccccggtcgtccggacctccgatcaacaactccaggaccaacatctacatcaacccgccggtggcgccgccgctgggcggatacgggtacgggagcccgttcttcggcggctactgctacggctggtcgccgttcagcttcttcgcccccgggccgagcgtcgccgtcagggatcggcggcggcttcgacacgctcgtcctcttcttggtgctgggcgccgtcatcggagatgtcacgcggttcctcaacaggaacaacgacgattacgacgactactgattatcagtgccaggctcctgctacgtacttcacctttcgtgtgtatatatatatgacgaaatttttcccgtgcggtatcctaagaacggagtgtactgacgatgcatcaggagatggatgttataattctggtcacagtgaaatgtaatgagcttaacgtcttttagtagggtcagtttgcaacagccaatacgggcataaatcgatcgagccaaaaaaaaaaaaa

SEQ ID NO: 73765 - protein, 209 aa, Zea mays
  misc_feature: Ceres CLONE 1558121
MALAPAPLQCFLTSSRPAVCTATPPNKRARRPSRISCRASGDDKDKVPSSGGSDLGVKQLGKLAMVALAAGVLVLGPVNGAMAAKSGGKVGGQAFRSAPRSSGPPINNSRTNIYINPPVAPPLGGYGYGSPFFGGYCYGWSPFSFFAPGPSVAVRDRRRLRHARPLLGAGRRHRRCHAVPQQEQRRLRRLLIISARLLLRTSPFVCIYI

SEQ ID NO: 73766 - DNA, 963 bp, Zea mays
  misc_feature: Ceres CLONE 1558123
  misc_feature: Encodes the peptide sequence at SEQ ID NO. 73767
  misc_feature (842)..(842): n is a, c, t, g, unknown, or other
  misc_feature (854)..(854): n is a, c, t, g, unknown, or other
ctggagctccccgcggtggcggccgctctagaactagtggatcccccgggctgcaggaattcgtctcacccctagaaaaagaacacagagtcacttcgccacgaacaaaagcgcatcgatctcgctgtcgtcactcctcgtcacccagccacgaacagaggcaccacccatcatggccctgcaagcggcgctcctcccatccaccctctcatccgtccccaagaagtgcagcatcgccgtctcggcgaaggacacggcattccttagcgtatcccagaagaaggtgcaggcggcgtcgctgtcggtgagaacgcgggtggcgacgacggcgcctgtggccacgccggggtccagcacggcggccaatgatgggaagaagaccgtgcggcagggcgtggtggtgatcacgggcgcgtcgtcggggttgggcctggcggcggccaaggcgctggctgacaccggcaagtggcacatggtgatggcctgccgcgacttcatcaaggcgggcaaggcggacaagggcgcctgcatggcggacagcagctacaccatcatgcacctggacctggcctccctcgacagcgtgcagcagttcatggacagcttccagcgcgccggcatgccgctcgactcactcgtctgcaacgccgacatctaccggcccactgcaaggacgccgacattcactgcggacggatacgagatgagcgtctgcgtcaacatctgtggcacttccctctggggcgcctggctctggacgacatgcagatgtcgactacccgtgccggcgctaatcatccgtggctccatgacggcaacaccacagactggacggggaaatncccgccaatgcngggctgggggacctaccggccctcccgtcggtgctgccggtcattaacggctctgcatgatcgacggttcctaaaactccaccgcgcccaagcttaaaaggaagcaata

SEQ ID NO: 73767 - protein, 242 aa, Zea mays
  misc_feature: Ceres CLONE 1558123
  misc_feature: SWISSPROT Homolog: EC 1.3.1.33 Protochlorophyllide reductase
  misc_feature (224)..(224): Xaa is any aa, unknown, or other
  misc_feature (228)..(228): Xaa is any aa, unknown, or other
MALQAALLPSTLSSVPKKCSIAVSAKDTAFLSVSQKKVQAASLSVRTRVATTAPVATPGSSTAANDGKKTVRQGVVVITGASSGLGLAAAKALADTGKWHMVMACRDFIKAGKADKGACMADSSYTIMHLDLASLDSVQQFMDSFQRAGMPLDSLVCNADIYRPTARTPTFTADGYEMSVCVNICGTSLWGAWLWTTCRCRLPVPALIIRGSMTATPQTGRGNXRQCXAGGPTGPPVGAAGH

SEQ ID NO: 73768 - DNA, 957 bp, Zea mays
  misc_feature: Ceres CLONE 1558125
  misc_feature: Encodes the peptide sequence at SEQ ID NO. 73769
ctggagctccccgcggtggcggccgctctagaactagtggatcccccgggctgcaggaattcgtctcacccctagaaaaaactcggaaggctcaccaaatcgtcctacgcttctgcctcctcctccacgaggtgaggaaaccctagcgactgaccatggcgttgctcccgcgcaccgcacggttggccttcctctctaccccgcggtcgtactccgccgccgccgctgccgctgcgggcgcctccccgacctccccagcgccatacgggggcgcgcccccaccggcgatgtcgaagacggccgagttcgtggtctccaaggttgatgacctgatgaactgggcgcgtaagggctcgatttggcccatgaccttcgggctcgcctgctgcgcggtcgagatgatgcacgccggcgcgtcccgctacgacttcgaccggttcggcgtcatcttccgtccctcgccgcgccagtccgattgcatgatcgtcgccggcacgctcaccaacaaaatggctccagccctccgcaaggtttatgaccaaatgcctgagcctagatgggttatttcaatgggcagctgtgccaacggtggtggatactaccattactcctactctgttgtacgtggatgtgaccgtatagtccccgtggacatctacgtccctgggtgcccaccaactgctgaagcactgcctgtacggtgttcttcagctccaaagaagatcaacaggcgtaaggatttccttcacgggtggccaagttgagcatgcttctgcttgtgctcgcttgctacgtttcttgcactcgacctactgtctatctgaaataaggaagactttgctcggatccacaaattgttgtggccggaaagatgtttgcccggttgtgagaaaaattacttgggtacttggaccaagtcccccgtaaggaaacaaaaccggctggaatcggttttta

SEQ ID NO: 73769 - protein, 158 aa, Zea mays
  misc_feature: Ceres CLONE 1558125
  misc_feature (36)..(138): Pfam Name: Oxidored_q6 Pfam Description: NADH ubiquinone oxidoreductase, 20 Kd subunit
  misc_feature: SWISSPROT Homolog: EC 1.6.5.3 NADH dehydrogenase (ubiquinone)
MSKTAEFVVSKVDDLMNWARKGSIWPMTFGLACCAVEMMHAGASRYDFDRFGVIFRPSPRQSDCMIVAGTLTNKMAPALRKVYDQMPEPRWVISMGSCANGGGYYHYSYSVVRGCDRIVPVDIYVPGCPPTAEALPVRCSSAPKKINRRKDFLHGWPS

SEQ ID NO: 73770 - DNA, 980 bp, Zea mays
  misc_feature: Ceres CLONE 1558126
  misc_feature: Encodes the peptide sequence at SEQ ID NO. 73771
  misc_feature (642)..(642): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (686)..(686): n is a, c, t, g, unknown, or other
agctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccacctagagatggatccgcaccaaagcaccagggggntnnntnnnggggggggggtnnnnnnnggnnnnntttnnnnttgngggggaaaagggttttggtgggggaaccttgggaggggggggttgacaactcgaatgctggagaaaccattctgggagcaaggaaaggtggctggatggctaaggccatcttacaacgggaatagcgcccggtcaaggggggttttggtttcaaaaccgagggggtctgccgaggaagttcacaattccttttcacaacttggggggtatccaccgggatgggaaaaaaaaatccaaatccgggtctgcaaaaatcaagccccagggttaaaaattaaaaacttcgttgaggag

SEQ ID NO: 73771 - protein, 223 aa, Zea mays
  misc_feature: Ceres CLONE 1558126
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (168)..(168): Xaa is any aa, unknown, or other
  misc_feature (169)..(169): Xaa is any aa, unknown, or other
  misc_feature (170)..(170): Xaa is any aa, unknown, or other
  misc_feature (171)..(171): Xaa is any aa, unknown, or other
  misc_feature (175)..(175): Xaa is any aa, unknown, or other
  misc_feature (176)..(176): Xaa is any aa, unknown, or other
  misc_feature (177)..(177): Xaa is any aa, unknown, or other
  misc_feature (178)..(178): Xaa is any aa, unknown, or other
  misc_feature (179)..(179): Xaa is any aa, unknown, or other
  misc_feature (180)..(180): Xaa is any aa, unknown, or other
  misc_feature (181)..(181): Xaa is any aa, unknown, or other
  misc_feature (183)..(183): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEEAGAAVEQFNGYTFQGRPLRVNCGPPPPRDGSAPKHQGXXXXGGGXXXXXXXLXGKRVLVGEPWEGGVDNSNAGETILGARKGGWMAKAILQRE

SEQ ID NO: 73772 - DNA, 979 bp, Zea mays
  misc_feature: Ceres CLONE 1558127
  misc_feature: Encodes the peptide sequence at SEQ ID NO. 73773
  misc_feature (654)..(654): n is a, c, t, g, unknown, or other
  misc_feature (794)..(794): n is a, c, t, g, unknown, or other
  misc_feature (962)..(962): n is a, c, t, g, unknown, or other
ctggagctcaccgcggtggcggccgctctagaactagtggatcccccgggctgcaggaattcgtctcacccctagaaaaaacgtcacgaggagcggaacacacacacactcgggtttccgatggcggcggccgcaccaacacacgcgcccgtgtcctcctcagcgtgccgttcgggattctcctctagcgatgtatccttccccaattttcgctcggcggcggcttcggcccctgggtggcggcgcagggagccgtacccggcagtctccgtagtgtcgagctccccgcagtctgtgccaggagctataactgtcgacaccgaggttgacacattgctagacagtgtgaagtgggacagcaaagggttggctgttgccattgcacaaaatgtggatactggagccattcttatgcagggttttgctaataaagaagcccttgcaaaaactatatcaaccaggaaagctacattctttagccgttcacggtcttccttgtggacgaaaggggagacatccatgaacttcattaatgtgcatgacattttcctagactgtgaccatgactctataatataccttggaaagccagatggacctacctgccatacaggagcagaaacgtgttattatacttcagtttatgatgctcancaaaaaaggtccaaagcccaatgaaggcaggcaggttatgacaacccctatactcacttgaagatacaattagtagacgccccgaggagaaaagtacctgatggaggtggcaagccatcatggacaaaaaagctactccnttgataaccagctacttgcctcgaaatacgttgaagaagctggtgagctaaattcaaacgctgcttgagaacaaggaccaatctcgtgcagcttccggggattggctgatctgctgtaccacacgctatggtgctgctccgaagtccagatggtaaagatggaaacangtccttgaggccccgaa

SEQ ID NO: 73773 - protein, 185 aa, Zea mays
  misc_feature: Ceres CLONE 1558127
  misc_feature (98)..(172): Pfam Name: PRA-CH Pfam Description: Phosphoribosyl-AMP cyclohydrolase
  misc_feature: SWISSPROT Homolog: EC 3.5.4.19 Phosphoribosyl-AMP cyclohydrolase
  misc_feature (178)..(178): Xaa is any aa, unknown, or other
MAAAAPTHAPVSSSACRSGFSSSDVSFPNFRSAAASAPGWRRREPYPAVSVVSSSPQSVPGAITVDTEVDTLLDSVKWDSKGLAVAIAQNVDTGAILMQGFANKEALAKTISTRKATFFSRSRSSLWTKGETSMNFINVHDIFLDCDHDSIIYLGKPDGPTCHTGAETCYYTSVYDAXQKRSKAQ

SEQ ID NO: 73774 - DNA, 968 bp, Zea mays
  misc_feature: Ceres CLONE 1558130
  misc_feature: Encodes the peptide sequence at SEQ ID NO. 73775
  misc_feature (642)..(642): n is a, c, t, g, unknown, or other
tggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgcctgcgaggcgggtcttcgagcccgttgccgtcgcggtgtcgtctgagtacgggaccgagggcgcggagcagcaggacggggagttctccgaggacctcatgctgttcgtcggtaacctgccgttcagcgtcgacagtgcgcagctggccgggctcttcgagctggcgggctccgtcgagatggtcgaggttgtatacgatagaatgactgggcggagccgtggatttggattccggacaatgtcttcagctgaagaagccggggctgctgtcgagcaattcaacggctatacatttcaaggaagacctctgagggtgaactgcgggccaccgccacctagagatggatccgcaccaagagcaccaaggtgtgtggggtttcnggggttgtttcccccaccctcttcgcgttctggcaaattggcatacgagcgcaaacccttatacggaggggtgcccccacggcagccccagctggaacggtgtccttggtgccgtgccgagggccttaatgactgcggatcccctggctcccgggggtaattcccggcggctacgggggggccggaatacccgtactcgggggagatctggcaacagatcggctttatggtcttaaccggtaccgtccagtgggttcctcactgttctgggagtaggcccaacccattctcctggttgcggcgaatttgggccaacgtgtccgggt

SEQ ID NO: 73775 - protein, 224 aa, Zea mays
  misc_feature: Ceres CLONE 1558130
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (172)..(172): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLMLFVGNLPFSVDSAQLAGLFELAGSVEMVEVVYDRMTGRSRGFGFRTMSSAEEAGAAVEQFNGYTFQGRPLRVNCGPPPPRDGSAPRAPRCVGFXGLFPPPSSRSGKLAYERKPLYGGVPPRQPQLERCPWCRAEGLNDCGSPGSRG

SEQ ID NO: 73776 - DNA, 946 bp, Zea mays
  misc_feature: Ceres CLONE 1558131
  misc_feature: Encodes the peptide sequence at SEQ ID NO. 73777
  misc_feature (673)..(673): n is a, c, t, g, unknown, or other
ggagctccccgcggtggcggccgctctagaactagtggatcccccgggctgcaggaattcgtctcacccctagaaaaaatcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccgcaaggcgcaggtggaggagttctacgtcatcacgtggacgtcccccaaggagcaggtgttcgagatgcccaccggcggcgccgccatcatgcgggagggccccaacctcttgaagctggcgcgcaaggagcagtgcctggcgctcggcaccaggttgcgctccaagtacaagatcacctaccagttctaccgcgtcttccccaacggcgaggtgcagtacctccaccccaaggacggcgtctacccggagaaggtcaaccccggcagggaaggcgtcngccagaacttccgcagcatcggcaagaacgtcaaccccatcgacgtcaaggtcaccggcaaggccaccttcgactaatcacacttcacgtacgccgcacgcccccagccggatccaaattaaaagaactcttcttctattaattacagtataatggtattttagctgctggtaccgtgggtgggatgatttgaaaaggtgcaagaatgaccctgtgggtattttattaccaagccccttcttaaattacaaggtcacttgcctgcctcctgaa

SEQ ID NO: 73777 - protein, 199 aa, Zea mays
  misc_feature: Ceres CLONE 1558131
  misc_feature (62)..(199): Pfam Name: PsaD Pfam Description: PsaD
  misc_feature (175)..(175): Xaa is any aa, unknown, or other
MAMATQASAATRHLLAAAWAPAAKPRQLSSQLALPSSSSRGPAPLRASTEEAVEAPKGFVAPQLDPSTPSPIFGGSTGGLLRKAQVEEFYVITWTSPKEQVFEMPTGGAAIMREGPNLLKLARKEQCLALGTRLRSKYKITYQFYRVFPNGEVQYLHPKDGVYPEKVNPGREGVXQNFRSIGKNVNPIDVKVTGKATFD

SEQ ID NO: 73778 - DNA, 945 bp, Zea mays
  misc_feature: Ceres CLONE 1558133
  misc_feature: Encodes the peptide sequence at SEQ ID NO. 73779
  misc_feature (68)..(68): n is a, c, t, g, unknown, or other
  misc_feature (915)..(915): n is a, c, t, g, unknown, or other
ctccccgcggtggcggccgctctagaactagtggatcccccgggctgcaggaattcgtctcacccctngaaaaaaaaaaaaaaaaaaaaaaaaaaaaaaaaaaaaaaaaaaaaccccaacgcggcaaacggcttcctcatccccctcccctcgccatggccgtccccacctccacctcctccccgctacccctcctcttcctccatcgctgcaccgcaaactctagcccctcggttctctccttcccgtcctccctccgcggcgcgtccctccgctcccgggccgcggccgcaccgcccgcaaagaccctctctgccgacggcatccccgacgcgccaccggaaggggcgggaacgggaattccgttgccatcgtcaattggggatgatggggagcagcttgcacccaagcagaagatcagaatcaagctgcggtcctactgggtgccgttgatagaggactcgtgcaagaagataaccgaagctgccaaaacaaccaacgcaaagaccatgggtcccgttcctctgcccactaagaggagagtctattgtgtgcttaactctcctcacgtgcacaaggactcacggttccatttcgagatccggacgcatcagcggctgattgatatcatgtatccaactgcccaaacaattgattcgttgatgcaactccagctccctgccggtgtggatgttgaggttaagctatgattctgttggagctgaacttttcgaagtttgatgtaatgaggtattcattttctgcagcttttctctgggactgaaaagaatgtagtgcctgtactaggaaagaagatgtcagaaatgaatgtacttgatttgagtattcagatgatatggttcatgctagctgtatacttgtattactgtatggggggcactaaatttcttctancagtctgaagcaaagaaggattggcaaatt

SEQ ID NO: 73779 - protein, 184 aa, Zea mays
  misc_feature: Ceres CLONE 1558133
  misc_feature (87)..(182): Pfam Name: Ribosomal_S10 Pfam Description: Ribosomal protein S10p/S20e
MAVPTSTSSPLPLLFLHRCTANSSPSVLSFPSSLRGASLRSRAAAAPPAKTLSADGIPDAPPEGAGTGIPLPSSIGDDGEQLAPKQKIRIKLRSYWVPLIEDSCKKITEAAKTTNAKTMGPVPLPTKRRVYCVLNSPHVHKDSRFHFEIRTHQRLIDIMYPTAQTIDSLMQLQLPAGVDVEVKL

SEQ ID NO: 73780 - DNA, 935 bp, Zea mays
  misc_feature: Ceres CLONE 1558136
  misc_feature: Encodes the peptide sequence at SEQ ID NO. 73781
ctccccgcggtggcggccgctctagaactagtggatcccccgggctgcaggaattcgtctcacccctagaaaaaacgcccagcgccagtcaccaaccttccactccctccctccgtcgccatggcgcgcaagaagatccgggagtacgactccaagcgcctcctcagggagcacctcaagcgcctcgccggcatcgacctcaccatcctctccgcccagatcacgcaatcaacggacttcgcggagcttgtgagccagcagccatggctgtcaaccatgaagctagtggtgaagcctgatatgctgttcgggaagcgtgggaagagcggcctcgtggctctcaacttggatttcaatcaagtcaaggagtttgtcaaggagcggctgggggttgaggttgagatgggtggctgcaaggctccaatcacgaccttcatcgtcgagccatttgtgccacatgatcaagagtactacctttcgattgtctcagagaggttgggcagcaccatcagcttctcagagtgtggaagggatgagattgaggagaactggggacaggttaggactatttttcctcctactgaagagccaatgacgtctgaatcatgtgcccctttgattggcaccctttccatggaggcacgccgaaaaattggggacttcttaaaaggaaggtttgcccgctcccaaaactggattcccatttccgggaaaggaacccttcccccgggcaaaggggggccattccccgggaagggggggaaacctgtgacccgcaccttcaaaaactccaaaaggggggagggaaaaatttccccccccttgggaaaggccccccccaaaaaagtccccccgaaaaaaaaaaaaaaagggcccctaaaataccgtgtttaccccaagggcccttgccacggccccgggggggggcaaataat

SEQ ID NO: 73781 - protein, 271 aa, Zea mays
  misc_feature: Ceres CLONE 1558136
  misc_feature: SWISSPROT Homolog: EC 2.3.3.8 ATP citrate synthase
MARKKIREYDSKRLLREHLKRLAGIDLTILSAQITQSTDFAELVSQQPWLSTMKLVVKPDMLFGKRGKSGLVALNLDFNQVKEFVKERLGVEVEMGGCKAPITTFIVEPFVPHDQEYYLSIVSERLGSTISFSECGRDEIEENWGQVRTIFPPTEEPMTSESCAPLIGTLSMEARRKIGDFLKGRFARSQNWIPISGKGTLPPGKGGPFPGKGGKPVTRTFKNSKRGEGKISPPLGKAPPKKVPPKKKKKGPLKYRVYPKGPCHGPGGGQI

SEQ ID NO: 73782 - DNA, 953 bp, Zea mays
  misc_feature: Ceres CLONE 1558137
  misc_feature: Encodes the peptide sequence at SEQ ID NO. 73783
ctggagctccccgcggtggcggccgctctagaactagtggatcccccgggctgcaggaattcgtctcacccctagaaaaaaaaattcctctacggcccaccttcttcctacctgccattctcccatccaacacagcaggacgtctcctcctcctccctcccgcttctatcgccgtcttcatttccaggacgcgtcgaattcctccatctaccgcgccggccgccgaggcccgagggggaggaggatgctgggcgccgcgaggaggcagcttggatccggtcccatgctgggacaggttttgcgaaggctccgcccggcggcggcggctgaggtggcgaggggctactccgctgcggcgaaggagatgactgtccgtgatgcattgaactctgcactggatgaagagatgtctgctgatccttcagtttttctgatgggagaagaggttggagagtatcaaggtgcatacaagatttctaagggcttgcttgacaagtatggtcccgatagggttcttgacacacctatcacagaggctggctttactggcattggtgttggtgcagcttaccaaggtcttcggcctgttatagaatttatgacatttaattttctcgatgcaggctattgatcatatcatcaattcagctgctaagtcaaactacatgtcagccggtcagatatctggttctattggtttttaaagaacaaatgggactgctgctggaattggtgctcaaccctcacagggttagcagcttggtttgccagttcccagacttaaagtcccacacctacccttcaaaaaagcccgaggcttgctaaagcgcctttaaaaacccggacccggtattttctggaaaaagaattgctttatgggaaactctccccgttccggcgaaggggggaatccaattttgcccaccgttgggaaccaaaaaaaaggggggggg

SEQ ID NO: 73783 - protein, 128 aa, Zea mays
  misc_feature: Ceres CLONE 1558137
  misc_feature (39)..(129): Pfam Name: Transket_pyr Pfam Description: Transketolase, pyrimidine binding domain
  misc_feature: SWISSPROT Homolog: EC 1.2.4.1 Pyruvate dehydrogenase (acetyl-transferring)
MLGAARRQLGSGPMLGQVLRRLRPAAAAEVARGYSAAAKEMTVRDALNSALDEEMSADPSVFLMGEEVGEYQGAYKISKGLLDKYGPDRVLDTPITEAGFTGIGVGAAYQGLRPVIEFMTFNFLDAGY

SEQ ID NO: 73784 - DNA, 893 bp, Zea mays
  misc_feature: Ceres CLONE 1558138
  misc_feature: Translation starting site: 416
  misc_feature: SWISSPROT Homolog: EC 5.2.1.8 Peptidylprolyl isomerase
ctccccgcggtggcggccgctctagaactagtggatcccccgggctgcaggaattcgtctcacccctagaaaaaaccaaatccttctcctccgcgccgccacagccgggcgcgcctctcgatcgagatccaggagatatgcctcgttatgatgatcgccatgggaatacacgcttgtatgttggaagattggcccctcgcacccgtgtcccgcgtacctagaatatcttttcagcaaatatggaagaatacgtgaagtggagttgaagcgtgactatgcattcattgaattcagtgacccccgtgatgctgatgatgcgcagtacaacctagatggcagggaagtcgatggaagccgtattattgttgaatttgctaaaggagttcctcgtggttctgggtggtcacgtgagtacatgggaagaggacctccaccaggaacaggtcgtttgtttttactgtggaaatggatgggtcactgggcaagggactgccaaggctggtgactggaagaaacaaatgctaccgctggtggtggaatcggggccatttagaaaggaatttgccccgaacaggccaaggaaatcccagggggtgtaaaaaaggtttttcccggggtccccttcccccccggtggggggaaagggggccccaaccccgggaacttctccctaaaacccccgggatcttttggcccaattccaaaatccccccctttgggatctcccccgggggggggagaacccccccttaaaactgttcacaaggggggaaaatcctggggaggcttttttccctccccccgggggggggggcggacccccccccccggggttttgtttttctccccccccccccaaaagaaaaaaaaaaaaaagcgccccctctcccccc

SEQ ID NO: 73785 - DNA, 904 bp, Zea mays
  misc_feature: Ceres CLONE 1558140
  misc_feature: Encodes the peptide sequence at SEQ ID NO. 73786
  misc_feature (662)..(662): n is a, c, t, g, unknown, or other
tggagctccccgcggtggcggccgctctagaactagtggatcccccgggctgcaggaattcgtctcacccctagaaaaaagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactaccttggcaaccccagcctgatccacgcgcagagcatcctcgccatctgggcctgccaggtcgtgctcatgggcgccgtcgatggctaccgtattgccggcnggccgctcggcgaggtcgtcgacccgctgtaccctggcggcagcttcgaccccctcggcctgggcgacgacccgtagccttcgccgagctcaaggtgaggagctcaagaccgcccgcctcgcatggtttccatgtcgggctcctcgtccaggcatcgtcacccgctgggccccgctcgagacctcgctgacacatcgctgaccagtcaaaacaacgctggggctacccaaccacttcgtgcc

SEQ ID NO: 73786 - protein, 200 aa, Zea mays
  misc_feature: Ceres CLONE 1558140
  misc_feature (61)..(198): Pfam Name: Chloroa_b-bind Pfam Description: Chlorophyll A-B binding protein
  misc_feature (176)..(176): Xaa is any aa, unknown, or other
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVDGYRIAGXPLGEVVDPLYPGGSFDPLGLGDDP

SEQ ID NO: 73787 - DNA, 964 bp, Zea mays
  misc_feature: Ceres CLONE 1558142
  misc_feature: Translation starting site: 156
  misc_feature: SWISSPROT Homolog: EC 2.6.1.44 Alanine--glyoxylate transaminase
  misc_feature: SWISSPROT Homolog: EC 2.6.1.11 Acetylornithine transaminase
ggagctccccgcggtggcggccgctctagaactagtggatcccccgggctgcaggaattcgtctcacccctagaaaaaaaccagcgactcacacacccgcgcgccgcttctgtagggccccaaccaaccgcgcagggagaaaaccaccacagcacatgcagcgcctcgcctcctcccggaggctcctccaggccgcgctcgcccccgcccgggccaactccagcctctccgcggccgccgtcgccgcgcccgcgccagcgaatggcgccttccccaagatgccggccttcgactacacgccgccgccgtacgacgggccgcgcgccgaggagatcttccggaagcgcgctcagttcctcagcccatccctctttcatttctacgatcgcccattgaacatagtcgaaggaaagatgcagtacctatttgatgaggatggccgtcgttacctggatgctttcggtggcattgcaacagtttgttgtgggcactgccatccagatgttgttgaagccatagtaaacaggcaaagcggatccagcactcccacagtctatatctcaatcatgcaattgcagattttgccgaagcattgggctccaaaatgcctggtgatctgaaggttgttttcttcacaaattcagcacggaggcaaatggaccttgccctgatgaattgccggctttacactggttgcaaagaaattatcccccttgagaaaggaaaaccaggggaaagccgcgggaaaaaggggggcccccggccaaccaattggaaatccaaggtgttcaaaaagggagaaccctgggctttaaaccaaacccctaaaaaaggccttttggctcccggggaaaatacccccaaaatgtcgggaaaaccccatttgaaacacgggggaaagggggggcctttcaaacaacaaaggggggtggggatataataaaccaccccaaaaatctccgct

SEQ ID NO: 73788 - DNA, 939 bp, Zea mays
  misc_feature: Ceres CLONE 1558144
  misc_feature: Encodes the peptide sequence at SEQ ID NO. 73789
  misc_feature (119)..(119): n is a, c, t, g, unknown, or other
  misc_feature (139)..(139): n is a, c, t, g, unknown, or other
gctggagctccccgcggtggcggccgctctagaactagtggatcccccggggctgcaggaattcgtctcacccctagaaaaaaaaaaaaaaaaaaccaaatcccccgatctcctcgctntcctcccgtgtccgtcgccngccgcgcgcctctggagaagagatagagggcggccggctgcatcgaccccgtcgccacccccgctctgcctcccccggcaccgatcagggtttgatcgatggcgtcgaagaggatcctgaaggagttgaaggacctgcagaaggacccgcccacctcctgcagcgcaggtcctgttggtgaggacatgttccattggcaagcgaccatcatggggccttcggacagcccatttgcaggtggggtattcttggtgaacattcacttcccaccggattaccctttcaagccaccaaaggtgtctttccgcaccaaggttttccacccgaacatcaacagcaacggcagcatttgccttgacattctataggaacagtggagtcctggcttaactatctaaaagttctcttgtcaatctgctccctggtcacggaccccaaacccggatgatccccttggccccgaaattgcccccatggccaaaaccaacagggccaagtttgagtcccccccaccctccgggaaccaaatatatccaggggctaaaacaaggttaaaagcgggccaaacgggtaaaggcgccggccccccattcgtttccccaaaaaacccgccagtcccaatttgaaggggcctttgggagaccttggccccggtgaacctctttttcccctgggaaaccctgtggcggtgtttccccgcgccttgtgttaaagaagcggtttttttaaataaaggcgcgctctttatacccgctcgaaaaaaaaaaaaagaggggccgccggtgccccttccccatcat

SEQ ID NO: 73789 - protein, 89 aa, Zea mays
  misc_feature: Ceres CLONE 1558144
  misc_feature (5)..(90): Pfam Name: UQ_con Pfam Description: Ubiquitin-conjugating enzyme
  misc_feature: SWISSPROT Homolog: EC 6.3.2.19 Ubiquitin--protein ligase
MASKRILKELKDLQKDPPTSCSAGPVGEDMFHWQATIMGPSDSPFAGGVFLVNIHFPPDYPFKPPKVSFRTKVFHPNINSNGSICLDIL

SEQ ID NO: 73790 - DNA, 933 bp, Zea mays
  misc_feature: Ceres CLONE 1558145
  misc_feature: Encodes the peptide sequence at SEQ ID NO. 73791
  misc_feature (750)..(750): n is a, c, t, g, unknown, or other
  misc_feature (840)..(840): n is a, c, t, g, unknown, or other
  misc_feature (871)..(871): n is a, c, t, g, unknown, or other
ctggagctccccgcggtggcggccgctctagaactagtggatcccccgggctgcaggaattcgtctcacccctagaaaaaatgctctgatccccatttaaagctgatgctcccaatactaggtactctactcatgcccccagccactacatattatttgctcatgacgctaccaaggattatcatggttacgccaggtctccagactcatatctgttacaagaacccggatctgctctgttcggactaccatactcgatctctctctaccgtggacaacaccaccgacatcagcaacggtgccacggtccctagctgacacaaagcccacctgatcggtgccgagatcgcctccctcatcaaaacaagagcgagaccacacatcctgattctcacgcgcgagcgcatatcattaagacaattaccgtgtatcagactgctacatgcgagcacaacaccatcctgagcggcaccgctcatgatcttatatccaccaaaggttgaactgcaacatgaatatgatgaccctcggatggatgccagcttcctgctgacaccgaagctcgtactcaaactgtcatggtgctttcgtactaaagttgtatgcccttgagcaggaatctcacgacacactgcaactggaaactttaagattacgatgctgcaataaggttgactcatgatgacatgcgccatcgctgaacctgacatcatgcagacaacctcctggagcctacgatcaggagtgagnaattaacccacaatgtgctcaagaagacttagcacagacttcgaccacgaaatcaccctgatatgcaagcacatgctctgactccttacngacttatgctccatacaactttggcagccgntgcggatcaccccagtggggcaaaaggccggttgctccctccaagtgacctgacatccaata

SEQ ID NO: 73791 - protein, 44 aa, Zea mays
  misc_feature: Ceres CLONE 1558145
MILYPPKVELQHEYDDPRMDASFLLTPKLVLKLSWCFRTKVVCP

SEQ ID NO: 73792 - DNA, 901 bp, Zea mays
  misc_feature: Ceres CLONE 1558146
  misc_feature: Translation starting site: 167
  misc_feature: SWISSPROT Homolog: EC 1.3.1.33 Protochlorophyllide reductase
ctccccgcggtggcggccgctctagaactagtggatcccccgggctgcaggaattcgtctcacccctagaaaaagaacgcggagtcacttcgccacgaacaaaagcgcatctatattgctgtcgtcactcctcgtcagccacacacgaacagatgcaccacccagtatggccctgcaagcagcgctcctaccgtacaccctctcattcgtgcccaatacatgcaccatcgccttctgcacgcgtaaggacacggcattcgttaccttatgccagaaaaatgtgcaggcggcgtccctttcaatgagaactcctgtggggacgacggggcctgtggctacatcggggtccagcacggggggctatgatgggaagaacaccgtacgatagggcgtggtgaagataacgagcgcgtggtcgggttctagactagcctcgaccaatgcactagcgtgacaccgactagtggcacatggtgatggtctgcatcgacttcatctaggcgggcaacgaggacatgggcgcgtggttgccggacatgatctacacaatcatgcacctggacctagcctccctcgaaagcctgcagcaattaatggacagctgcatgcgtgccggtcatcctctcaactgactgccctgtaaaggcgacatctacggggtggtttaaggaagcctacatttccgggggactgataccatatgagcttcagcctctagcacctgtgccaatttccccctgtgggggctgcttctggaccaaatgcagtatttggatttcccttcccgcaggggaaaaaacgttgtctccatgaccggcaaacccgttggtctgtgcccggaaaatttcgaacagggccgggcttgataaaatcaccggggctccgcgtggggccttctttt

SEQ ID NO: 73793 - DNA, 916 bp, Zea mays
  misc_feature: Ceres CLONE 1558148
  misc_feature: Encodes the peptide sequence at SEQ ID NO. 73794
  misc_feature (531)..(531): n is a, c, t, g, unknown, or other
  misc_feature (705)..(705): n is a, c, t, g, unknown, or other
  misc_feature (770)..(770): n is a, c, t, g, unknown, or other
ctccccgcggtggcggccgctctagaactagtggatcccccgggctgcaggaattcgtctcacccctagaaaaaagccaccacggaccacaggccagaaaaaggcttcgccttggtccttggatccccccacacaacgcagcacccgcactctccaggcgtctgccaatccgaaacgaaacccacccgtaggcaaaccaggactgagattgagcggagagcagcacagtcatggcggggcaggaggtggcgaacaagcgggtggtactgaagcgctacgtgacggggttccccggcgcggacgacatggaggtggtcaccggcaccgcgcgcgtggccgtgccgccggggtcgacggccatggtgctcaagaacctctacgtgtcgtgcgacccttacatgcgcggccgtatgaccaagcacgagaggcccagctacgtcccggacttcgtcgtgggggaggttttggaaaactttggcgtctgcaaggtgatagcatctgggcaccaggatttcaaggttggggatcttngtgtgggggatgtaccggatgggaggagtacactctcatccataacccggagtcatttttcaagatcaatcatcctggaattgcctctgtcctactacacaggcgttcttggcatgccgagccttactgcttgggctggatttttcgatgtgggcaagcccaagaaaggcgatnattgtctcgtctcagcagcatcaggagccgttggtcagctggttgggcagtttgctaagctacangatgttatggtgccggcagtgctggtcctgaaagaaagttaatctctgaaaacaagttggggctcatgagccttcactacagaaaagccggacccgtgccgcctgaaaggattcccaaggcttgcactcacttcagacggggggag

SEQ ID NO: 73794 - protein, 193 aa, Zea mays
  misc_feature: Ceres CLONE 1558148
  misc_feature (101)..(101): Xaa is any aa, unknown, or other
  misc_feature (159)..(159): Xaa is any aa, unknown, or other
  misc_feature (180)..(180): Xaa is any aa, unknown, or other
MAGQEVANKRVVLKRYVTGFPGADDMEVVTGTARVAVPPGSTAMVLKNLYVSCDPYMRGRMTKHERPSYVPDFVVGEVLENFGVCKVIASGHQDFKVGDLXVGDVPDGRSTLSSITRSHFSRSIILELPLSYYTGVLGMPSLTAWAGFFDVGKPKKGDXCLVSAASGAVGQLVGQFAKLXDVMVPAVLVLKES

SEQ ID NO: 73795 - DNA, 990 bp, Zea mays
  misc_feature: Ceres CLONE 1558149
  misc_feature: Encodes the peptide sequence at SEQ ID NO. 73796
tggcggccgctctagaactagtggatcccccgggctgcaggaattcgtctcacccctagaaaaatatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttgcggttcagccccatcaaggagtccatcgtgtcccgcgagatgacccgtcgctacatgactgacatgatcacctacgccgacaccgacgtcgtcaccgggggcgccggctccccggggttggccagcgcttacaaactctcaaagaaccccggcgtgagcatccccatatgggaactttccgtttccccaggtttggaccaattgcttgacccgaaaagggtttattcccctggcggggcccaacacgggggacgaaaaacaaaaaaaacccatgcccgggtttcatatgaaggcaaggggttttgggcgggggaaaacctccggcccgggggggcccacacatattgaggccactccctaaaagggggccttctcccccccaaaaaaaaaaaaaagggggtgaggatcctcctcccggggggaaatatcaaaaccacccccgttggtttccccgcacgtaccatagttgtataaaaaaaagaatctctgttattaaaagaaatggagcgttgcttgcagactttcaaaatatgtggggtcgcgaggtaggccccgctaagtttttaacaacaaaaccgtgtctgcttatgctttgccgcgcgtatgaaaacaacacccacacatttattttgttagtggtttaaacgctaacgatcgtgttttgt

SEQ ID NO: 73796 - protein, 177 aa, Zea mays
  misc_feature: Ceres CLONE 1558149
  misc_feature (64)..(177): Pfam Name: Thi4 Pfam Description: Thi4 family
MATAAASSLLKSSFAGSRLPAATRTTPASLVVATGPRGAGAGPICASMSMSSSNPPYDLTSLRFSPIKESIVSREMTRRYMTDMITYADTDVVTGGAGSPGLASAYKLSKNPGVSIPIWELSVSPGLDQLLDPKRVYSPGGAQHGGRKTKKTHARVSYEGKGFWAGENLRPGGAHTY

SEQ ID NO: 73797 - DNA, 916 bp, Zea mays
  misc_feature: Ceres CLONE 1558150
  misc_feature: Encodes the peptide sequence at SEQ ID NO. 73798
ggagctccccgcggtggcggccgctctagaactagtggatcccccgggctgcaggaattcgtctcacccctagaaaaaacgtgcgagcgcaatgctggcggcgtccctcaggccggggccttcgctcgcggccttccccggtaccgcccagaggagcccagttcctttcctccccttccctgctcgcctccaccaccggcccgtcctcctctccgcgaccgccgagggaaccggcgcccccgccggccagggagacgcctcggctgccccgctcgacgaggtgcgcctgccgcagttcgctgcggactgggaatccgcgcgcgcgtgcaaggaccaggggaggatcttctcgctgccggtgctgagggccaacagtggcgggctcatcgtcaggttcaactccctgcaggggttcgtgcccaaccctctcctcagccccgcgcactggtgtaaagaccccaaaaggcccatccaagatgttacgaaagacctagtaggaacgtccatttctgtcaaggtggctgaagtgaatgaggaggaaaagaaacttgtcttctctgagaaggatgctagttggtcaacatactcttcccgaataaagattggcgacatctatgatggaattgtgggctcagtgttccactatggtgcatttgttcacctgcgatttcctgatggatatatcatcttactggtcttgacatatctcggaggtgtcttgagatcttgtcaagacgtcaagatgttctaacgaaggggatgctgtcaaggtcatagttgtgacatggattgacgagtcaaggatagcttatctatcgacactgggagagatcctctatggagacttggacaagtgatcctttgaagcgatcatcactaatcaagaggctcttcaaaatgaactctgccagactga

SEQ ID NO: 73798 - protein, 219 aa, Zea mays
  misc_feature: Ceres CLONE 1558150
MLAASLRPGPSLAAFPGTAQRSPVPFLPFPARLHHRPVLLSATAEGTGAPAGQGDASAAPLDEVRLPQFAADWESARACKDQGRIFSLPVLRANSGGLIVRFNSLQGFVPNPLLSPAHWCKDPKRPIQDVTKDLVGTSISVKVAEVNEEEKKLVFSEKDASWSTYSSRIKIGDIYDGIVGSVFHYGAFVHLRFPDGYIILLVLTYLGGVLRSCQDVKMF

SEQ ID NO: 73799 - DNA, 954 bp, Zea mays
  misc_feature: Ceres CLONE 1558151
  misc_feature: Encodes the peptide sequence at SEQ ID NO. 73800
  misc_feature (864)..(864): n is a, c, t, g, unknown, or other
  misc_feature (892)..(892): n is a, c, t, g, unknown, or other
ctggagctccccgcggtggcggccgctctagaactagtggatcccccgggctgcaggaattcgtctcacccctagaaaaaagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctaccgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaggaacgggctctgggcttggttctctcctcctggagcgcctgtctgttgactatggcaagaagtccaagctcggtttcaccgtgtacacatccccccaggtgtccacatccgtggttgagccatacaacagtgtcctgtccacccactctctcctcgagcacactgatgttgctgtcctgctcgacatggagccatctatgacatctggcgccgctcccttgacattgagcgccaanctacacaacctcagaagcttgtctccangtcatctcatcctgacggctcccaggagatcgatgtgctctgaacgtgatgtgacgatccca

SEQ ID NO: 73800 - protein, 252 aa, Zea mays
  misc_feature: Ceres CLONE 1558151
  misc_feature (49)..(230): Pfam Name: Tubulin Pfam Description: Tubulin/FtsZ family, GTPase domain
  misc_feature (222)..(222): Xaa is any aa, unknown, or other
  misc_feature (232)..(232): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYTSPQVSTSVVEPYNSVLSTHSLLEHTDVAVLLDMEPSMTSGAAPLTLSAXLHNLRSLSPXHLILTAPRRSMCSERDVTIP

SEQ ID NO: 73801 - DNA, 897 bp, Zea mays
  misc_feature: Ceres CLONE 1558153
  misc_feature: Encodes the peptide sequence at SEQ ID NO. 73802
  misc_feature (510)..(510): n is a, c, t, g, unknown, or other
  misc_feature (774)..(774): n is a, c, t, g, unknown, or other
  misc_feature (775)..(775): n is a, c, t, g, unknown, or other
  misc_feature (791)..(791): n is a, c, t, g, unknown, or other
  misc_feature (811)..(811): n is a, c, t, g, unknown, or other
  misc_feature (814)..(814): n is a, c, t, g, unknown, or other
  misc_feature (815)..(815): n is a, c, t, g, unknown, or other
ctggagctcaccgcggtggcggccgctctagaactagtggatcccccgggctgcaggaattcgtctcacccctagaaaaaacacctgcagctgccacagcgggtggtgcctggcttggcggcctagcatagctgcgctgcgcatgctagtgaccaatggcgtccaccaaggtgccactgttcctcgtcctcaacctcctgctcttcgcggcggccaacgcctgcccttactgcccgggcaacaatggccacggtagcagcgggcaccatggcggcagtgggcatggcggcggtggcagcggcggttccggtggcggcagcagcggcggagggtacggtccgatcggtggtggtggcagcggcggcggcggcggaggagggtacggtccgatcggtgacggtggcagcggcggtgggatcggagtcggacccatcggaggcggcagcggggggatcggacccataggaggtggcagcggtggtgggtacggtcccatcggtggagggggangtggggatccggtgggcggtggcctcgatcgaccgagccggatgggacggccattgcccgaccaacgcgctgaaactaccccgagtgcgccaaactgccaggacctgatcagagccgacggccgcgcgccggggaaaaatcaagggcggccccggacgaaacgagaagatggagaacaaagacgccgcgggccaaggaatctggccggggaccacagggcgggaggccaatcccaaacccccgggaaaagagggcgcccgaaannaagcacaccggaaggncgcccaccggaggcaccaantgnnccgggccccccaggcacgcaagtggagtccaaataacccagaacccccgaccgcctggcccccattttgtggttttttattt

SEQ ID NO: 73802 - protein, 73 aa, Zea mays
  misc_feature: Ceres CLONE 1558153
MATVAAGTMAAVGMAAVAAAVPVAAAAAEGTVRSVVVAAAAAAEEGTVRSVTVAAAVGSESDPSEAAAGGSDP

SEQ ID NO: 73803 - DNA, 934 bp, Zea mays
  misc_feature: Ceres CLONE 1558154
  misc_feature: Encodes the peptide sequence at SEQ ID NO. 73804
ctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgacctctccctcctcaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgctacatcaccgtctacgaggcccagtcccgcggcggccgtggaggcggcggcggtgggtactgtggtggccgtggaggcggcggctactgcggtggcgggcgccgtgatggcggtggcggctactgcggtggcggcggctacggtggcggcggcggctactgtggtggtggcggctgctactgcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaagtcgctctgtgtcagttggtagtgctgtggtcatcctcggtttcagcagaccatgcatcatacagcatggactgcggatcaatggatgctgtttccccgtcaggctttatcctaagtaatcttaaggaaaaatggtggcttcttgttgctgcaaaaataaaaaaaaccagacgc

SEQ ID NO: 73804 - protein, 155 aa, Zea mays
  misc_feature: Ceres CLONE 1558154
  misc_feature (10)..(81): Pfam Name: RRM_1 Pfam Description: RNA recognition motif. (a.k.a. RRM, RBD, or RNP domain)
  misc_feature (48)..(150): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDLSLLNAFSTYGEVLESKIILDRETQRSRGFGFVTFSTEEAMRNAIEGMNGKELDGRYITVYEAQSRGGRGGGGGGYCGGRGGGGYCGGGRRDGGGGYCGGGGYGGGGGYCGGGGCYCGGNRGGGYGNSDGNWRN

SEQ ID NO: 73805 - DNA, 951 bp, Zea mays
  misc_feature: Ceres CLONE 1558157
  misc_feature: Encodes the peptide sequence at SEQ ID NO. 73806
  misc_feature (744)..(744): n is a, c, t, g, unknown, or other
ggagctccccgcggtggcggccgctctagaactagtggatcccccgggctgcaggaattcgtctcacccctagaaaaactctctttctcaaagttcggagtcgaggccgccgcccagaccgcctccccttccccgcctccggtgcccaaggccaggccaacagttttgaggtggtaatggcggaccaggctaaccaacccactgtccttcataagctaggtggccagttccacctgagctccagcttctctgaaggtgtacgggcccgtaacatctgcccttctttctcaccttatgaaaggagatttgccacgaggaactacatgacccagagcctttggggcccttcaatgtctgttagcggtggcatcaatgttccagtgatgccgactccgctttttgccaatgctccagccgagaaaggtggcaaaaacttcatgattgatttcatgatgggcggtgtttcagctgctgtttcgaagactgcagctgctcccattgaacgagtgaagctgcttattcagaatcaggatgagatgatcaagtctggtaggctatcagagccgtacaagggtattgctgattgcttcaaacgtaccatcaaggatgagggtttctcttccttgtggaggggtaacactgctaatgttattcgttacttccctactcaagctttgaactttgcgtttaaggactacttcaagaggctgttcaacttcaagaaagacaggtatggttactggnaagtggtttgctggcaacctggcctctggtggtgctgctggtgcttccctctttgttttttgtgtactcccttggattatgcgagacaagttggccaatgatgccaagctgccaaggggcagagcgatagacaattcatgggtcttgtggatgtctaccgcaagacactcaatctgatggtattgctgggcttttacgtggatttaa

SEQ ID NO: 73806 - protein, 222 aa, Zea mays
  misc_feature: Ceres CLONE 1558157
  misc_feature (86)..(183): Pfam Name: Mito_carr Pfam Description: Mitochondrial carrier protein
  misc_feature (190)..(190): Xaa is any aa, unknown, or other
MADQANQPTVLHKLGGQFHLSSSFSEGVRARNICPSFSPYERRFATRNYMTQSLWGPSMSVSGGINVPVMPTPLFANAPAEKGGKNFMIDFMMGGVSAAVSKTAAAPIERVKLLIQNQDEMIKSGRLSEPYKGIADCFKRTIKDEGFSSLWRGNTANVIRYFPTQALNFAFKDYFKRLFNFKKDRYGYWXVVCWQPGLWWCCWCFPLCFLCTPLDYARQVGQ

SEQ ID NO: 73807 - DNA, 986 bp, Zea mays
  misc_feature: Ceres CLONE 1558160
  misc_feature: Encodes the peptide sequence at SEQ ID NO. 73808
  misc_feature (499)..(499): n is a, c, t, g, unknown, or other
ctccccgcggtggcggccgctctagaactagtggatcccccgggctgcaggaattcgtctcacccctagaaaaaatcttcaccgtccttcagcaaatattagttttggatcaaggattgggagttcttccagttctggttctacagtactgatacctgcttcacaagatcccagtacaagcttgataggaagtgattttcctgagccccttttgttaggttctttgtttacagctgattcaacaaatttcttatctgcatctggaaacagaagtaaccagcaaaattctggatccagctctagttccatgcttagacctgctgtaaatgttgcagctcaacaagtccctgggttcaacgtatctcagccaagtacaactctaagaggttcagctgatgtgtctaggaggtccttaactgctgctgggtgttctcatttttagaaagtcaagcatggcattgcagcaccgtgggacttcatccacaccgcatgagattcngagtccacagccatgatcaggctctcgtgcccatcagcagtcataaagaacctggtcattcctcgatagacaggcaaaacccctggttactggaaccttcaagctttttttgcagcccatagcttccagggaaggagggcggcccatttcccaaatccccaatggttttttaaaaatttcgcccggggaaaaaatccaaattgggagatttccctccccgggacgggcccctttttttgaaacccccaattttttttaaaaaaccccgaatatcgcgcttttggggaaaaaatcccccaagagaaaaccccccccagggaaacactttgggttttaacaccccgggtttggggagaaaaaaccctgtgtttttaaaaagaaaattttttttttttttggtgaaaccccccccgggtgttacacctttttttttcccacaaaaaacccccaggagaagattttgtgaaaatagtgttgggcccccccc

SEQ ID NO: 73808 - protein, 44 aa, Zea mays
  misc_feature: Ceres CLONE 1558160
MLRPAVNVAAQQVPGFNVSQPSTTLRGSADVSRRSLTAAGCSHF

SEQ ID NO: 73809 - DNA, 932 bp, Zea mays
  misc_feature: Ceres CLONE 1558161
  misc_feature: Translation starting site: 150
ctggagctccccgcggtggcggccgctctagaactagtggatcccccgggctgcaggaattcgtctcacccctagaaaaaagagcagccgacaactctctaccgtccgagaccccaagcaccagcgcggcggcggcggcggcggcgaccatggctgtcgggaagaacaagaggatctccaagggaaagaagggtggcaagaaaaagaccgtcgaccctttctctaagaaggattggtatgacatcaaggcaccgtcggtgttcagtgtgcgcaacatcaggaagactctcgtatccaggacgcagggtaccaggattgcttctgagggtctgaagcacagaatctttgaggtttgcctagctgatcttcagggcgacgaggatcaagcttacaggaaaatcaagctccgtgctgaagatgtgcagggcaggaatgtgctcacaaacttttggggtatgaattttaccactgataaattgaggtccctagtgaagaagtggcagacattaatccaagcccatgttgatgtcaagacaaccgacaactacatgttgcgtttgttctgcatcggcttcacaagaagcgcccaaacaggtcaagagaacctgctatgctcaggcatccaagatccgtaagatccgcgctaagatgttgagattatgatcaacccaggctcttcatgtgacttgaaagaacttgtttcaaaagtcactccaaaagtttttgggtaggaaaattgagaagccacctccggattctccaacttaaaaagtcttctttccgaggggaaaaatcccaagggcccccaatttccatcttgggaacccctggggggtccccggcacccccaaaagagagtgggtgtgaaactttaaaagcccctcaaaggaaaatagcctggccaaaggtgtccccccccacaatattttttt

SEQ ID NO: 73810 - DNA, 957 bp, Zea mays
  misc_feature: Ceres CLONE 1558163
  misc_feature: Encodes the peptide sequence at SEQ ID NO. 73811
gctggagctccccgcggtggcggccgctctagaactagtggatcccccgggctgcaggaattcgtctcacccctagaaaaagccgcccccgtctcctctcctctcctctcctccgcatccacggccgcaggcagcagccagccactcgacgatctagtcgtctctctctccccgctctgccgcctcgctgccgcggcttcccgtcggctggaggatgaaggtcacggtcgtgtcccggagcggccgggaggtcgtcaagggcggcatcgacctcaaggactcggccaaggtcgcggacctgcaggaggccatccatgccaggactaagaagtattatccttctaggcagcggctcaccctcccccttcaacctggaaaaggcgggaagccagttgtcctcagtccaaaggccagcctgctagaatactgcgagaagggttctgggtcactgacagtggtcttcaaagatttagggccacaggtctactacagcacactgttcttcttcgagtacctgggtcctctcatcatctaccccatgttctactatctgcccgtctacaaatacttcgggtacgagggggagcgggccatgcaccctgtccagacctacgccatgtactactggtgcttccactacttcaagcggatcatggagacgttcttcgtgcaccgcttcagccacgcgacgtcgccgctctcgaacgtcttcaggaactgtgcctactactggaccttcggcgcttacattgcttactactgcaaccacccgctgtacaccccagtgagtgacctgcaaatgaagatggggtttgggtttggggtcctctgccaggtagcggacttctactggcaaatccgtgctggggaactcaggagcccaagcgggggggggggtaccagatccccgccggtttctggtcaaattcctggaccggcccatattacccccacggt

SEQ ID NO: 73811 - protein, 247 aa, Zea mays
  misc_feature: Ceres CLONE 1558163
  misc_feature: SWISSPROT Homolog: EC 1.3.1.38 Trans-2-enoyl-CoA reductase (NADPH)
MKVTVVSRSGREVVKGGIDLKDSAKVADLQEAIHARTKKYYPSRQRLTLPLQPGKGGKPVVLSPKASLLEYCEKGSGSLTVVFKDLGPQVYYSTLFFFEYLGPLIIYPMFYYLPVYKYFGYEGERAMHPVQTYAMYYWCFHYFKRIMETFFVHRFSHATSPLSNVFRNCAYYWTFGAYIAYYCNHPLYTPVSDLQMKMGFGFGVLCQVADFYWQIRAGELRSPSGGGGTRSPPVSGQIPGPAHITPT

SEQ ID NO: 73812 - DNA, 902 bp, Zea mays
  misc_feature: Ceres CLONE 1558165
  misc_feature: Encodes the peptide sequence at SEQ ID NO. 73813
  misc_feature (540)..(540): n is a, c, t, g, unknown, or other
  misc_feature (560)..(560): n is a, c, t, g, unknown, or other
ggagctcaccgcggtggcggccgctctagaactagtggatcccccgggctgcaggaattcgtctcacccctagaaaaaacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcggcatcccgtggttcgaggccggcgcggacccgagcgccatcgcgcccttctccttcgggtcgctgctgggcacgcagctgctgctgatggggntggggtggagtcgaacccgntgggtggacttcttcaacccggactcccagggccgtgtagtgtgccacgccgtggtcgcgcaccgctgagaacttcgccaacttcaccggcgagcatgtctacccgggtcggcaagttcttcgacccgctcggcctcgccggcaccgtcaatgacggcgtctacatccccgacgtcgacagactctgagcggctcaagctggccgagatcaagcacgcccgcatcgccatgcttggcatgctcgccttttactttaaagcccggcagggcaagacgccgctcggcgcgctccggcctatgatttgcatgctgcccgggaacgattcaatcccgattttgggt

SEQ ID NO: 73813 - protein, 169 aa, Zea mays
  misc_feature: Ceres CLONE 1558165
  misc_feature (54)..(165): Pfam Name: Chloroa_b-bind Pfam Description: Chlorophyll A-B binding protein
  misc_feature (141)..(141): Xaa is any aa, unknown, or other
MALAPTSAAVLKTPFLGARRALAKPAPRRALVIAAAAAAKKSWIPAIKSDAEIVNPPWLDGSLPGDFGFDPLGLGKDPAFLKWYREAELIHGRWAMAAVLGIFVGQAWSGIPWFEAGADPSAIAPFSFGSLLGTQLLLMGXGWSRTRWVDFFNPDSQGRVVCHAVVAHR

SEQ ID NO: 73814 - DNA, 956 bp, Zea mays
  misc_feature: Ceres CLONE 1558166
  misc_feature: Encodes the peptide sequence at SEQ ID NO. 73815
acccgcggtggcggccgctctagaactagtggatcccccgggctgcaggaattcgtctcacccctagaaaaaaagtcaagctgagcacaagtgatcgaacaactacagtacatacactctatcgatctctgtgaattaatttagttattaactcgatcatggcgcgcccccaaaacaaccagaaccccagggtgttcctggtcctcaacatcggcggcgtgacggttggccgcgtcgtcatcgagctgttcgccgacaaggtgcccaagacggcggagaacttccggctgctgtgcaccggagagcgcagcgtgtggttgtggtcctgcaagcgcctgcactacaagggcgctgcgttccaccgcgtgttgcccgggttcatgttgcagggcggcgacatcactgcgggcaacggcacgggccgcgagtctgctatcggtgacgcccgggtacttcgcccaacaaggcctttcggaacccctccagcaacaatggcccccggcttgttttccttggccaaaccccggggccccaacacaaaaggatctccaatttttttaataaccttttcaccaaaacccccggggtttgggaagggcccccccctctcgttttttgggccccgctccgggaataggctattagacaccctcgtggtgccctataaatataagccgggggcccccccagggggggagaccttaagaggaattttttttctacgccaattgtggggggaagattttgacccttatgccccccggtgggtaaattttttgagtagaacacctccccccccctcccaaaagatgtggataatctacagaggaggtggatgaaccacacagtacaggtcattctcttatgttgtggtgtttggtcgccgtcgtcttattaaaatatatcttttgaaccccacgcgaataaaataaccactctaacatgtcccgttcttt

SEQ ID NO: 73815 - protein, 226 aa, Zea mays
  misc_feature: Ceres CLONE 1558166
  misc_feature (11)..(172): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MARPQNNQNPRVFLVLNIGGVTVGRVVIELFADKVPKTAENFRLLCTGERSVWLWSCKRLHYKGAAFHRVLPGFMLQGGDITAGNGTGRESAIGDARVLRPTRPFGTPPATMAPGLFSLAKPRGPNTKGSPIFLITFSPKPPGFGKGPPLSFFGPRSGNRLLDTLVVPYKYKPGAPPGGETLRGIFFLRQLWGEDFDPYAPRWVNFLSRTPPPPSQKMWIIYRGGG

SEQ ID NO: 73816 - DNA, 1001 bp, Zea mays
  misc_feature: Ceres CLONE 1558167
  misc_feature: Encodes the peptide sequence at SEQ ID NO. 73817
  misc_feature (505)..(505): n is a, c, t, g, unknown, or other
ctggagctccccgcggtggcggccgctctagaactagtggatcccccgggctgcaggaattcgtctcacccctagaaaaaaccacacaacgatctagctacttcctctctcaagcccataggtgttgtagagcaactcaactagcaatggcttccaagagcacaatgcgttcccttgtcctcatcatggggctcctgctgctctcgtgcagcggcatcagcagcgcggcacggctgctggaggaggtggcgcccaatgaggagtacccgcaccctgaagtgccagaactgcccaagcctgagctcccgccgcaccctacggtgccggaactccctaagcctgatgagctaccgccacatccggtcgtgccggagctgccaaagcccttagtgccagtgcaccccgaccgtaccggagctgacgaaccccgagctgactcctcaatccaccgagccctgatctgccgatgaccgaagttgtctgaagcaccccgccttgactgaanctgccgtagcccccaattgcctactcacgccacagggccgagagttccaaatccctaagtggcctgaccctcccaaaccctggggtgcctggagccccccccctggtgccgaaccttccaaaaaaccgaatttcccccttaccccccctgggcaaaggctgccaaaccccgagggggcgaaatttgcaaattcctgatccgcccaaagagggggtgccccctctctcctaaaccctgtttctttttcccccaaaagcataagccccccccccaaaacagggtgggcaaaggtgttttccctaaaaatcccaaaggccggggagtaaaaaaaaaacaaaaaaagcggcccactatgaaacaccgtttttttttttttcttctccggcggtgttttattttatttttcccaaaattttttttcgcccccccccccacccccaaggggggggggggttttttttgttaaaaaaaaaataaacccaccccccccggcccc

SEQ ID NO: 73817 - protein, 107 aa, Zea mays
  misc_feature: Ceres CLONE 1558167
MASKSTMRSLVLIMGLLLLSCSGISSAARLLEEVAPNEEYPHPEVPELPKPELPPHPTVPELPKPDELPPHPVVPELPKPLVPVHPDRTGADEPRADSSIHRALICR

SEQ ID NO: 73818 - DNA, 964 bp, Zea mays
  misc_feature: Ceres CLONE 1558169
  misc_feature: Encodes the peptide sequence at SEQ ID NO. 73819
caagctggagctccccgcggtggcggccgctctagaactagtggatcccccgggctgcaggaattcgtctcacccctagaaaaaatgtggctccttacttccgcgccgccacccctacaggtaaggaagaggaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtgtcatatgtgaagactcctcgtggcctccgcacactcaactctgtttgggcccaacatcttagcgaagaagtgaggagaaggttctacaagaactggtgcaagagcaagaagaaggctttcacaaagtatgctctcaaatatgaaaatgatgctgggaagaaggaaattcagctgcagcttgagaagatgaagaaatatgcttctgttatccgtgtcattgctcatacccagattaggaagatgaagggtttgaagcagaagaaggctcacctgatggagattcacgtcaatggtggtaccattgctgacaaggtggactatggctacaattctttgagaaagaggtcctgttgatgctgtcttccagaaggatgaatgatggacatcattgtgtgacccagggaaaggtttttgagggtgtggtcccccttggggatgcacccggctccccgcagaccccatgggtctcccaagttgcttgtacggtgcatgcatccggctaggttcccttaaccttgcccggccgggcaaatggtacccccccgcctgaa

SEQ ID NO: 73819 - protein, 207 aa, Zea mays
  misc_feature: Ceres CLONE 1558169
  misc_feature (50)..(205): Pfam Name: Ribosomal_L3 Pfam Description: Ribosomal protein L3
MSHRKFEHPRHGSLGFLPRKRSSRHRGKVKSFPRDDPKKPCHLTAFLGYKAGMTHIVREVEKPGSKLHKKETCEAVTIIETPPLVIVGLVSYVKTPRGLRTLNSVWAQHLSEEVRRRFYKNWCKSKKKAFTKYALKYENDAGKKEIQLQLEKMKKYASVIRVIAHTQIRKMKGLKQKKAHLMEIHVNGGTIADKVDYGYNSLRKRSC

SEQ ID NO: 73820 - DNA, 891 bp, Zea mays
  misc_feature: Ceres CLONE 1558171
  misc_feature: Encodes the peptide sequence at SEQ ID NO. 73821
  misc_feature (811)..(811): n is a, c, t, g, unknown, or other
ctggagctccccgcggtggcggccgctctagaactagtggatcccccgggctgcaggaattcgtctcacccctagaaaaaggccgccgacaactcgggcgggacacgggagacagccatggcgacgggcggccaggggaatgccgcgggctactaccagtacccgacatcgtacgccggtgctgcggacgatgagcgccggtggtggccgtggctcgtgcccaccgtgctcgtctcctgcatcgcggtcttcgccgccgagatgttcgtcaacgactgcccgcgccacaggagcacgctcggctgcggcgccgggtgcgtggcggccggtctcctccgccggttctccttccagccgctccgcgagaacccgctcttcgggccttcctccgccaccttggagaagatgggagctctcaactgggccaaagtagttcatgagcaccaagggtggcgcctcattagctgtatctggctccatgctggcctagttcacttggttggcaacatgctaagcttgctcttcattggaatccgccttgagcaacattttgggtttgtgcgcattggtgtcatctacttgatatctggctttgggggcagagtgttgtctgcacttttcttacacagcaactacgtctctgttggtgcctctggggctttgtttggcctctttggatctatgctctcagagcttattataaattggactatcgattccaacaaggcagcggcgatcagtacgctactttttataactgtaactgatctggcccattgggatattacctcatgcctgcatagttggcccnacattgaacgatgtgcttctgggatttctttatgggatttgtcctgctgggcagactccaatcttggtttgatggtacct

SEQ ID NO: 73821 - protein, 258 aa, Zea mays
  misc_feature: Ceres CLONE 1558171
  misc_feature (105)..(232): Pfam Name: Rhomboid Pfam Description: Rhomboid family
  misc_feature: SWISSPROT Homolog: EC 3.4.21.105 Rhomboid protease
  misc_feature (232)..(232): Xaa is any aa, unknown, or other
MATGGQGNAAGYYQYPTSYAGAADDERRWWPWLVPTVLVSCIAVFAAEMFVNDCPRHRSTLGCGAGCVAAGLLRRFSFQPLRENPLFGPSSATLEKMGALNWAKVVHEHQGWRLISCIWLHAGLVHLVGNMLSLLFIGIRLEQHFGFVRIGVIYLISGFGGRVLSALFLHSNYVSVGASGALFGLFGSMLSELIINWTIDSNKAAAISTLLFITVTDLAHWDITSCLHSWPXIERCASGISLWDLSCWADSNLGLMVP

SEQ ID NO: 73822 - DNA, 974 bp, Zea mays
  misc_feature: Ceres CLONE 1558172
  misc_feature: Encodes the peptide sequence at SEQ ID NO. 73823
acccgcggtggcggccgctctagaactagtggatcccccgggctgcaggaattcgtctcacccctagaaaaaaatcccctccccacatcgggaaccgtcgccgacgccgcaggatgagacgcatcgaggttagcacacgaagaagcgaccatgagggccaagtggaagaagaagcgcatgaagaggctcaagaggaagcgcagaaagatgaggcagatatccaagtaggcagatcgagatggattgtggacctgatgacatgcgtgggtacatacatttcttcggatgcgttggtgtgcctgtggagagatgtcaacctgccatggtgtcacggtccgccatcacttgaacgtcttgcatgcgcttcagtaggccatttttcatggttctagttgtatttgaatccagcgtttgccactaagataaatcagacattcgttttgtgaacctatgatgatggagctttatttgctgataatatctacctaccgatttgagctgtacttccttcatttgaatctgcagaaatgcgcaacttagctgagacattgttaagggatataattcgtggaagtccagatgttaaatgggaaagcataaaaggtctggagaatggaaagcggcctctccaccaaccaggtgtaatgccaatttaatatcccatattcttcacaagaatattaccaccttggaatgggatattactggtttgggtcacctggaaacaagaaagatgtgcctccctaaagctgtgggtaatgaacgcaaaacaaattttttcatttttgttgccccgtctatttgtagcaagggggggcggcgacccggaaaaaccaagggaagtgggttgtggaacctcgaaaggtttctggccccctccacggtttctccctgggaggaattcgaagtatattttgtggcaaacgggggggaagcccccccgtggacaggagatgagagcgttttcttaaatt

SEQ ID NO: 73823 - protein, 92 aa, Zea mays
  misc_feature: Ceres CLONE 1558172
MRRIEVSTRRSDHEGQVEEEAHEEAQEEAQKDEADIQVGRSRWIVDLMTCVGTYISSDALVCLWRDVNLPWCHGPPSLERLACASVGHFSWF

SEQ ID NO: 73824 - DNA, 953 bp, Zea mays
  misc_feature: Ceres CLONE 1558175
  misc_feature: Encodes the peptide sequence at SEQ ID NO. 73825
tggagctccccgcggtggcggccgctctagaactagtggatcccccgggctgcaggaattcgtctcacccctagaaaaaattcccaagcaaacagccaaacacacgcgaagaaaaggagatagagtacaggttacagagaggcagagagcaaagatgtgtggtggtgcgatcctcgccgagctcatcccgactacgccggcccgccgcggcggcgcggcgtggcccgccggcaagtgcaagcggcggaaggcggacgacttcgaggccgcgttccgggagttcgacgaggacatccggaggaggaggaggaggaggacgagggggtttgttggaccacatgcccgccttcgtcgtccgcgcctcgtccgcggcgacgcgccccacggcgcgccaggaggactcggaggcggcgccaggcgcccgaccaccagttccggggcgtcccgtgccgccctgggggcaagcgggtcgtggacatccctcaccccctttaagctgtggtgaacgtgctgctgtccttccctgcgccaaggaaccgtttcgcagctatgagctgcctcacacgttgcgtgcaggcctcgggctacggactgtgacgccgatgatgcgatctcacgcgccgaactgctcccaggtgaggcgcagcgcccgcaggatagccacccatcaaacgcgctacatgacaccggcccattttcttccggcggagtaaggatcaggcctcctaccggacgagattcgattgcgtcccggaaatgcaagtgggacgtttgaagcaggttgctttcatgaccttggtggcagatctggtgttctcctctgagaaaagtcagtgaattcgcccaaccaagggggatccgggtcattttatccgaccccgaagccatggacaaaaaatgcccttagccctgatgaaaattgttggatttaagctgccactctttggagagat

SEQ ID NO: 73825 - protein, 116 aa, Zea mays
  misc_feature: Ceres CLONE 1558175
MCGGAILAELIPTTPARRGGAAWPAGKCKRRKADDFEAAFREFDEDIRRRRRRRTRGFVGPHARLRRPRLVRGDAPHGAPGGLGGGARRPTTSSGASRAALGASGSWTSLTPFKLW

SEQ ID NO: 73826 - DNA, 929 bp, Zea mays
  misc_feature: Ceres CLONE 1558176
  misc_feature: Encodes the peptide sequence at SEQ ID NO. 73827
  misc_feature (516)..(516): n is a, c, t, g, unknown, or other
  misc_feature (715)..(715): n is a, c, t, g, unknown, or other
  misc_feature (850)..(850): n is a, c, t, g, unknown, or other
  misc_feature (875)..(875): n is a, c, t, g, unknown, or other
catgctggagctcaccgcggtggcggccgctctagaactagtggatcccccgggctgcaggaattcgtctcacccctagaaaaatcgttgcgtgcgcactgatttcttgttgctgtaataattggccgctcagcgctgcgggtgaacgggttcccttgcaagcgtgaggcgaacgtgacggcggacgacttcttcttcggcgggctcgccgcggccgccgacgtgtactcgggcaacccgatggggtcggcggcgacggcggcggacgtgtcggtgctcccgggtctcaacaccctgggcgtgtccatggcgcgcacggacttcgcgccgtcgggcggcgtcagcccgccgcacgtgcacccgcgcgccacggagatcctcttcgtcgtggagggcaccctcgaggtgggcttcgtcacctcggcaaaccgcctcttcagccgcgccgtcggcaagggagaggtgttcgtgttcccccgcggcctcgtgcacttccagcgcatcgtcggggcgggncgcccgcccgtggcgatctcggctttcaacgcccagctgcctggcacgcagacggtcgccggggcactgttcggcgctgcgccggcggtgccgacggacgtgctggcgcgggcgttacagatcgacgggtggagcgatcgagtacatcaagtccaagtttgcgcccaactagggcatgtctcgaattgcaaatgctcanggtgatcgaaaagaaggtacgaacgaactaactactaaactaggtgtggtgcccgtgcgttgcaacgggaacgtataataccacggtaatttatgtacaaatgggtggtatattggttatgaaaaaagttttggnatacatttgtgtagacatcaacagnctctataggaaccaagcatcacggggcatgctaggtcccatcgaaacatactat

SEQ ID NO: 73827 - protein, 158 aa, Zea mays
  misc_feature: Ceres CLONE 1558176
  misc_feature (1)..(139): Pfam Name: Cupin_1 Pfam Description: Cupin
  misc_feature: SWISSPROT Homolog: EC 1.15.1.1 Superoxide dismutase
MGSAATAADVSVLPGLNTLGVSMARTDFAPSGGVSPPHVHPRATEILFVVEGTLEVGFVTSANRLFSRAVGKGEVFVFPRGLVHFQRIVGAGRPPVAISAFNAQLPGTQTVAGALFGAAPAVPTDVLARALQIDGWSDRVHQVQVCAQLGHVSNCKCS

SEQ ID NO: 73828 - DNA, 969 bp, Zea mays
  misc_feature: Ceres CLONE 1558177
  misc_feature: Encodes the peptide sequence at SEQ ID NO. 73829
  misc_feature (662)..(662): n is a, c, t, g, unknown, or other
  misc_feature (734)..(734): n is a, c, t, g, unknown, or other
  misc_feature (736)..(736): n is a, c, t, g, unknown, or other
ctggagctccccgcggtggcggccgctctagaactagtggatcccccgggctgcaggaattcgtctcacccctagaaaaaaccgcgaaggcacacagccgccgtatcttttacttgcgctcggcacgcaggcgacggctgcggcgctcaggttggggttctcatcgacggcgtcagcggcttcccctcccgcctctcgtcagtcgcttcgcgccctcgcctccggtcctccgcacactggccggtgaccctgcatagtattatctgattttcctggaggccacattttaaggactgaggttacaatggcagatgccagccctagaacagaaacatcaacagatgatactgacgacaataacgggcttgaaccaggcagaggtggtcttgttgcttctgactccagtgacagatccaaagacaaacatggagatcaaaagacattgcgtcgccttgctcaaaatcgtgaggctgcaaggaagagccgactaaggaagaaggcatatgttcaacagttggagaatagcaggctaaaacttacccaactagagcaagagctgcaaagagctcgtcagcagggcatttttatatctagttcagttgatcagtcacactccatgagtggaaatggggcattggcctttgatatggagtatgcgaggntggttggaagagccaatcggcaaattagtgaactaatggctggtgtcagtgctcatgcaagtgaactgatcntncgaagtgttgttgataagatcatgtcacactatgatgagatttttaggctcaaaagcatgcagccaatgcagatgtttttcacgtcttatctggcatgtggagacaccgggcgaaaagtgttttttggggctaggagttcccgacatccgagggttttaaagcttctttcaaaccacctgtacctctcaccaaaaagcagctgtgaaggataagcaacttcagcaatctaaat

SEQ ID NO: 73829 - protein, 214 aa, Zea mays
  misc_feature: Ceres CLONE 1558177
  misc_feature (41)..(93): Pfam Name: bZIP_1 Pfam Description: bZIP transcription factor
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature (120)..(120): Xaa is any aa, unknown, or other
  misc_feature (144)..(144): Xaa is any aa, unknown, or other
MADASPRTETSTDDTDDNNGLEPGRGGLVASDSSDRSKDKHGDQKTLRRLAQNREAARKSRLRKKAYVQQLENSRLKLTQLEQELQRARQQGIFISSSVDQSHSMSGNGALAFDMEYARXVGRANRQISELMAGVSAHASELIXRSVVDKIMSHYDEIFRLKSMQPMQMFFTSYLACGDTGRKVFFGARSSRHPRVLKLLSNHLYLSPKSSCEG

SEQ ID NO: 73830 - DNA, 935 bp, Zea mays
  misc_feature: Ceres CLONE 1558180
  misc_feature: Encodes the peptide sequence at SEQ ID NO. 73831
acccgcggtggcggccgctctagaactagtggatcccccgggctgcaggaattcgtctcacccctagaaaaagcctcactcactcaccgatccctcgccaaggcacaggctccccgtgagctccgccacgcgggcgcgtcgcctccctcgtcctactccttcctcaccgcagtccgcacgagcaatggcgatggcagccatagcctccccgtcgtcgaggaccctgatccctccgcgacaccactgcgccgcgccctccccgtccacctccggcgactcctcgctccgcctcctccgagcacacccgcgccacggacggcgcggccgggcggtgtccgtctcgacgcccgcggcgcggagccggccgttcgtcttctccccgcgcgcggtgtccgactctgagagctcccagacctgcctcgaccccgacgccagcgcgagcgttcttggaatcgttctcggaggtggtgctgggactagattgtaccccttgacaaagaagcacgccaagcctgcaatgccagtgggtgccaactatagactgattgatatccctgtcagcaagtgtctcgacagctacatatacaagatctatgtggtaacacgattcaactctgcttccctgggccgtcaccgtctaagagcctacgggaacaacattggagggtacaagtatgacgggttcgttgaagtcttaactgcacagcacagcccagatgatccggactggtttcaggagactgcagatgctgtaaggccatacttgtggtcatgtgaggaacaccacgtgatggagtttcttattcttggctggcgatcccctgtaccggagggattatgaaaagttcattcaggccaccaagagaaacggatgccgaaattactggtgctggcctaccaatgaatgagaacttgccaccgctatttggcttctg

SEQ ID NO: 73831 - protein, 218 aa, Zea mays
  misc_feature: Ceres CLONE 1558180
  misc_feature: SWISSPROT Homolog: EC 2.7.7.27 Glucose-1-phosphate adenylyltransferase
MAMAAIASPSSRTLIPPRHHCAAPSPSTSGDSSLRLLRAHPRHGRRGRAVSVSTPAARSRPFVFSPRAVSDSESSQTCLDPDASASVLGIVLGGGAGTRLYPLTKKHAKPAMPVGANYRLIDIPVSKCLDSYIYKIYVVTRFNSASLGRHRLRAYGNNIGGYKYDGFVEVLTAQHSPDDPDWFQETADAVRPYLWSCEEHHVMEFLILGWRSPVPEGL

SEQ ID NO: 73832 - DNA, 975 bp, Zea mays
  misc_feature: Ceres CLONE 1558184
  misc_feature: Encodes the peptide sequence at SEQ ID NO. 73833
  misc_feature (461)..(461): n is a, c, t, g, unknown, or other
tccccgcggtggcggccgctctagaactagtggatcccccgggctgcaggaattcgtctcacccctagaaaaaccaccagtggcacagtggcagtggctggccacccaatcgtctcgttcgtcatctacctctccctcctccaacccaagctaagctaaacagcttacagctcgctccgccatcaccgtatcgagagagacagagacaggctagcgagggaatggagaggatgctggccaggctgatgcagcggcggagctccgtccccctgtccggcctcctccaccacggaggagcgcccgccccgctgcaggccgccggcgccactggggcctccccgctgatcttctcgcaccagcagcagcagcagcacacggccgtctccgcagtcctgccggggctcaagatcatggactgcgcgtaccagctgatcgggtagactccgatggtgtacctgaancaagtgaccgaggggtgcggcgcccaggttggctgccaagctcgagtccctgccggccgcctttcaccgccaaaagaaagacgggggatttcgatgcgggaagaaccccaaaaaaagggggcccaccacccccaggaaaaacacactttgatccgaccccccctgggggaaaaggggccccggggtgggggttaaagggcgggccccaaaggggggaaaaaaccgggggccacaaggcgtcccttaaacaacccggaaaaaaggggaaaaaaaggggggtttttggccccacccgggggggtttacccccccgaaaaaagttttgggcgcaacggtgtaaaaacccaaggcccccttttaaaaaatttcccggccctatggggcccccggtctcaaaaaccgcggaattggggggggctctccaaccccccggcccaatttttgggggacaacctgggcccccaatattttctggggggggaggagggggccccccccgggggggggtattata

SEQ ID NO: 73833 - protein, 72 aa, Zea mays
  misc_feature: Ceres CLONE 1558184
MERMLARLMQRRSSVPLSGLLHHGGAPAPLQAAGATGASPLIFSHQQQQQHTAVSAVLPGLKIMDCAYQLIG

SEQ ID NO: 73834 - DNA, 935 bp, Zea mays
  misc_feature: Ceres CLONE 1558185
  misc_feature: Encodes the peptide sequence at SEQ ID NO. 73835
ctccccgcggtggcggccgctctagaactagtggatcccccgggctgcaggaattcgtctcacccctagaaaaaaaactcgctctcactttactcctatccactgcggtctggacgcgtgcgagagacttgacaaagcagcagcagggatggcgcctctgaagctgtacgggatgccgctgtcccccaacgtggtgcgcgtggccaccgtgctcaacgagaagggcctcgacttcgagatcgtccccgtcgacctcaccaccggcgcccacaagcagcccgacttcctcaccctcaaccctttcggccagatcccggctctcgtcgacggagacgaagtcctcttcgagtcccgcgcgatcaaccggtacatcgccagcaagtacgcgtcggagggcacggacctgctccccgcgacggcgtcggcggcgaagctggagttgtggctggaggtggagtcgcaccacttccacccgaacgcgtcgccgctggtgttccagctgctcgtgaggccgctcctgggcggcgcccccgacgcggcggtggtggagaagcacgcggagcagctcgccaaggtgctcgacgtgtacgaggcgcacctggcccgcaacaagtacctcgccggggacgagttcacgctcgccgacgcctaccacgcgtcctacctgctctacctcagcaagaccccaaaggccgggctcgtcgcctgccgcccccacgtcaaggcctgttgggaaggcatccgcgcccgccccgcgtttcagaagaacgtcggcgccatgcccttgacccggcggccctcctctcggcttgactccccttgccctgcctgggtcccggatgttcggaacccctaatcaattaagaggcccatccgtcttgcattgctgccgcccctgtggcttaaaagccggtgaaataaacgtgtggctttcg

SEQ ID NO: 73835 - protein, 235 aa, Zea mays
  misc_feature: Ceres CLONE 1558185
  misc_feature (2)..(77): Pfam Name: GST_N Pfam Description: Glutathione S-transferase, N-terminal domain
  misc_feature (107)..(202): Pfam Name: GST_C Pfam Description: Glutathione S-transferase, C-terminal domain
  misc_feature: SWISSPROT Homolog: EC 2.5.1.18 Glutathione transferase
MAPLKLYGMPLSPNVVRVATVLNEKGLDFEIVPVDLTTGAHKQPDFLTLNPFGQIPALVDGDEVLFESRAINRYIASKYASEGTDLLPATASAAKLELWLEVESHHFHPNASPLVFQLLVRPLLGGAPDAAVVEKHAEQLAKVLDVYEAHLARNKYLAGDEFTLADAYHASYLLYLSKTPKAGLVACRPHVKACWEGIRARPAFQKNVGAMPLTRRPSSRLDSPCPAWVPDVRNP

SEQ ID NO: 73836 - DNA, 935 bp, Zea mays
  misc_feature: Ceres CLONE 1558186
  misc_feature: Encodes the peptide sequence at SEQ ID NO. 73837
  misc_feature (398)..(398): n is a, c, t, g, unknown, or other
  misc_feature (399)..(399): n is a, c, t, g, unknown, or other
  misc_feature (436)..(436): n is a, c, t, g, unknown, or other
  misc_feature (437)..(437): n is a, c, t, g, unknown, or other
  misc_feature (458)..(458): n is a, c, t, g, unknown, or other
tggagctccccgcggtggcggccgctctagaactagtggatcccccgggctgcaggaattcgtctcacccctagaaaaaaattcgaacgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcnnatgagacccgtgtacactcatcaaggactaccgtggnncagatgaaactgagctcaccnagatctgtgatggcatccctcagcttctcgaaatctcacttgtgccgtcttccaccgctcccgagtccagggtctctatctcaagatgaagggtgactactccgaaacccttgcttatttcaaactggaaactaaaaaaaaggcccttgctaaaaaaccaggggggaaaaaaggctgccccaaaaattgctttggcggaacctgccccaacccccctttaggggtggggggggcccaaacttcccgggggtccctggaaaattcaaaccccccaatgcccccgggtttttaaaaaagagttttttaaaagccccttctgaaatggacccccggggaggaggtctccaaaggacccctttttatccccccccccctggaaaaatgcccccttgggtcttcaacccccagaaacccccgaaaaaaatggggggcccccccacccctctgggggggggaaaaacccctttttctccccaa

SEQ ID NO: 73837 - protein, 80 aa, Zea mays
  misc_feature: Ceres CLONE 1558186
MASAELSREENVYMAKLAEQAERYEEMVEFMEKVAKTVDSEELTVEERNLLSVAYKNVIGARRASWRIISSIEQKEEGRG

SEQ ID NO: 73838 - DNA, 965 bp, Zea mays
  misc_feature: Ceres CLONE 1558187
  misc_feature: Encodes the peptide sequence at SEQ ID NO. 73839
  misc_feature (777)..(777): n is a, c, t, g, unknown, or other
  misc_feature (903)..(903): n is a, c, t, g, unknown, or other
  misc_feature (965)..(965): n is a, c, t, g, unknown, or other
ggagctccccgcggtggcggccgctctagaactagtggatcccccgggctgcaggaattcgtctcacccctagaaaaacttcgtcccgcatcgtttcctcctccttttccccgttcgtcccctggattggcgtctacccggcgcgacccggaccgaatcctaagtccgcctgccgccgccgccgtctcccgttggaaacgagtttggagtaaagaaaccgaccttgcatctgtgttctgtctgtctatgctgctttgctttggattcacaaaaaataagccttgcatctcactgacttgagataactatgcctaaggacaggagctcccgcgtttcctctcacgagagccgccgggctcgtgcctccccatacttgtcagcgtctcatggacagagcagttcttcacgccggtcacaagagtctcctgcggccgcggcagcgaagcaagctgcagagtgggaggatgttcggtgctcggtctgcatggaccacccgcacaacgctgtcctgctggtctgctcgtcgcacgagaagggctgccgccccttcatgtgcgacaccagctcgcggcactccaattgctatgaccagtaccggaaggcgtccaaggactcctccaaggattcagggacagagtgcagcgagtgccagcagcaggtccagctctcgtgcccgctgtgccgtgggccagtcagcgactgcatcaaggactacgacgcacggaggtacatgaacaccaaggtccggtcctgcaccatggagtcgtgcgagttcangggcgcctaccaggagctgaggaagcatgctagggtggagcaccccagcgcgatgcccgatggacgtagaccctgaacggcagcgggattggcgccagatggagcagcagcgggaccttggagacntgattgagcatgctgcgttcaggggttcacggccacgttgaggaccacagcgggcgacctgn

SEQ ID NO: 73839 - protein, 122 aa, Zea mays
  misc_feature: Ceres CLONE 1558187
  misc_feature (1)..(123): Pfam Name: DUF1644 Pfam Description: Protein of unknown function (DUF1644)
  misc_feature: The sequence is a functional homolog of SEQ ID NO 354 in the 10/666,642 US patent application
  misc_feature (98)..(98): Xaa is any aa, unknown, or other
MDHPHNAVLLVCSSHEKGCRPFMCDTSSRHSNCYDQYRKASKDSSKDSGTECSECQQQVQLSCPLCRGPVSDCIKDYDARRYMNTKVRSCTMESCEFXGAYQELRKHARVEHPSAMPDGRRP

SEQ ID NO: 73840 - DNA, 970 bp, Zea mays
  misc_feature: Ceres CLONE 1558189
  misc_feature: Encodes the peptide sequence at SEQ ID NO. 73841
  misc_feature (779)..(779): n is a, c, t, g, unknown, or other
ctggagctccccgcggtggcggccgctctagaactagtggatcccccgggctgcaggaattcgtctcacccctagaaaaaattccgtcgtcgtcgtcagcagcttctgcttgctttgtgggggaaggagagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctcgtggggcgcttcctggccgcctccgagccggccgtgtccgtgcagctcggcgaccacggccacctcgcttactcccacaccaaccaggcgctcctccgccccaggtcgttcgcggccaaggacgaggtgttctgcctgttcgaaggggtgctggacaacctgggtcggctgagccagcagcacgggctgtcaagcaagggcgccaacgaggtgctcctcgtcatcgaggcctacaagacgctgcgcgaccgcgcgccctacccggccagcttcatgctcgcccagctcaccggctcctacgccttcgtcctcttcgacaagtccaccaactccctgctcgtcgcatccgaccccgagggcagggtgccgctcttctgggggatcaccgccgaacgctgcgtcgccttctccgacgacatcgacatgctcaaaggctcatgcggcaagtcgctcgcgccgttttccgcatgctgctttctactcaacgcccntcggagggctcaagtgctacgagaaccccagcacgaggtcaccgctgtccccgccgacgtagaagaagatctgcgtgcactttccagggtggtggaagggtctactgtcctgacggcgctgcactgatcgtcatcagctggcgtagcgatccatgatgatgagccaacttgtaagccccttggggagatgg

SEQ ID NO: 73841 - protein, 238 aa, Zea mays
  misc_feature: Ceres CLONE 1558189
  misc_feature (197)..(197): Xaa is any aa, unknown, or other
MLAVFSGQVVEVPAELVAAGSRTPSPKTKASQLVGRFLAASEPAVSVQLGDHGHLAYSHTNQALLRPRSFAAKDEVFCLFEGVLDNLGRLSQQHGLSSKGANEVLLVIEAYKTLRDRAPYPASFMLAQLTGSYAFVLFDKSTNSLLVASDPEGRVPLFWGITAERCVAFSDDIDMLKGSCGKSLAPFSACCFLLNAXRRAQVLREPQHEVTAVPADVEEDLRALSRVVEGSTVLTALH

SEQ ID NO: 73842 - DNA, 940 bp, Zea mays
  misc_feature: Ceres CLONE 1558192
  misc_feature: Encodes the peptide sequence at SEQ ID NO. 73843
  misc_feature (556)..(556): n is a, c, t, g, unknown, or other
ctggagctccccgcggtggcggccgctctagaactagtggatcccccgggctgcaggaattcgtctcacccctagaaaaagcacaacacaagagctactactacagctcctcatctcaagtgtgtagacgagacagagagacactgagagagcgccatggccagcctccaagtcactcctacttcggcgttcactgagtggaacgagctgaagttcgaaggcctgtacctgttccacacgcccctgggctcaggcgccaaccaagctcgggtcatagacaacaaggcgccgattggcatcggtgccaccgtagttaacaactggacagtgtatgacgggccagggccgaacgcaaagctggttgcccgtgcacagggcttgcatatccaagccggcaactgggtcaactccttcagcctagtgttcgtggatcaaagggtcagtgggtccacgcttgaagtgaccgggatagtagttgaatccggggagtgtgctattggtgggggcaccggtcagtttgcatgtcaaacggtgtcatcttcaagagttccatgancagagaacgaaagaaactcatacacctcccatccatgctttctgtcggtgctcggaccgagaaacggctcgcccccaaatttgaacctggggttgggaaggcgggtcccccgtgaaattaaggaaaaaccccgggttggaaaaaatcccccttgcgacggggtcccccgaaccccataggctttcccaagggaaccccgccggaaaaacaaattgtggtttcctgggggggttcggggggaaaaatgccccggggcccccccccccaacccgggggccccaggatccttccgggaaaaagggtttctaaaaggccccccgttaaacccccaatggtggggaaacccctcaaaaacagccccttttaaaagaggggggaggggat

SEQ ID NO: 73843 - protein, 132 aa, Zea mays
  misc_feature: Ceres CLONE 1558192
  misc_feature (3)..(133): Pfam Name: Dirigent Pfam Description: Dirigent-like protein
MASLQVTPTSAFTEWNELKFEGLYLFHTPLGSGANQARVIDNKAPIGIGATVVNNWTVYDGPGPNAKLVARAQGLHIQAGNWVNSFSLVFVDQRVSGSTLEVTGIVVESGECAIGGGTGQFACQTVSSSRVP

SEQ ID NO: 73844 - DNA, 892 bp, Zea mays
  misc_feature: Ceres CLONE 1558194
  misc_feature (721)..(721): n is a, c, t, g, unknown, or other
  misc_feature (813)..(813): n is a, c, t, g, unknown, or other
  misc_feature (822)..(822): n is a, c, t, g, unknown, or other
  misc_feature (849)..(849): n is a, c, t, g, unknown, or other
agctccccgcggtggcggccgctctagaactagtggatcccccgggctgcaggaattcgtctcacccctagaaaaaaaccgctgcagcagagacgcccgaggcagcgcagatcagcagaccgcacgtcacacaccaccattgcagcaatggcgcgcgccggcgctctctgcctggcgctgctgtgcctcgtagccgtgcactcggccgtggcgcagaaatccaccccggccccggccaccgcaccggccgccaccaccaccccaccggcgaccccgtccaagaagacgcccgcgccagccgcggcgccgcccaccacccccgccaccctggccccggccgccgcgccgcccaccacccctgccacccccgcgcccgccgcgaccccgcccgccaccctggctcccgccgcgtcaccgcccaaggcgtcccctcccgcgccggcgcccaaggccaaggccaccccgcccgcccccgccgcctccccgccggtggccgagctgccgcccgccgcctcgcccccggcccccgcccccgcctccccgcccaccaagcccgccgaggtccccgcgcccgcgccgtccaagaagaagaagaagccctcctcgtcctccaagaacaagaagaagaatccaaggccccagcccccgcccccgtcgtcgcctaggcacggcacagcatgtatgccgcggctacgtgcgtgacgacgacagaactcctacncggaatatgcagccggtgcgccgcgcgcgctcaacgtccatggatgccgcggctgacggttgtactcctgtccgttttttaaccggacggcngggcctacntgtatgtagtagtactagtgcagtcantgcccctcacgttttgggtggccggggctacatgccgaactac

SEQ ID NO: 73845 - DNA, 950 bp, Zea mays
  misc_feature: Ceres CLONE 1558195
  misc_feature: Encodes the peptide sequence at SEQ ID NO. 73846
ctccccgcggtggcggccgctctagaactagtggatcccccgggctgcaggaattcgtctcacccctagaaaaaccacgagtcgagtagccattgcccattgccattccttccttcctccacagagaaatccgatccgcggagatttgacccaaccagatcatatcacacacgtaatcccatcccattccgcccgcaacagcagcaccaccggtgggaagaagaagatgaagaaggccacttcgctctccgagctgggcttcgacgccggcgacgcgtcgtcgggcttcttccgccctgtgtccggcgactcgtcgacgccgacgtcgcagcaccaccggcggaggctgaccaaggtgtcggtcatcggcgcgggcaacgtggggatggccatcgcgcagaccatcctcacgcgcgacctggccgacgagatcgcgctggtggacgcggtcccggacaagctccgcggggagatgctggacctgcagcacgcggcggcgttcctgccgcgcacgcgcctcgtgtcctgcaccgacatgtccgtgaccagggggctcgacctggtcatcgtgacggccggggcgcggcagatccaggcgagagaagctcgacctgctccagcggaacgtgggctgttccccagaatctgccgccgctggcggacaatccaacgaacgcctgctgctcgtggggccaaacccgggtacgggtcacctaagtgcccggaaactttggggcttcccgccaacccggttattggaaccggaacaaacctgaaacggccgggtaggggtccttcccccaaaaccctgagttaaaccccgaaaataaggggtaatgggggggagaacgggaaaacctcggggggggtgggcaaaaggtaaagggggggaaacccggcccaaactcccgggaagaacccccgtcttaaaagagaggcgggggggccct

SEQ ID NO: 73846 - protein, 196 aa, Zea mays
  misc_feature: Ceres CLONE 1558195
  misc_feature (42)..(179): Pfam Name: Ldh_1_N Pfam Description: lactate/malate dehydrogenase, NAD binding domain
  misc_feature: SWISSPROT Homolog: EC 1.1.1.27 L-lactate dehydrogenase
MKKATSLSELGFDAGDASSGFFRPVSGDSSTPTSQHHRRRLTKVSVIGAGNVGMAIAQTILTRDLADEIALVDAVPDKLRGEMLDLQHAAAFLPRTRLVSCTDMSVTRGLDLVIVTAGARQIQAREARPAPAERGLFPRICRRWRTIQRTPAARGAKPGYGSPKCPETLGLPANPVIGTGTNLKRPGRGPSPKTLS

SEQ ID NO: 73847 - DNA, 932 bp, Zea mays
  misc_feature: Ceres CLONE 1558196
  misc_feature: Translation starting site: 139
ctccccgcggtggcggccgctctagaactagtggatcccccgggctgcaggaattcgtctcacccctagaaaaaatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgagggccgtgtggttcaaggcctgctcccagatctccagcgagggtggactgtactacctcgggaaccgaagctcatcaacgcgcaaaacatctcgccattctgggctggcaggtcttgctaatggggcgccttcaaggttaccgaatcgcccggggcccctcggggaaggtttcaaccccgtctttccgggggggaagtttaaaacccgttggcgcccccaaaaaacacccaaaaggcttgggggagaccaggggggaaagggcccaaaaaagggcccccccccccaccgttcccccatgttggagaatttttttccccaagaccacttttaccagggagagagcgccccccaaaaaaaaccgtggaaaaaattttgtggaaccccccacaaaaaaaaagagtggggggggt

SEQ ID NO: 73848 - DNA, 991 bp, Zea mays
  misc_feature: Ceres CLONE 1558197
  misc_feature: Encodes the peptide sequence at SEQ ID NO. 73849
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
ggagctccccgcggtggcggccgctctagaactagtggatcccccgggctgcaggaattcgtctcacccctagaaaaagagaacggagaagagaacaagagatagtacttgacactcctgtcctgctcctcccactcccacgctcccaaccgagctcgagcgcacgcacacgcgcacaagcaggagctcctgtcccgctagatcccaaacagtctcctgcccgcgcgcgtttggggtggcgcgaaggaatcaccggatggcgatgttcgcgcggccgctgctggccaccctgctgctgctgccggcgttcctgctctctgccgcctcggccgccgacagcaagagcaaccctgctgatgagctcgtggcactgatcaacagcaaccgcactgctgggcagggcatctctgtttcggacaaccaaggnnnttggatgcatcgctctgcagtacatcaaagcatacgaagggccattgtgaccaggtggacgacaagaagccgatggagtcaaagctcaccgacccgtttcgccccgacctgggggggtcaaggccacaaccctccccaaaatacccggaaaagctggggggttggccgtccccataattggggcccacttagagcctttgggcttttggttgggaaaaaaccaaaagggcccccaaaaatgcggcaaaaataacccacccaagggcggggggggctttaaaacggccatatgggggggggacccatttttgggggggcccctgtatagagagcaaaacaaacccccctttggggggggggggggaaaaaccaaaggcccccccccccgggggttgtttgggagaaaaaaaaaaaagcgggccccccaaaaaggggccttttaaacaaattggggcccaaagagggggaggagaacttttttttgaaccccctttaagaagagaaaggaaagaagatactcccccctatttttttttcaccaccccccggggggggggagggg

SEQ ID NO: 73849 - protein, 141 aa, Zea mays
  misc_feature: Ceres CLONE 1558197
  misc_feature (58)..(58): Xaa is any aa, unknown, or other
MAMFARPLLATLLLLPAFLLSAASAADSKSNPADELVALINSNRTAGQGISVSDNQGXWMHRSAVHQSIRRAIVTRWTTRSRWSQSSPTRFAPTWGGQGHNPPQNTRKSWGVGRPHNWGPLRAFGLLVGKKPKGPPKMRQK

SEQ ID NO: 73850 - DNA, 939 bp, Zea mays
  misc_feature: Ceres CLONE 1558198
  misc_feature: Translation starting site: 118
ctccccgcggtggcggccgctctagaactagtggatcccccgggctgcaggaattcgtctcacccctagaaaaaattccccaatctagggttgctgagctccccaccactgccggccatgcccgacgcggatgttgacaccgtgattcgcgaagccgccgcggccgcggccccagccggcgacgacgacagcgagggtgacaccgaggaggaggaggaggagggggacgaggtcgacgaggacgaggacgacgacgaggagttacccgccgaggcgccagcaccagacgaggagcaacctgctccagcgcccatgctcgaccttgccggggaatccaaaccagctgacgctggtcttccagggcgaggtttacgttttcgaatccgcaccccccgagaaggttcaagctgtgctgctacttttaggacgtggtgaactaccacctggtttagctggcatggtttttccccatcaaaatgaaaaacaaggctatgacaatttacttcaaaggaaagacattccagcaaaaaaggttgcttccctatttagggttcctggaaaaagggaagggaaagaattttggttaaaaaattcttatggctgtcccaaaaaatgggcccccagagtgcccgtccgaaagggcattttgcggaaaaaccccccgggagggaaaccccccccccccggaagggacccgggtcccgggggctcggcccaattttgcctcccaaaaaaatgggccaaaatgggggcctttggaaaaaagcccccccttttgggtttgggcccggggcccaggtttttttaaaatttgtggtgtttgggggaaaaaaggggcccctttatttcccccgggaaaaaaatattcccccggggcaccccggggggaaaaaaaaaaaacccgccgccgcccaaaaaaatattgtgtggggaagaggg

SEQ ID NO: 73851 - DNA, 961 bp, Zea mays
  misc_feature: Ceres CLONE 1558206
  misc_feature: Translation starting site: 163
  misc_feature (885)..(885): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (927)..(927): n is a, c, t, g, unknown, or other
ggtgctccccgcggtggcggccgctctagaactagtggatcccccgggctgcaggaattcgtctcacccctagaaaaaatagtgcagcaagcaactgcaaagcagcaagctctactcttcttctgtactgaacgtgtgactagataacaataagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggtggtggctacaacaagtccggcggcggcgacgactacggccgcagcggcggcgatgggtatggaaggtccggcggcgacgactacggccgtggcaccggcggcggcgggtacaacaagtccggcaacgacggctacgacagcgggtacaacagatcgggcaccaccaacgacgacgaatacggccgtggcaccggcggcgggtacggcagcaagccctctggcgacgacgcgtacgccggcggcggcggtggcgggtacggcaagcagtccggtggcggcgcggacgatggcggagagtacggctcctcccgggacactcggaaaaaatacaggaaaggaggagaaagagcacaagcacaatgagcacctcggcgagatgggcgccctcgtctgctgcgccttcgccctgtacgagtagcacgagtcgaagaaggacccggagcacgcgcagcggcacaatattctaagaggccttgggcggctgtggctgcccctgggcagcgggcggcttcncgttccccgagcaccacgacagaggaggcaacccnnnccccntatgaacccccccgggtaaaatatataagaccct

SEQ ID NO: 73852 - DNA, 885 bp, Zea mays
  misc_feature: Ceres CLONE 1558207
  misc_feature: Encodes the peptide sequence at SEQ ID NO. 73853
acccgcggtggcggccgctctagaactagtggatcccccgggctgcaggaattcgtctcacccctagaaaaactcgtgcaaaaccctagccctcgcgccgccgcctccttcgccacccagcgctcgagctcctcgctccctgcgagcgcgcgccgctgcgccaccatgtaagtgtcaacatcgcgaacccttcctccgggtgccaaaagaagctggaaatcgatgacgaccagaagctgcgtgccttttatgaccgaaggatatcccaggaggtcagtggtgatgctctgggtgaggagttcaagggttatgtcttcaagatcatgggtggatgtgacaagcaaggcttcccaatgaagcaaggagttttgacttctggtcgtgttcgtcttctgctccatagggggactccctgcttccgtggttatggcaggcgtaatggtgagcgcaggaggaagtctgtccgtggttgcatcgtgagccaagacctatctgttatcaacttggtgattgtgaagaagggtgagaatgatctgcctggtctgactgacactgagaagccaaggatgaggggtcccaagagggcctccaagatcagaaagctgttcaaccttaacaaggatgatgatgtacgcaagtacgtgaacacataccgcaggacattcactaccaagaacggcaagaaggtcagcaaggcacctaagatccaacggcttgtgacacccttgaacctccagaggaagcgtgctagaatcgctgaccagaagaagaggataactaagagaagtctgaggctgctgagtaccagaagctcttgcccagaagctgaaggaacaaagagaccgcccgaccggaactgggcaagtagaaggcccatcctttccg

SEQ ID NO: 73853 - protein, 187 aa, Zea mays
  misc_feature: Ceres CLONE 1558207
  misc_feature (1)..(77): Pfam Name: Ribosomal_S6e Pfam Description: Ribosomal protein S6e
MGGCDKQGFPMKQGVLTSGRVRLLLHRGTPCFRGYGRRNGERRRKSVRGCIVSQDLSVINLVIVKKGENDLPGLTDTEKPRMRGPKRASKIRKLFNLNKDDDVRKYVNTYRRTFTTKNGKKVSKAPKIQRLVTPLNLQRKRARIADQKKRITKRSLRLLSTRSSCPEAEGTKRPPDRNWASRRPILS

SEQ ID NO: 73854 - DNA, 944 bp, Zea mays
  misc_feature: Ceres CLONE 1558209
  misc_feature: Encodes the peptide sequence at SEQ ID NO. 73855
ctccccgcggtggcggccgctctagaactagtggatcccccgggctgcaggaattcgtctcacccctagaaaaaccgaaggccgagctcatccaatccagtcgcctgattgcattgggatcccatggccaagctcgccgtcctcctcctcctcctcgccgtggccgcgtccgccacagtgccggcgcacggccgcgataccccgactgagatcaagctcatcaaaggcacggacgcctccggcgtgggcgacgacagcatggagtgcgtgtacacggtgttcatccggacggggtcgatcttgaaggccgggacggacgcgaacgtcacgctggagctggccgccgcggacggcaacggcgtggggatctcgaacctgcccgcctggggcgggctcatggggcagggctactcctacttcgagcgcagcaacctggacatcttcagcggccgcgggccctgcatggcgaaggcgccgtgctggatgcggctggccaccgacggcaccggcgaccaccacgggtggtactgcaactacgtggaagtcaccaccacgggccccgcacaagtgtgcgggcagcagctgttcaccgtcgagcagtggctcagcaccgacgcccccgccatcaagctcgtaggcgttcgcgactactgcagcggcgacccccagggcgccctcgcggcttgacgtgcccggcgcccggttatagtaaacacagcaccccgccctggactgaacccgcgggggaggctgggtttggttggttgggaacaacccaaaaaatttttgggcccatgggcccccccccccgaaggggaggccccccaagcatggggtttaggggataaacctatttggacccggccaaagttccaaaatcggaacccccccccgggggggggaaggggtttttttttccaagagacctgtggaattttaaccac

SEQ ID NO: 73855 - protein, 187 aa, Zea mays
  misc_feature: Ceres CLONE 1558209
  misc_feature (48)..(172): Pfam Name: PLAT Pfam Description: PLAT/LH2 domain
MAKLAVLLLLLAVAASATVPAHGRDTPTEIKLIKGTDASGVGDDSMECVYTVFIRTGSILKAGTDANVTLELAAADGNGVGISNLPAWGGLMGQGYSYFERSNLDIFSGRGPCMAKAPCWMRLATDGTGDHHGWYCNYVEVTTTGPAQVCGQQLFTVEQWLSTDAPAIKLVGVRDYCSGDPQGALAA

SEQ ID NO: 73856 - DNA, 897 bp, Zea mays
  misc_feature: Ceres CLONE 1558210
  misc_feature: Encodes the peptide sequence at SEQ ID NO. 73857
agctccccgcggtggcggccgctctagaactagtggatcccccgggctgcaggaattcgtctcacccctagaaaaaattcctcctcctgtcctccaccctagccaaagcccctcggatcggatgcggtctcctccgtgtcccattcgccacgcagcggcgccacaggagacggagacggagatgaagctgtccatccagtcgctcgccaggaagctgtccctgccgtccccgaagcggggcggcggcggcatcgtcgaggacgggaagaagaagaagaagcgctcgctgtcgcgcggcgaggcgccgtcgttcgcgtcctcttcttcctcctcctcctcctcctccgccaccacgacgccgcggtccgtgctggcggcggcgccggcgccggcgctggagatcccgcggcaggagctggaggccgtgctgcggagcctgggccacacggagccggccgacgccgagctcgacggcgtggccgcgctcaccgcgcagcccccgccgtgcgacaccgacgccgaatccgacagcaacatcttggaggcggtgcacatgttcgacacggactgataccgccgcttcaccgcctaagagctccgcggcggcatagaaacaatcgtctgtggtgggtgactgctcgacgactgccggcgcgagatccgctgtgtcgacactaacagcaacagcttcgtcagattctggcacttcgcgctcatgatgatggccagcaccgtgtcggccaatgcacgggcatccgagttactgatcgagcacgatgaccgccatagcctgacctgcgccagggaagggatcatctgaagcgtacgccgcgcattagctgcacgaggcgctctatacgtcaaaataataaatgtcgtttcgggatgaggctatca

SEQ ID NO: 73857 - protein, 129 aa, Zea mays
  misc_feature: Ceres CLONE 1558210
MKLSIQSLARKLSLPSPKRGGGGIVEDGKKKKKRSLSRGEAPSFASSSSSSSSSSATTTPRSVLAAAPAPALEIPRQELEAVLRSLGHTEPADAELDGVAALTAQPPPCDTDAESDSNILEAVHMFDTD

SEQ ID NO: 73858 - DNA, 916 bp, Zea mays
  misc_feature: Ceres CLONE 1558211
  misc_feature: Encodes the peptide sequence at SEQ ID NO. 73859
  misc_feature (755)..(755): n is a, c, t, g, unknown, or other
  misc_feature (780)..(780): n is a, c, t, g, unknown, or other
  misc_feature (876)..(876): n is a, c, t, g, unknown, or other
ggagctccccgcggtggcggccgctctagaactagtggatcccccgggctgcaggaattcgtctcacccctagaaaaaagacgaggaggggcacaccacgcaggagaccggaggagagcgcgcgcgcggatccacctcgatgttggcaagaccatcagcaccgcctttggtgactgctcaaactcctgaagtcggcatcttcattacagctcgcaacgtctcgggtgcactggtcgccaagcttcctggtaacaaaaacaagtgtggaggaagatcgaatgtccggcagcggaacatccaacctgggaaaaggggctgtcgtcgggagtggcgggcgctctcagcagctgaccaagcgcaggcttctaccttggacgtagatgaggagtgcaaacgggtgctcactccattgggtttctccagcgaagacgccgagaagatgctgaagaaagcgtttggctggacccactcgccgtactggagcgaggagagggagaaggaggttccgaccgccgaggcggtagctggagtgctggactacatcaagagcctggggctgtcggacgaagaccttggcaggctgctgaagaagttccccgaggttcttgggtgcgacctcgacggcgaggtgaggccgaatgtgggcaagctggacagtgactggggaataaacgggaagaccctgcggagccttctgctgagtaaccccaaagttctgggctacaatgttgactgcagaggggattgcatggccnagtgcacccgctgttgggttaggtnctgatgatggattgggttttgttctccgtcgccacatcgttggtcaggaacctggggacttggttttgcttgcctggcatttttctggtagctagncacctgtcgaatgtagcacatcgctagctgcctggatatt

SEQ ID NO: 73859 - protein, 213 aa, Zea mays
  misc_feature: Ceres CLONE 1558211
  misc_feature (206)..(206): Xaa is any aa, unknown, or other
MLARPSAPPLVTAQTPEVGIFITARNVSGALVAKLPGNKNKCGGRSNVRQRNIQPGKRGCRREWRALSAADQAQASTLDVDEECKRVLTPLGFSSEDAEKMLKKAFGWTHSPYWSEEREKEVPTAEAVAGVLDYIKSLGLSDEDLGRLLKKFPEVLGCDLDGEVRPNVGKLDSDWGINGKTLRSLLLSNPKVLGYNVDCRGDCMAXCTRCWVR

SEQ ID NO: 73860 - DNA, 911 bp, Zea mays
  misc_feature: Ceres CLONE 1558213
  misc_feature: Encodes the peptide sequence at SEQ ID NO. 73861
  misc_feature (543)..(543): n is a, c, t, g, unknown, or other
  misc_feature (544)..(544): n is a, c, t, g, unknown, or other
  misc_feature (548)..(548): n is a, c, t, g, unknown, or other
ctggagctccccgcggtggcggccgctctagaactagtggatcccccgggctgcaggaattcgtctcacccctagaaaaagtgtctcaaacacacgagagctcctcttgtcttgctcagcaatcatatcgcacgagatactattgactccaagtacagaccagtccagtactgttgtacggcctggttccgtggaacagagatgggcaagcaaaagattgtgctcaagttgcccctggatgacgagaggaagaggaggaaggccttcaaggcagctgtgggaatgaacggtgtgacgtccgccacgatggagggcgactagatcaccgtcgtcggcgatggagtcgaccccatcacgctcacaaccatccttctgcgcagcctcggctacgcggagctgctcagcgtcagctccggcgacgacaagaagaagggcgacgggtactgctactggagcgccggtggcatgatgtacggtggcggcggatacggtggtggcaaagagggcaaggagagcaaagagagcagcggcggcagacatggnngccnggttgggggggtcctaacggcggccattacatggcgattgccgtcggttctcgtacccctgccagcctaccagcagtacaacgtccatgcccgcccgtaccccgccagcctactcctagtcctgcagcatacccgcagcaagaacatgaccctggatgcagcatcatgtgaaaaaacatcctacaagtaaatcctgagagttggttgaaggtggccgaaccatgtagatcagattaacatggttgggttcgtaccgacaagatgatccatgctgccttgagctgtgcaacggagatgatgatccagtgagtgatgggcattatcatcgtgtatttagtacaggtttgcaccaagttgacgatg

SEQ ID NO: 73861 - protein, 39 aa, Zea mays
  misc_feature: Ceres CLONE 1558213
MGKQKIVLKLPLDDERKRRKAFKAAVGMNGVTSATMEGD

SEQ ID NO: 73862 - DNA, 954 bp, Zea mays
  misc_feature: Ceres CLONE 1558214
  misc_feature: Encodes the peptide sequence at SEQ ID NO. 73863
  misc_feature (827)..(827): n is a, c, t, g, unknown, or other
ctccccgcggtggcggccgctctagaactagtggatcccccgtggctgcaggaattcgtctcacccctagaaaaaaaaaaaaaaaaaaaaaatcttggtcttgatcctctgagtccgtggccatgagcgtcgtccatgtctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcggcatcatcgacgccgacgtcaagcccgtcggcgacaacgccatctccgtcgacggcaaggtcatcaaggtcgtgtccgaccgcaaccccagcaacctgccgtggggcgagctcggcatcgacctcgtcatcgagggcaccggcgtcttcgtcgaccgcgagggcgcggggaagcacatccaggcgggggccaagaaggtgctcatcacggcgcccggcaagggcgacatccccacctacgtcgtcggcgtcaatgccgaccagtacaaccccgacgagccatcatcagcaacgcctcctgcaccaccaactgcctcgcgccattcgtcaaggtgctcgaccaaanttctgcatcatcaaggcacatgaccacacccactcttacacggggtacattagctgctggacgctagcacacggtactgggcgggggccgcgccgcgggctaaaattgtgccacgtcacggtggcgc

SEQ ID NO: 73863 - protein, 209 aa, Zea mays
  misc_feature: Ceres CLONE 1558214
  misc_feature (36)..(180): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
  misc_feature (203)..(203): Xaa is any aa, unknown, or other
MRRNATSDDFMSAVSFRTHAVGTSGGSRRAPTEAKLKVAINGFGRIGRNFLRCWHGRGDASPLDVIAINDTGGVKQASHLLKYDSTLGIIDADVKPVGDNAISVDGKVIKVVSDRNPSNLPWGELGIDLVIEGTGVFVDREGAGKHIQAGAKKVLITAPGKGDIPTYVVGVNADQYNPDEPSSATPPAPPTASRHSSRCSTKXLHHQGT

SEQ ID NO: 73864 - DNA, 952 bp, Zea mays
  misc_feature: Ceres CLONE 1558215
  misc_feature: Encodes the peptide sequence at SEQ ID NO. 73865
agctccccgcggtggcggccgctctagaactagtggatcccccgggctgcaggaattcgtctcacccctagaaaaacaccgcagccgcagcacattcgcctcgccttcccttccccaccagcccccgtctctctctctctctttctctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggacgagtcgggcggcttcgtcaaggcccccggcggcgcgcccgccaacgtcgcctgcgccatcgccaagctcggcggctcctccgccttcgtcggcaagttcggcgacgacgagttcgggcacatgctggtgaacatcctgaagcagaacaacgtgaactcggaggggtgcctgttcgacaagcaagcgcggacggcgctggccttcgtgacgctcaagcacgacggggagcgcgagttcatgttctacaggaacccgagcgcggacatgctgctgacagatgcggatctggacctgggcctggtgcggcgcgccagggtgttccactacggctccatctcgctcatctccgagccgtgccgctcggcgcacatggccgccatgcgcgcagccaaagccgcgggcgtgctctgctcctacgaccccaacgtgcgcatcccgctctagccgtcgaccgacgccgcacgctgaggcatcctcagcatctggaatgtaggcgacttgctcaacgtcagcgacgactaagtggccgtcctcaggcgcggggacgccacgacgaggagaacgggctgtccctgatggttgaacgctcaagctgctcgtcgtcacgacggggaacaaggatgcaggtactcacaagaatt

SEQ ID NO: 73865 - protein, 186 aa, Zea mays
  misc_feature: Ceres CLONE 1558215
  misc_feature: SWISSPROT Homolog: EC 2.7.1.4 Fructokinase
MAPLGDGGAAAAAASNNLVVSFGEMLIDFVPDVAGLSLDESGGFVKAPGGAPANVACAIAKLGGSSAFVGKFGDDEFGHMLVNILKQNNVNSEGCLFDKQARTALAFVTLKHDGEREFMFYRNPSADMLLTDADLDLGLVRRARVFHYGSISLISEPCRSAHMAAMRAAKAAGVLCSYDPNVRIPL

SEQ ID NO: 73866 - DNA, 916 bp, Zea mays
  misc_feature: Ceres CLONE 1558217
  misc_feature: Translation starting site: 146
  misc_feature (427)..(427): n is a, c, t, g, unknown, or other
  misc_feature (761)..(761): n is a, c, t, g, unknown, or other
gctggagctcaccgcggtggcggccgctctagaactagtggatcccccgggctgcaggaattcgtctcacccctagaaaaagagccacggagagcaaaggcagcacactcagctatccagcaaaagagatcgagacgcaggagtcatggccaccgtcagcgccgccgtggtgaccaccatcgttgcccgcgccgcgatcgccaggcccaatgctctagggctgcctgcgctgagggcgaggagcgagagggtgcggtgcagctacgccaaggacgcggccccagtcagcaccaagggcgcaggcgcgtcgctgctcgccgcagcgggcgcggtgaccgcgtcggcggggcccgcgctggcgctcgtggacgagcgcatgtccacggagggcaccgtggctgagcctcgggctcagcaacaacctgcntggggtggatcctcctgggggtcttcggcctcatctggtccctctacaccatctacacctctgacctcgacgaggacgaggagtccggtggcctctcgctctagatccaccctctcctgttaatgatctgaatgtaaacatggtggcggtcatcggtgtaaatttagacatggctatttgcatctaacaaaaacctggtgttcttctataccacgcgtccacgccactgctaagctgctccccgttcgccaggtcggcgacccaggcgaaacgtgctgctgcaagaagaagataggtacacagacagcatgtccggagttcagcgatgcccgcnggcttgggcgtgcggggctgaaagggtcagggtggttaccaacacagtaccggctgtttcgccgcactgcaaaagaaagtccttcccccggggtgctcggcctgggcctaggggcaaaaccgatctggcgcggagcaggaccaaaagagcctccc

SEQ ID NO: 73867 - DNA, 918 bp, Zea mays
  misc_feature: Ceres CLONE 1558218
  misc_feature: Encodes the peptide sequence at SEQ ID NO. 73868
  misc_feature (696)..(696): n is a, c, t, g, unknown, or other
  misc_feature (713)..(713): n is a, c, t, g, unknown, or other
  misc_feature (714)..(714): n is a, c, t, g, unknown, or other
  misc_feature (734)..(734): n is a, c, t, g, unknown, or other
  misc_feature (889)..(889): n is a, c, t, g, unknown, or other
  misc_feature (890)..(890): n is a, c, t, g, unknown, or other
acccgcggtggcggccgctctagaactagtggatcccccgggctgcaggaattcgtctcacccctagaaaaaaaactccactccagtctccaggctcttttccctgctcctgtgggctgtggcgagcgcaaaccagcctcgcttcccaaaccctagctcctcgctctcccgcccgcgtggcctgccaggcaaccacccccagatcaactccgtacagcgtgcctccgcctcccggactccagcggcggcgggatgtggtctcactccaaggacttgctcgagatcgagcccctcgagctccgattcccattcgagacaaagaagcagatctcgtgctctatgcagttgacaaaccgaacagatgactacatcggctttaaggttaagacgacgagcccgaagaagtactgtgtccggcccaacagcggcatcgtgccacctcggtccaccagcgatgtcattgtgacaatgcaagcacaaaaggaggcgccaccagacatgcagtgcaaggacaagtttcttgtgcaaagtgtcgttgtggcggaagggaccttagtcaaggacatcactggcgatatgtttaccaaagaatcagctaatgtggtggatgaggttaagctgaaggtcgtctacatcccaccacccatacacatccccagtgcatgaggaatctgaagaaggtcatcaccccgaccntcattgtccgattgaanntaacttgattatccagaacnacgagggatctgatgagccactgtgtccccggctggaaaaccctttgatcaaaggacaaccctctgaaaacccgccttgattcaaagtgaaaaaaaaaaaaacccggccttcacaaaaaatagcctccaagaactggaccttcaaggggaacccnncaaccaaaggggaattcccttgggggcg

SEQ ID NO: 73868 - protein, 137 aa, Zea mays
  misc_feature: Ceres CLONE 1558218
  misc_feature (8)..(115): Pfam Name: Motile_Sperm Pfam Description: MSP (Major sperm protein) domain
MWSHSKDLLEIEPLELRFPFETKKQISCSMQLTNRTDDYIGFKVKTTSPKKYCVRPNSGIVPPRSTSDVIVTMQAQKEAPPDMQCKDKFLVQSVVVAEGTLVKDITGDMFTKESANVVDEVKLKVVYIPPPIHIPSA

SEQ ID NO: 73869 - DNA, 958 bp, Zea mays
  misc_feature: Ceres CLONE 1558220
  misc_feature: Encodes the peptide sequence at SEQ ID NO. 73870
  misc_feature (804)..(804): n is a, c, t, g, unknown, or other
ctccccgcggtggcggccgctctagaactagtggatcccccgggctgcaggaattcgtctcacccctagaaaaatatctatctactatatatcgatccacccatccctcgcagctccaaagcattgaagcaaagaaccctgcaactgcaacaagccctgacgcttaatacatcggccggcactcgatcggcagcagatcaaagatggcggcggaggagggggagaaggcgaagagcggcggcggcgggcagcagatgacggtggtgcgggggctggacgtggcgcggtacatggggcggtggtacgagatcgcgtcgttcccgtccttcttccagccgcgggacggccgcgacacgcgcgccacctaccggctgctggaggacggcgccacggtgcacgtgctcaacgagacgtggagcaagggcaagcgcgactacatcgagggcacggcctacaaggccgaccccggcagcgacgaggccaagctcaaggtcaagttctacctcccgcccttcctccccatcgtccccgtcgtcggcgactactgggtgctctacgtcgacgatgactaccagtacgcgctcgtcggcgagccgcgccgcaagaacctctggatcctgtgcaggaagacgagcatcgacgtagacgtgtacatacagctggtggagcgtgccaaggaggaatgctacgacgtgagctagctgcacatgacgccgcaggacgacccgccgtcggagagcgacgccgcgcccacgacaaccaggggggtgtggtggtttcagtcgctctttcggaaatgactgnccgtcaccgcacgcgcgcgttgctccggtacggtgcttgcagttgcacaaataaaccagcccgaatgaattgaagattggaattttagccttgtagatccggccccctatcggggggggtggaactgtgagatgggcgtgtaaccttaacgtgt

SEQ ID NO: 73870 - protein, 165 aa, Zea mays
  misc_feature: Ceres CLONE 1558220
  misc_feature (24)..(166): Pfam Name: Lipocalin_2 Pfam Description: Lipocalin-like domain
MAAEEGEKAKSGGGGQQMTVVRGLDVARYMGRWYEIASFPSFFQPRDGRDTRATYRLLEDGATVHVLNETWSKGKRDYIEGTAYKADPGSDEAKLKVKFYLPPFLPIVPVVGDYWVLYVDDDYQYALVGEPRRKNLWILCRKTSIDVDVYIQLVERAKEECYDVS

SEQ ID NO: 73871 - DNA, 958 bp, Zea mays
  misc_feature: Ceres CLONE 1558221
  misc_feature: Translation starting site: 164
  misc_feature: Pfam Name: Ribosomal_S5_C Pfam Description: Ribosomal protein S5, C-terminal domain
  misc_feature (815)..(815): n is a, c, t, g, unknown, or other
  misc_feature (820)..(820): n is a, c, t, g, unknown, or other
ggagctccccgcggtggcggccgctctagaactagtggatcccccgggctgcaggaattcgtctcacccctagaaaaactttttgcgccgccgcagccccaaaccctcatcccccatcaatctcaggggcgccccagccaccccacccttcactcacctaaccatggcggagcgcggcggcgagcgtggtggagagcgcggcgggttcggccgtggcttcggtcgcggcgggcgcggtgaccgtggtgggcgtcgcggcggccgccgtggcccgcgccaagaggaagagaagtgggttcccgtcaccaagctcggccgccttgtcaaggagaacaagatcaccaagatcgaggagatctacctgcactcgctccccgtcaaggagcaccagatcgtcgagaccctcgtcccggggctcaaggacgaggtcatgaagatcacgcccgtccagaagcagacccgtgccgggcagcgcacccgcttcaaggccttcgtcgttgtcggcgatggcgacggccacgtcggcctgggagtcaagtgcgccaaggaggtggccaccgccatccgcggcgccatcatcctagccaagctctccgtcgtccccgtcaggagggggtactgggggaacaagatcggacagccccacaccgtgccctgcaagtcaccggcaagtgtggctccgtcactgtgcgcatggtgcccgcgcccagaggttctgggatcgtcaccgcgcgcgtgcccaagaaagtgctgcagttcgctggcatttgaggatgtcgttcacctcgttccgtggctgccactagaccctgggncactncgtcagggcaaccttcgactggctgatgaagactacggcttcctcactcctgaatctgggacccataccagttctccatgggcccgtttcagcagttaaccgactgcttgaaaagccaaccaagccctttgggttcag

SEQ ID NO: 73872 - DNA, 900 bp, Zea mays
  misc_feature: Ceres CLONE 1558223
  misc_feature: Encodes the peptide sequence at SEQ ID NO. 73873
tggagctcaccgcggtggcggccgctctagaactagtggatcccccgggctgcaggaattcgtctcacccctagaaaaaacgccacgctctccaacgccacagcttgcgcccgcaatggcactcgtctccgcctcctcgtcctccaccaccgccgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggcatcttcatcccggagttcctgaccaagatcggcgtcctcaacacgcccttctggtacaccgccggcgagcagcagtacttcaccgacaccaccaccctcttcatcatcgagctcatcctcatcggctgggccgagggccgccgctgggctgacatcatcaagcccgagagcgtcaacaccgaccccatcttccccaggaacaagctcaccggcaccgacgtcgggtaccctggtgggcctctggtttgacctgctcggctggggcagcggctcggcggaaaaatcaaggagctgcgcaccaaggagatcaagaacggacgcctcgccatgctcgccgtcatgagcgactggtttcatggcgagtacaccgggaccggccccatcgaaaactcttcgcccacctggacgacccgggcaaaacacccttttccaggctttcaaccccaatgaggagt

SEQ ID NO: 73873 - protein, 192 aa, Zea mays
  misc_feature: Ceres CLONE 1558223
  misc_feature (63)..(191): Pfam Name: Chloroa_b-bind Pfam Description: Chlorophyll A-B binding protein
MALVSASSSSTTAVTALPRNGQRASSSFLGGKTLLRQAEAARPSFAVRAAADPNRPIWFPGSTPPPWLDGSLPGDFGFDPWGLGSDPESLRWNVQAELVHCRWAMLGAAGIFIPEFLTKIGVLNTPFWYTAGEQQYFTDTTTLFIIELILIGWAEGRRWADIIKPESVNTDPIFPRNKLTGTDVGYPGGPLV

SEQ ID NO: 73874 - DNA, 886 bp, Zea mays
  misc_feature: Ceres CLONE 1558224
  misc_feature: Translation starting site: 254
  misc_feature: SWISSPROT Homolog: EC 4.1.2.13 Fructose-bisphosphate aldolase
tggagctcaccgcggtggcggccgctctagaactagtggatcccccgggctgcaggaattcgtctcacccctagaaaaaaaggaaggagaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccaagtacatctccggcgccatcctcttcgaggagacgctgtaccagtccgccgtcgacggccgcaagatcgtggacatccctggcggagcagggcatccctgccgggggatcaaggtgggacaagggccttgttcccgctcgccggctccaacaacgagtcgtggttgcagggcccttggaacgggctgggcgtcccgccgaggcgcctactaccagttctgggggcccgcggtccccccaagtgggggcaccgttcgtccgcattccttaaggccccctccaagctcttcctttaaggaagggcccccgggggggggttctcacccttcacccct

SEQ ID NO: 73875 - DNA, 939 bp, Zea mays
  misc_feature: Ceres CLONE 1558226
  misc_feature: Encodes the peptide sequence at SEQ ID NO. 73876
  misc_feature (939)..(939): n is a, c, t, g, unknown, or other
gcggtggcggccgctctagaactagtggatcccccgggctgcaggaattcgtctcacccctagaaaaaagcgcgtcaggcaatggctccggcaccggtggccgctcccgtggcttcggtctcccgcgcggcagctgcgctcgcccccgccggcgccgtccgctccgccagggtagcctccctgcaccctttccactcttccaccaaaatcgtgctgctgccaccacggaccggcctgctcagatccgccaggcagaggcggcgcttggcggcacggagcagcacctcggagagcagcacggatgactcccaatccccgaaacaagagaaggcgccgttcgggtacacgaggaaagacgtgctgctgatcggcctcggcgtcaccgccttcggcgtcggcctcaagtacgggctcgagctcctgggagttgaccccttgcaggccggcaacgtcgtgcagctgctggtggtgctcgggatgacggtgagggtggatctccacctacatgttccgggtggccaacaaggacatgacctacgcgcaccagctcagggactacgagaagcaagtcatggagaaacggctggagagcttgtcggaggctgagctgcaagctctgctcgagcaagtggaggaggagaagcagcgcgtgcctcatgtcccggaagagcctaacgctattaccttcaggaagaaatgatgatcgttctattatctgccatatggacaccgacctagcttgtttatagcatagcttcgccattcatagctagctgcatcgatatttttagatctgtacaatacgccccgctaaagcactagtgctgtcaacatgaaaatatccatttttctgccgcgcggcgtttatgggacaataccgtagcaccaaagtacaaatcccgtctttgagaatatcattggcgtggtaacttatcatcn

SEQ ID NO: 73876 - protein, 174 aa, Zea mays
  misc_feature: Ceres CLONE 1558226
MAPAPVAAPVASVSRAAAALAPAGAVRSARVASLHPFHSSTKIVLLPPRTGLLRSARQRRRLAARSSTSESSTDDSQSPKQEKAPFGYTRKDVLLIGLGVTAFGVGLKYGLELLGVDPLQAGNVVQLLVVLGMTVRVDLHLHVPGGQQGHDLRAPAQGLREASHGETAGELVGG

SEQ ID NO: 73877 - DNA, 913 bp, Zea mays
  misc_feature: Ceres CLONE 1558229
  misc_feature: Encodes the peptide sequence at SEQ ID NO. 73878
ctggagctccccgcggtggcggccgctctagaactagtggatcccccgggctgcaggaattcgtctcacccctagaaaaaatagcactgccgcatgagaagatagcaccgcccgctgcaatgaaccgcgcttcttggttgctccttgttctggtgcagctctcttgcttgcactgctactcagccacccaccatggcggcggccggaagcacggacgcccactactacacgcgcccgccaacatcgtcgtcggctccgttgtcgtcgtccactccggcagctccgaggctaccaccaccgccgtttcttcaggcaccctggtcggggtccgctgccacgacgggaacggccggacggtgttccggaaggacggcgtcgtgacggaccgcagcggcaggttccgcgtgcacctcgcgcacgggccaagcagcggcagcagcagcagccaccagctccggtccgtcacgtcctgctcggtggcggtgcacctcccgcaggcgtcgccgccgtgcgtcgccaccgccagctccgctcgcgggctccacctcgtcgcccaccacaacaagcacgaccacggcggcggcactcgcgtcttctccgccggcgccttctccgtccgcccggagctctgcagcaacaagggcctgttcttcccgccggtcccgctcgtgccgggccacccaacggtcggcggcgtgccatccccgccaaccccgtcacgccccgcccggcgtccctcgttgcggcgcttctgcctaccccgtctccgccgtccgtcctgccaccgcttgtccacagccaccgccgtcgtccgtaattacccccttggtgcccgttggttaacccgccgccgccgcaccgccgcccagcttttttcacccctgggtgccgtccttccctcgggggtgcccgt

SEQ ID NO: 73878 - protein, 264 aa, Zea mays
  misc_feature: Ceres CLONE 1558229
MNRASWLLLVLVQLSCLHCYSATHHGGGRKHGRPLLHAPANIVVGSVVVVHSGSSEATTTAVSSGTLVGVRCHDGNGRTVFRKDGVVTDRSGRFRVHLAHGPSSGSSSSHQLRSVTSCSVAVHLPQASPPCVATASSARGLHLVAHHNKHDHGGGTRVFSAGAFSVRPELCSNKGLFFPPVPLVPGHPTVGGVPSPPTPSRPARRPSLRRFCLPRLRRPSCHRLSTATAVVRNYPLGARWLTRRRRTAAQLFSPLGAVLPSGVP

SEQ ID NO: 73879 - DNA, 881 bp, Zea mays
  misc_feature: Ceres CLONE 1558231
  misc_feature: Translation starting site: 465
  misc_feature (635)..(635): n is a, c, t, g, unknown, or other
  misc_feature (861)..(861): n is a, c, t, g, unknown, or other
ggagctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagtctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggcntgccaggtcgtgctcatgggcgccgtcgagggctaccgcatcgccggcggccgcttctgcgaagtcgtcgacccgctctatccctgctgcagcttcgaaccgctcggcctcgccgtactaccccgaagcctcgctgagctcaaggtgaggagctcaagacggccgcctcggcatgggtctccatgttcggattcttcgtcaaggccatcgtcaacgggtaggcccngctcgagtacttcgctgact

SEQ ID NO: 73880 - DNA, 953 bp, Zea mays
  misc_feature: Ceres CLONE 1558232
  misc_feature: Encodes the peptide sequence at SEQ ID NO. 73881
  misc_feature (825)..(825): n is a, c, t, g, unknown, or other
  misc_feature (826)..(826): n is a, c, t, g, unknown, or other
  misc_feature (839)..(839): n is a, c, t, g, unknown, or other
  misc_feature (868)..(868): n is a, c, t, g, unknown, or other
  misc_feature (907)..(907): n is a, c, t, g, unknown, or other
  misc_feature (953)..(953): n is a, c, t, g, unknown, or other
gcggtggcggccgctctagaactagtggatcccccgggctgcaggaattcgtctcacccctagaaaaaatctcgtacctcacttccgtcccgcccagcttcgcttcacggcgcgccgaccggcttggacgcgccgaccggctcgtgatcagctcggtcggatccgacggtcgctcgctgctgcagcgggcgcttgctgtgcgtcgcgtgggctcggccggagcccggagggaggcggagccttccccgggtctcgaagatggcggcgccgccggcgagggcccgggccgactacgactacctcatcaagctgctcctcatcggcgatagcggtgttgggaaaagttgtctccttttgcggttctcagatggctctttcaccactagctttatcaccaccattgggtaagcactgctagtgtcgaaaatcagttagttttgaatggatcattattttcaaatgaatgctgctattagaaaaaaaggcagacccagtgccagaggctcccacatgagtggggtctggggaagagataaactgagacaagcctcccctcacaaatgcggagaggttgcttccagtcctcgacctggtgactcagtgggacagctctcatcactgcatcaggcctgccctttagaatgctactattagaatatttctaaaatagtttatattttatctttaaaaaggattgacttcaaaataagaacagttgagcttgatggtaagcgcgtaaagttacagatatgggatactgctggtcaagagcggtttcgtactattactaccgcctactacaggggtgcaatggggaatttcgcnntgtctatgatggntactgatgagtcatcttttcatatattangaaactggattaggtacatagagcacatggcttccgacnatgtggataaaattttgggtaggcacaaagctgacatggatgaaan

SEQ ID NO: 73881 - protein, 49 aa, Zea mays
  misc_feature: Ceres CLONE 1558232
MAAPPARARADYDYLIKLLLIGDSGVGKSCLLLRFSDGSFTTSFITTIG

SEQ ID NO: 73882 - DNA, 938 bp, Zea mays
  misc_feature: Ceres CLONE 1558233
  misc_feature: Translation starting site: 157
ggagctcaccgcggtggcggccgctctagaactagtggatcccccgggctgcaggaattcgtctcacccctagaaaaaatctcggtccttacttgcgtatcgctcagctttgcttcactgaggacctactggcttgctcgcgttgaccggatcctgatgagatcggtcagatccaacaggctctccctgctgcatccggcactggccgggtgtctcgtgtgctcggacggagcccacgtaggaggcggagccttaccagggtctcgaatatggcggcgccgccggcgagggccctggccgactacgactacgctcagcaaggttgtcctcatccgctataacggcgtcgggaaaaatcgactccttgtgcggatctcagatgggtctttcatgtctagcttcaccaccacctgttgagtaagcactgctagggccgaaaatcagattgttttgaatggatcattattttcaaatgaatgctgctgttagagaaaaaggtagacccagtgccagacgctcccacatgagtggggtctggggaagagatagactgagacaagcctcccctcacaaatgcggagaggttgcttcctgtcctcgacctgctgactcagtggagacatctctcatcactgcatgatgcctgccctttaaaatgctactattagaatattcccaaaatactttatattttatcttctaaaaggattgactacaaaataaaaacagttaagctcgatggttagcgccttaagataacaatacgggataccgctggtcaagagccgcttcctaactattaccaccgcctacccagggggcgcaattgggaatttcccttgcccatgatgtaacgatgaagaatccttccaaaaaatagaaaccggatttggaacgggggccacctgccttcggaaatggtgaaaaaatcttgggag

SEQ ID NO: 73883 - DNA, 896 bp, Zea mays
  misc_feature: Ceres CLONE 1558234
  misc_feature: Encodes the peptide sequence at SEQ ID NO. 73884
ctccccgcggtggcggccgctctagaactagtggatcccccgggctgcaggaattcgtctcacccctagaaaaaatctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccgccgcctcctgctgctaccccacccccttcgtccagcggcaagtgcccgctgaacgcgctcaagttcggcgtgtgcgccgatgtgctcggcctcgtcaaaggcgaggttggcaaggtgcctgccgagccatgctgtaccctcatcaaaggccttgcggacttcgaggccgccgtctgcctctgcacggccatcaaggccaacgtgctcggcgtcgtcgtcgatgtccccatcaagctcagcgcgctcgtcaactactgtggcaagtgcgtgcccaagggctacatgtgcgcgtaagcagctcctggcggttacacactcgtagctgttcacgtacgagattatatatgcacgcaccctgcatggcacgaatgcatgcattgtgtccgctgatatatctctcctgtctcagttgtgcacctagccttcggttctacaaaacctagatacattccagccaaatacttgtcagttcaattcgcatgtattgtctcttgttgaattcccattatttttcttttgtatgtgggcatttacctcgtaagagtgcgacaccttctcagaggaaaaaaaaggggggtgttagcttgctagttcttatatctacgaatcatgtaatcttgtgagagtccatttgatgtgcatgtaa

SEQ ID NO: 73884 - protein, 133 aa, Zea mays; identical to SEQ ID NO: 52393
  misc_feature: Ceres CLONE 1558234
  misc_feature (51)..(132): Pfam Name: Tryp_alpha_amyl Pfam Description: Protease inhibitor/seed storage/LTP family

SEQ ID NO: 73885 - DNA, 916 bp, Zea mays
  misc_feature: Ceres CLONE 1558235
  misc_feature: Encodes the peptide sequence at SEQ ID NO. 73886
  misc_feature (863)..(863): n is a, c, t, g, unknown, or other
  misc_feature (874)..(874): n is a, c, t, g, unknown, or other
  misc_feature (895)..(895): n is a, c, t, g, unknown, or other
ctggagctccccgcggtggcggccgctctagaactagtggatcccccgggctgcaggaattcgtctcacccctagaaaaacgcgtgggttctgtcacttctgtgacttctgtctgcgtctcgctctccggcgactggtgggccgccgccaccctaagccagttgccgaggtttacattggtctcttcgccggcgacgagcacccaccacgagtcttgacaagtttttccaatggaccaagtaccgaatggaaggcataaggtttcttttgcgaagccaagagtacttgtgctttcagattctgactctgactctgaaggttttgtagaagagctaactcctgttcactcaaagtcaaacgggaaggcttcatctgcgagcctaaaaactggtggaaaggcttcagcctgtttctaaaggtgaggcaagcaaaggaaaagcatacagtagtgacaaaggtggaaagggttcttcatcacatgcagtgcctaccaagtctgatgcagaactaaagctagagcttgatatccctccaaattctagaatgctaatgaattgtgaagcagctgaactattgcaagaaattcatgagcacatggctatactatcagaggaccccaagatcaaaattcctgagtcatttgacaaagcttttcagtattcaaaagatggaaatcatttcaccactgcaagctctgtgaaacaagccattgaacctcttaaaaaatgtggggtcagtgatggagagatatgcatgatagcaaacattggagcctgagaccgttgaagaggtttacgcactagtggcatctctcaagctgataggtcagctatcgaaacgtcagtcaccgaggtgcttagcgnctcgcatactnaaggctgcgtagtgatctccnatggactagaccgacatctac

SEQ ID NO: 73886 - protein, 77 aa, Zea mays
  misc_feature: Ceres CLONE 1558235
MLMNCEAAELLQEIHEHMAILSEDPKIKIPESFDKAFQYSKDGNHFTTASSVKQAIEPLKKCGVSDGEICMIANIGA

SEQ ID NO: 73887 - DNA, 874 bp, Zea mays
  misc_feature: Ceres CLONE 1558236
  misc_feature: Encodes the peptide sequence at SEQ ID NO. 73888
ggagctcaccgcggtggcggccgctctagaactagtggatcccccgggctgcaggaattcgtctcacccctagaaaattgccttccccttccgctcgagtctgctctagggtttttgccaagccgccgtcgccgtcgctctgccctcgtatcccctcccacgacaccgagacaccaagatgacggcgcagaccgcggaggagctcgccacccagatcgagcagcagaagctcgaggagcagaagaccgaggcagaggaagttgtggtggaggatgaggaggaggaagatgaggacgatgacgatgatgacaaggatgatgatgaactcgatggggatgccagtggcaagtcaaagcaaagcaggagtgagaagaagagccgcaaggccatgctgaagcttggcatgaagcccatcactggtgtcagccgcgtcactgtaaagaaaagcaagaatatactctttgtcatctccaaaccagatgtgttcaagagcccgaattccgacacgtatgtcatattcggcgaggctaagatcgaggacctcagctcccagctgcagacccaggcagcagagcagttcaaggctcctgacttgagccagatgatcttgaatccagagacgtctggcccgggacaggaggacaatgatgaggatgtcgacgaaactggtgttgaggccaaggacattgagctggtgatgacccaggcatctgtctcaggcccaaagctgtcaaggccctcaagggctactatggggacttgtcacggccatcatggatctgacacctagggtgatattgctgtccgtgcactttttgttttggagtgctttgcaacttgagtgtatatgtggacctatgcttcgaggatgtgt

SEQ ID NO: 73888 - protein, 203 aa, Zea mays
  misc_feature: Ceres CLONE 1558236
  misc_feature (62)..(121): Pfam Name: NAC Pfam Description: NAC domain
MTAQTAEELATQIEQQKLEEQKTEAEEVVVEDEEEEDEDDDDDDKDDDELDGDASGKSKQSRSEKKSRKAMLKLGMKPITGVSRVTVKKSKNILFVISKPDVFKSPNSDTYVIFGEAKIEDLSSQLQTQAAEQFKAPDLSQMILNPETSGPGQEDNDEDVDETGVEAKDIELVMTQASVSGPKLSRPSRATMGTCHGHHGSDT

SEQ ID NO: 73889 - DNA, 877 bp, Zea mays
  misc_feature: Ceres CLONE 1558237
  misc_feature: Encodes the peptide sequence at SEQ ID NO. 73890
ctggagctccccgcggtggcggccgctctagaactagtggatcccccgggctgcaggaattcgtctcacccctagaaaaagtgccagcgcccagcaggccattctgctcgccttactccctcacagaacccagtaaaatattgccagtcccgccatcgagatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttcgccgtcaggtacggcaagagctacgagagcgcggcggaggtccataagcggttcaggatcttctccgagagcctccagctggtccgctccaccaaccgcaaaggcctctcctaccgcctcggcatcaaccgcttcgcggacatgagctgggaggagttccgtgcgacccggctcggcgcagcccagaactgctccgccacgcttaccggcaaccaccggatgcgcgccgccgccgttgcgctgccggagacgaaagactggagggaggatgggattgtgagcccagtgaaaaaccagggccactgtggatcatgctggaccttcagcactactggtgcacttgaggctgcatatacccaggcaactggcaagcccatctctctctctgagcacagcttgttgactgtggttttgcattcaacaatttcggatgcaacggatgccttcctcccagggccttgaatactcaaatacaatggtggccctgacactgaaggatcttacccttaccaagtgtcaagggatctgcaa

SEQ ID NO: 73890 - protein, 215 aa, Zea mays
  misc_feature: Ceres CLONE 1558237
  misc_feature (59)..(115): Pfam Name: Inhibitor_I29 Pfam Description: Cathepsin propeptide inhibitor domain (I29)
  misc_feature: SWISSPROT Homolog: EC 3.4.22.16 Cathepsin H
MAPRRLLVLAVLALAATAAAANSGFADSNPIRPVTDRAASALESTVFAALGRTRDALRFARFAVRYGKSYESAAEVHKRFRIFSESLQLVRSTNRKGLSYRLGINRFADMSWEEFRATRLGAAQNCSATLTGNHRMRAAAVALPETKDWREDGIVSPVKNQGHCGSCWTFSTTGALEAAYTQATGKPISLSEHSLLTVVLHSTISDATDAFLPGP

SEQ ID NO: 73891 - DNA, 969 bp, Zea mays
  misc_feature: Ceres CLONE 1558238
  misc_feature: Encodes the peptide sequence at SEQ ID NO. 73892
  misc_feature (829)..(829): n is a, c, t, g, unknown, or other
  misc_feature (876)..(876): n is a, c, t, g, unknown, or other
  misc_feature (877)..(877): n is a, c, t, g, unknown, or other
  misc_feature (897)..(897): n is a, c, t, g, unknown, or other
ctccccgcggtggcggccgctctagaactagtggatcccccgggctgcaggaattcgtctcacccctagaaaaaaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctagctagctagctcctgcgtgagctagtagctagtgccatgcgtcgtctctgtcgttcggttttgcttcgggtcaccgtgtaccctttgctttgctgggttcttctttcctttttacatttgtttttcttcttttccccaggcatggantccttgcttttccagcagtctctggctggatgtgaatgtatccatgnntgcaatcatgggcttgcatngggctacctctatacctgctacaaaactactgcaacgctattaattccttggggggtgaggaaaaaaaaaaa

SEQ ID NO: 73892 - protein, 170 aa, Zea mays
  misc_feature: Ceres CLONE 1558238
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSTASLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 73893 - DNA, 897 bp, Zea mays
  misc_feature: Ceres CLONE 1558240
  misc_feature: Encodes the peptide sequence at SEQ ID NO. 73894
  misc_feature (852)..(852): n is a, c, t, g, unknown, or other
ctccccgcggtggcggccgctctagaactagtggatcccccgggctgcaggaattcgtctcacccctagaaaaaactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggctagcggcgagaagaagcaccaccacctcttcggctgaccgtagtaccggccggcgcgcgaccgagagctagctagctccggcgcacacaaccacacacctgtttaattctgtactgcatgcgtgtgtaatttgatggttcacaataatgagtccctctccggaccttggtagctgcttgcttgtggtgagtgagagtgtagactgagggaaaaaaaagtgggtttgggccttgggggctacctccaagagaagcgtgttcctgtactcgcttcgttttctctgcatgcggtgtataattgtgttcaatataaatgaaaancggtcgtgatgtgtggctccccttgtcaggctcatgtgtatccgt

SEQ ID NO: 73894 - protein, 131 aa, Zea mays
  misc_feature: Ceres CLONE 1558240
  misc_feature (41)..(120): Pfam Name: ABA_WDS Pfam Description: ABA/WDS induced protein
MSEEKHHHFFNHHKKDEEQPAGEYGYSETEVVTATGEGEYERYKKEEKEHKHKQHLGEAGAIAAGAFALYEKHEAKKDPEHAHRHKITEEVAAAAAVGAGGYVFHEHHEKKKDHKDAEEASGEKKHHHLFG

SEQ ID NO: 73895 - DNA, 887 bp, Zea mays
  misc_feature: Ceres CLONE 1558243
  misc_feature: Translation starting site: 246
  misc_feature (537)..(537): n is a, c, t, g, unknown, or other
  misc_feature (811)..(811): n is a, c, t, g, unknown, or other
  misc_feature (857)..(857): n is a, c, t, g, unknown, or other
ctggagctccccgcggtggcggccgctctagaactagtggatcccccgggctgcaggaattcgtctcacccctagaaaaagcttctcatttggggcctgagcaacccgcaaccaccgcacgttaggtactaccgagaggcacaggccggcaagaaccgagctagctaataatcagggaagctgcctggaaaaagtctcggccttcgtcttcgcagcgctgtgtagacgagtactcgatcggcgcgatggaggggtcgacgacgacgaccgaaggccacgtggttgggatcccggtgagcaccagggcttatggcatcgaggagcccgacttcccggcggaggagacgcagacgcccgaccacggagaattcccgagctccttccagtacaacgacagccatgatgctaccagttcaacgacgaccaccgatcggccgacgagcgatctacaaggcaccacctgcaggaagggaggcagtatcgctcagggcatctaagagcacgtgaccctggggccaaacctttcggacacggtgnaaggggaagttctccctggcggcgaatatcgtgcgggccggcggcgtggagaaggtgttccggcggtggttctccgcggactagaacgagaagctgctgcaggcctcgcagtgccacctgtctactacagccgggcccatcgccggcgtgctgttcgtgtcgacagcgcggggtggccttcgcagcgaccgggcgctgggcgtgccggtgccggtgcccaaccccgcgcagctggaccgtcgcgcgtgccgtacatggtgacatcccgctgccntaaagtaagggctgtgcggccctcgagatacaacaccggccggaancaaaatacgtgcggctcgcaccacccgacg

SEQ ID NO: 73896 - DNA, 904 bp, Zea mays
  misc_feature: Ceres CLONE 1558244
  misc_feature (833)..(833): n is a, c, t, g, unknown, or other
tggagctccccgcggtggcggccgctctagaactagtggatcccccgggctgcaggaattcgtctcacccctagaaaaaatagtgaggatgatgtgcacaagagtataaaatacaatgtgtgggctagcactcctaatggaaataagaagctggatgctgggtaccgagaggctcaggagaaatccaatgactgcccggtgttcttgtttttctctgtgaacacaagtggtcagtttgttggtgttgctgaaatggttggtcctgttgactttgataagactgtggagtattggcaacaagacaagtggaatggttgttttccactcaagtggcacatagtcaaggatgtgcccaacaacactttgaagcatattacactggataacaatgataataagcctgtgacaaacagccgtgacacacaagaggttaagctggaacaaggtcttgaaatgttgaagattttcaaagaacatgttactaaaacgtcaattttggatgattttggtttttacgagaatcgccaaaagttgatgcaggaaaagagggcgaatcagcaactgcttcaaggccagggggggcgatgtttctcaagagaaagacaaggatgcgactaatggcaaaccagagtcacagaaacaggcaacgagcaaggaaggcactcctgctgaggtggcggcggatgcctccaaaccagtagctgaaagtggaatatcaaatgacaactaagcatcatgcatactggtcggcaccataccggtgcaaatgctgcatgttttgcggtatctgcaatcaaaacctattgattctgcctgaattctgacttctttcngtactggagtcgtgagatgggctcatgggagtgatcagatttactattggcccttgctagttggggactgg

SEQ ID NO: 73897 - DNA, 925 bp, Zea mays
  misc_feature: Ceres CLONE 1558245
  misc_feature: Translation starting site: 122
tggagctccccgcggtggcggccgctctagaactagtggatcccccgggctgcaggaattcgtctcacccctagaaaaaaccaacctcagcacaccaaggagagtacgtggaggagcagccatggcttcatcggtggccgccgcggcgagcacattcctgggaacccggctggcggacccggctccacagaacgggcgcatcgtggcccggttcgggttcgggttgggcgtgcaaagcaaagcctgctccgaagaaggtggcgaagacatcaacctcctctgaccggccgctgtggttccccggcgccatggcgcccagaatacctggacgggtcgctggtctgagactacggatttccacccgttatgtctcgggaagcccgtggagtacctgcagatcaagttggactcgatggaccagaacctggccaagaatgacgtcggcggcatcatcagacaccggatcaagtcctccgaagcaagtccaccaccttgcagccctacatcgaggtgttctgcctccagctggtcctgtagtgctaaatcatgcaagggcgttggggccatgctcggcaccctgaggtgccttttcctaagagtggctcaccggctccgcatggcaagaccccggacaaggtggagctggtgaaccggccctcccttcctgggccaaccgttcccgttaaccttctccacctgatgggaaaaaaggtgccccgtaacccgctaaattggattccagggaaagccgaaacccggacgggaaataagccccccggggggggccctttttcaaacccgttgcctttgggggggaccgtaaaataaaaaccgccgcccggggaaataaaaccgccggtctccccagggcccctcccggttagccggggggagccccccccggaaggggccccatttggggccc

SEQ ID NO: 73898 - DNA, 995 bp, Zea mays
  misc_feature: Ceres CLONE 1558246
  misc_feature (368)..(368): n is a, c, t, g, unknown, or other
  misc_feature (370)..(370): n is a, c, t, g, unknown, or other
  misc_feature (664)..(664): n is a, c, t, g, unknown, or other
  misc_feature (693)..(693): n is a, c, t, g, unknown, or other
  misc_feature (719)..(719): n is a, c, t, g, unknown, or other
  misc_feature (726)..(726): n is a, c, t, g, unknown, or other
  misc_feature (742)..(742): n is a, c, t, g, unknown, or other
  misc_feature (799)..(799): n is a, c, t, g, unknown, or other
  misc_feature (815)..(815): n is a, c, t, g, unknown, or other
  misc_feature (880)..(880): n is a, c, t, g, unknown, or other
  misc_feature (915)..(915): n is a, c, t, g, unknown, or other
  misc_feature (917)..(917): n is a, c, t, g, unknown, or other
  misc_feature (932)..(932): n is a, c, t, g, unknown, or other
  misc_feature (968)..(968): n is a, c, t, g, unknown, or other
  misc_feature (969)..(969): n is a, c, t, g, unknown, or other
  misc_feature (974)..(974): n is a, c, t, g, unknown, or other
  misc_feature (995)..(995): n is a, c, t, g, unknown, or other
acccgacgtgacggccgctctagaactagtggatcccccgggctgcaggaattcgtctcacccctagaaaaaaatcaagctgcccattccctcgtgacagcagctgcctgcctgctccgaggcgccacccagctcttcctcgccccagcagccgcttcccgagatccttttcactttcaccaccagggtacatagaccgcatctgcggtgctctgcgctcctcggactcgatttgttggatcatccatccagctgccgccggacgtcgatcagctacctatcttgaaaccacaggaccgagcgtggaaactcccggaccggaaaatccaattttcattcctcaccccccggtgagaaggggggggatnantacaacccaaggtgaagagacctgtggggcaagtatgagaccaggccggaacataagggaaggggcaccctcgccaaagtgaagggtcgctaagggacacgctccaccggcggaggccatgaccccttaaaatcccgggaccaaggagaaagggccccctagagcaaaaattggttgagcccaatccaggggggggggatctgccaccgaaaaaaagtagtatgcgaccccccccctaaacggccggtgcgacctattgaatcaaagggggatctggggcaaagtagtaacatncaggggagtcgcccatcgggggggacggngaaaatccccccggcaaccgagcagnaaccccntgaccttttagaatancacaatctattttaacgagtggggggtgcgaccatcgaaaaggagagaaggaagggngctccgcggtgtcgcnctctgtccccggcgatgagaacggtataacgacgacagccggtgcccacagaccagaccgcttcntaaggaggcgacgggagcgtgcagtgcaaagttcntntttgaagtacagttngtttagcaacacagcgcgcagattcggaccgcgtgnntgagngtgtggcgagcacgcggtggn

SEQ ID NO: 73899 - DNA, 907 bp, Zea mays
  misc_feature: Ceres CLONE 1558248
  misc_feature: Translation starting site: 230
tcccgcggtggcggccgctctagaactagtggatcccccgggctgcaggaattcgtctcacccctagaaaaaagatctcaagtcttatcgctcctcgtcatcacatggaacctgtgtcaggagaatcagcgctttggcgagcagcaccatggccctctcctgcctctggcttcgccggccaggcagtgaacgtgccgtcatctctcttctgcgaggccctgggtgactgatgcacgtgacggccgcgaacgcaaagccggccgagagctcccgcaggccgtggaacgggcccgacggcgtgctctacctgggacctgtgtccggcgagccccagagctacctgtacaggcgagtgtctcctggctactactgatgggacacacgctgggctgtccgaggacccggagaccttcgacaacaaccgggagctggatgtcatccactcacactgggccatgctgggaacgttgggctacgtgttagctgatctgctcgcccgcaacggcgtatacttcggcgaggccgtgtgaggtcaacgccggaggcaggagatcttcagctgaggtgggctggactacctaggaaacccgagcctgatacactgtcagagaatcctagccatctgggcctgacgagctctgctcataggagccatagaggggtaccgcttctcctgctgcccgctcggagaggtcgtcgacgcggtctgccgctgctgctgattagacccactatgcctccgagaagagcctgacgcactcgcggagctcaacgtgacgagctcaacaaggacgcctcgcatgttctcatgttagtgtcctcgcccagcatgctgaccgcaaggaccgttcgtaactagctacagctcgcgaccgttacaaaagggtgggcctatgcaccactttgc

SEQ ID NO: 73900 - DNA, 939 bp, Zea mays
  misc_feature: Ceres CLONE 1558250
  misc_feature: Encodes the peptide sequence at SEQ ID NO. 73901
ctccccgcggtggcggccgctctagaactagtggatcccccgggctgcaggaattcgtctcacccctagaaaaaagcctcctcgcaggtgaccttgcgtacgtacgtcgtagcggctcgtccagctcgctcgccaccgccatggacccgtacaagcaccgcccgtcgagcgccttcaacgccccgtactggaccaccaactccggcgcccccgtgtggaacaacgacagctccctcaccgtaggcgcacgaggtcccatcctgctggaggactaccacctggtggagaagctagccaacttcgaccgcgagcgcatcccggagcgcgtggtgcacgcgcgtggcgccagcgccaagggcttcttcgaggtgacccacgacatcacccacctgacgtgcgccgacttcctgcgcgcgcccggggtgcagacgcccgtcatcgtccgcttctccacggtgatccacgagcgcgggagccccgagacgctgcgcgacccgcgcgggttcgccgtcaagttctacacccgggagggcaactgggacctggtgggaaacaacttccccgtcttcttcatccgcgacggcatcaagttcccggacatggtgcacgcgctcaagcccaacccgcggacgcacatccaggacaactggcgcatcctcgacttcttctcgcaccacccggagagcctccacatgttctccttcctcttcgacgacgtcggcatccccgccgactaccgcacatggacggatccggggtgcacacgtacacgctcgtcagccgcgccggcaccgtcacctacgtcaagttcactgggcgcccaccctgcgcgtgcgctcgctgatggacgacaaggccgtcgcgtttaggcgcgcctacaacagcacgccacaatgaactcacggacgccatcgccgcggggtaactccccgaattgaa

SEQ ID NO: 73901 - protein, 242 aa, Zea mays
  misc_feature: Ceres CLONE 1558250
  misc_feature (18)..(242): Pfam Name: Catalase Pfam Description: Catalase
  misc_feature: SWISSPROT Homolog: EC 1.11.1.6 Catalase
MDPYKHRPSSAFNAPYWTTNSGAPVWNNDSSLTVGARGPILLEDYHLVEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSFLFDDVGIPADYRTWTDPGCTRTRSSAAPAPSPTSSSLGAHPARALADGRQGRRV

SEQ ID NO: 73902 - DNA, 930 bp, Zea mays
  misc_feature: Ceres CLONE 1558254
  misc_feature: Encodes the peptide sequence at SEQ ID NO. 73903
  misc_feature (831)..(831): n is a, c, t, g, unknown, or other
  misc_feature (928)..(928): n is a, c, t, g, unknown, or other
ggcggccgctctagaactagtggatcccccgggctgcaggaattcgtctcacccctagaaaaagagatacccgttttacttcctcgctccccaccaatacgacggattaaatctcctgccttcgtcgggtgctctcggccgctagacagccacaaagtgcctcgcccgctcccttcagcgtggcggcacctcttcttcctgctccgagctcgcgtatctaccttttcctcagctgctgatggaactgtgtatcggctcctcttccagaactttctcctgttacccaaaaccatgttccgaaacagagatctatactatatcatgaacaaccgtcctaaaaggacggtagacgtattctctatctagcacgtgggttgaatttacctgtcgactatagtgcgaatgcggataagcgttaagcaatattttaattttgtgctaaaagggaataggcatgaagccatagagctgacagaagaaatggaacctaacgtgctagagaatgataccgatctacattatgatcatgctactctccacataattgagcgaggacacttcgaaagaattacacacaatctctcgaatgtagccagaacaaaatgacatcatttcagaaggttaccaactataatgagaaagtagaggactctatggccctcatgtcttatgaagagcctgacgagtcacctatgtttcatctaataaacccagagcacacgcagaatgtcgcatagggcttgaaacaggctgtacttgcacaagctaatcctccaaggatatgatccttggaagaggacgtccaaccaggaactagcgttcgacgatacntacaggaagaagtggctacgatctttactacggtttgcttcgatgccatactgagcagtcaatgtgcaactgtcacttattaggaactggtacaccntg

SEQ ID NO: 73903 - protein, 44 aa, Zea mays
  misc_feature: Ceres CLONE 1558254
MTSFQKVTNYNEKVEDSMALMSYEEPDESPMFHLINPEHTQNVA

SEQ ID NO: 73904 - DNA, 874 bp, Zea mays
  misc_feature: Ceres CLONE 1558255
  misc_feature: Encodes the peptide sequence at SEQ ID NO. 73905
  misc_feature (793)..(793): n is a, c, t, g, unknown, or other
ggagctcaccgcggtggcggccgctctagaactagtggatcccccgggctgcaggaattcgtctcacccctagaaaaactctcgcgccgccacttccctcccgaccctctcgcccaaaaccgtagcgccctcgcctgctcgccgccgccgtcgttgcgagctccccatcttcctccgttaaccatggcgacccagatcagcaagaagaagaagttcgtcagcgacggcgtgttctacgccgagctcaatgagatgctgacgcgggagctcgcggaggacggctactccggcgtggaggtgcgtgtcacaccgatgcgcacggagatcatcatccgcgcaacgcgcacgcagaacgtgctcggcgagaagggccgcaggatcagggagctcacgtctgtggtccagaagaggttcaacttccccgagaacggcgtctagctctacgccgagaaggtcgtcaaccgcggcctctgcgccatcgcgcaggctgagtccctccgctacaagctcctcggaggccttgccgtccggagggcctgctatggtgttcttcgctttgttatggagagtggtgccaagggttgtgaggtcattgtgagtggaaagctcagggctcaaagagccaagtccatgaagttcaaggatggctacatgatctcatctggtcagccagtgaatgagtacatcgactcagctgtgagacacgtcctcctcagacagggtgttctgggtatcaaggtgaagatcatgcttgactgggaccgaatggcaagttggcccgatcaccctcttncggaactggtgacatgcataccccgaaggaagagacgagctgccgcctcctggtctggcagctgaagtctaaggtcccaat

SEQ ID NO: 73905 - protein, 84 aa, Zea mays
  misc_feature: Ceres CLONE 1558255
MATQISKKKKFVSDGVFYAELNEMLTRELAEDGYSGVEVRVTPMRTEIIIRATRTQNVLGEKGRRIRELTSVVQKRFNFPENGV

SEQ ID NO: 73906 - DNA, 958 bp, Zea mays
  misc_feature: Ceres CLONE 1558256
  misc_feature: Encodes the peptide sequence at SEQ ID NO. 73907
ggagctccccgcggtggcggccgctctagaactagtggatcccccgggctgcaggaattcgtctcacccctagaaaaaacagcacatcccattcccctcgtctcatctcaagagcgactagagagaggaagagaacaagcgataagctcatctcgcacgcaagatgcgggctccaaggggcggaggcggctgccgcggcggccaggagcatgtggagctgatccctggcatccccgacgacgtggccgtggactgcctggcgcgcgtcccccacgcctcccaccgcgcgatgcgccgggtctgccgcggctggcggagcgccgccgcggcgccggccttcgcgtcggcgcgcgccgcggcgggcgccaacgaggacctcgtgtacctgatgcagttcgggaacccgtccggcgacgacgggcccaaggacggcgacgacgggcccggcagcaccccggcgtacggcgtggcggtgtacaacgtgacgacgggcgagtggcggcgggagcgcggcgcgccccccgtggtgccggtgttcgcgcagtgcgcggcggtggggacccgcgtggccgtgctgggcggctgggacccgcgcaccttcgagcccgtggcggacgtgcacgtgctggacgccgccacggggcggtggcgccgcgccgcgcccatgcggtcggcgcgctccttcctcgcctggcccgaggccggcggcaagatctacgtggcgggcggccccgacaagcacaagaacgccccctagaccgcctaggggttcaccccgggggcgacgcctgggaacccccgccccaactctctgaggccccccaccagcgcaccgccagggcccccggggcccggataagatctctgtggaaggtagtactcatcagtgccgcagatgggggcccacgccaccccaaaggaggcaactgtgggttatgactgtgctgcgttaaatctt

SEQ ID NO: 73907 - protein, 197 aa, Zea mays
  misc_feature: Ceres CLONE 1558256
  misc_feature (18)..(65): Pfam Name: F-box Pfam Description: F-box domain
MRAPRGGGGCRGGQEHVELIPGIPDDVAVDCLARVPHASHRAMRRVCRGWRSAAAAPAFASARAAAGANEDLVYLMQFGNPSGDDGPKDGDDGPGSTPAYGVAVYNVTTGEWRRERGAPPVVPVFAQCAAVGTRVAVLGGWDPRTFEPVADVHVLDAATGRWRRAAPMRSARSFLAWPEAGGKIYVAGGPDKHKNAP

SEQ ID NO: 73908 - DNA, 947 bp, Zea mays
  misc_feature: Ceres CLONE 1558257
  misc_feature: Encodes the peptide sequence at SEQ ID NO. 73909
ggagctccccgcggtggcggccgctctagaactagtggatcccccgggctgcaggaattcgtctcacccctagaaaaaaagcacatcccattcccctcgtctcatctcaagagcgactagagagaggaagagaacaagcgataagctcatctcgcacgcaagatgcgggctccaaggggcggaggcggctgccgcggcggccaggagcatgtggagctgatccctggcatccccgacgacgtggccgtggactgcctggcgcgcgtcccccacgcctcccaccgcgcgatgcgccgggtctgccgcggctggcggagcgccgccgcggcgccggccttcgcgtcggcgcgcgccgcggcgggcgccaacgaggacctcgtgtacctgatgcagttcgggaacccgtccggcgacgacaggcccaaggacggcgacgacgggcccggcagcaccccggcgtacggcgtggcggtgtacaacgtgacgacaggcgagtggcggacggagcgcggcgcgccccccgaggtgccggtgttcgcgcagtgcgcggcggtggggacccacgtggccgtgctgggcggctgggacccgcgcaccttcaagaccgtggcggacatgctcgtgctggacgcctccacggggcggtggcgccgctccgcgcccatgcggtcggcgcgctccttcttcgcctgcgccaatgccgggcgcaagatctacgtggcgggcggacacgacaagcacaagaacgcgctcaagatctgcgaagcgtacgacgccggggtcgactcctgtgacctgctgccagacatgtctgaagaacgcgactagtgcgacggcatgtgcaccgtggtcggggtacagctgcctggcagtcatcggactacgacggggcccccagggtggatctagcgcaccccgatgggttcgacccgtcttaacgcgcatga

SEQ ID NO: 73909 - protein, 221 aa, Zea mays
  misc_feature: Ceres CLONE 1558257
  misc_feature (171)..(217): Pfam Name: Kelch_1 Pfam Description: Kelch motif
  misc_feature (18)..(65): Pfam Name: F-box Pfam Description: F-box domain
MRAPRGGGGCRGGQEHVELIPGIPDDVAVDCLARVPHASHRAMRRVCRGWRSAAAAPAFASARAAAGANEDLVYLMQFGNPSGDDRPKDGDDGPGSTPAYGVAVYNVTTGEWRTERGAPPEVPVFAQCAAVGTHVAVLGGWDPRTFKTVADMLVLDASTGRWRRSAPMRSARSFFACANAGRKIYVAGGHDKHKNALKICEAYDAGVDSCDLLPDMSEERD

SEQ ID NO: 73910 - DNA, 924 bp, Zea mays
  misc_feature: Ceres CLONE 1558258
  misc_feature: Translation starting site: 165
  misc_feature (760)..(760): n is a, c, t, g, unknown, or other
  misc_feature (800)..(800): n is a, c, t, g, unknown, or other
  misc_feature (803)..(803): n is a, c, t, g, unknown, or other
ctccccgcggtggcggccgctctaaaactagtggatcccccgggctgcaggaattcgtctcacccctagaaaaaattgtgcgcgcattgaacatacgttcacaccgattctgatattcagttccggccacagatccgcagatatcataaacgtcctctggctcaatgctctttgaactcccccgtaccacccctggcctccgcgcagctgcctggtgcgccggcggtggcggctgcgaaaccaaggtgaactacttcgactcctcctgacgccatcccttgcagtactccaagggagaagaggcaggacgactagtggttagggcagacacagccctgtcacctaagtatacgtctcataaaaccattaggagacagagtacttgccaagatcaaaacatctgacgctaagtctgatagaggtattttacttccagtatcaggtcacaccagaccacaaagaggggagattgttgccgctggagaatggagaagttttgcaagtaaccccattgatatcactgttccgattggtgcacaagttgtctactccaaatatgcaggcacataattgaaattcaatgacacctaccatctcattttgaaagaagatgacataattggtattcttgacagtgatgatgtgaaggatatgaaaacactgaatgatcgcattctgattaaggttgctgaacctgaacaacgaacagctggtggtttgctattgacgcagaaactaacgataaacctctgtcggatcntggcagccgttggcccatcgccgttgggcgaagacggcancangcatcccctgtcgatcactcctgaaagcacgtgatgtattccaagtatgcagggagtgagttcacggccaaagaccgatgagtactccttgctcaaggcggcccgacgtgatggatgttct

SEQ ID NO: 73911 - DNA, 930 bp, Zea mays
  misc_feature: Ceres CLONE 1558259
  misc_feature: Encodes the peptide sequence at SEQ ID NO. 73912
  misc_feature (835)..(835): n is a, c, t, g, unknown, or other
aaagctggagctccccgcggtggcggccgctctagaactagtggatcccccgggctgcaggaattcgtctcacccctagaaaaaagcgaagcaagcagcctaaaaaaaccgtatcgtctcgcctgttcagtttccttctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgacaaggaccacgccggcccgctccgccccagcgttgacgccgtcgagtctgccgtgaagggcgtcgttagccccgtctacgaccgcttcagcggcctgcctctcgacgtcctcgccttcgtcgaccgcaaggtggacgacacggtgcactaggtggacaagcacctcccgggcgcgctgaaggcggcgtcggcgcatgtctacgcggtggttcggggcgtgccggatgtggcgcgcgagctggcggccgaggcgcagcggtcgggcgtgaggggcgcatcccgtgcggcgatcgcgatgacggagccggtggcgcgggacgtgtacggccgccctggagcccgtggtcaatgacctctacgtgcggtacgagcccgcggcggagcacctggtcgtctccgcctggcgctcgctgaacggccatgccggtggtccgcacctcccggggagatcgtcgntgcaaaccgacgcggcactgggccgacatgtaacaacagggcggtccgcagccaccgccggagcacggctaccgcgtggggcaaggtacctcccc

SEQ ID NO: 73912 - protein, 104 aa, Zea mays
  misc_feature: Ceres CLONE 1558259
  misc_feature (19)..(105): Pfam Name: REF Pfam Description: Rubber elongation factor protein (REF)
MAEEQSNPQHQQAEEREVMVEQQQPRRAPKLRYLDFVQVAAAQAAVCLAGLYGLDKDHAGPLRPSVDAVESAVKGVVSPVYDRFSGLPLDVLAFVDRKVDDTVH

SEQ ID NO: 73913 - DNA, 881 bp, Zea mays
  misc_feature: Ceres CLONE 1558261
  misc_feature: Encodes the peptide sequence at SEQ ID NO. 73914
tggagctccccgcggtggcggccgctctagaactagtggatcccccgggctgcaggaattcgtctcacccctagaaaaagcacttcaccggcctcctcctccttcccgtccatcgccgtcgccggggcgccctacaacttcaaaatggcggctaccgccaccgccatggctatagcaactatctcccccgccgctccgatcccatccgcgcccttcccatccctccccctcggcctccgcctccgccctcaacccctccttttcgctgcttaccgccgccgcctcctccatgttcccaaagccgcctcctgggacgaatccggccccgaggatggtggagatgcggaggaatccgttgacgctggggacgacgaggacaatgactataagccgctgcccgagccggtgtcctcctcctagttccagttctcggcgccacccgagggctacatcgagcccgcggcgtttgacaagctaccgccagagtccccagaagacgtggcggcggcgtacgaatctctctactggccagccctcagaggcgagacattgctgagaaacaacgtcctccaggtcaaggtgggcgaccccatcgacatggaccgggagcaacgtccgaacgacgatttcacctagcgcgtcgtgcaggtcaaccgcgtcacctacgtcgtgcaaggagggaggcagctctcctaccaagcaatcgtcgtcgctggcgacatgaaggccacgctggatggctgaaacgggaaagacaaggtagtcacggaggccatcaccaatgcctccatgaatcgacagcgcatcatcgtcacagtgccgctgactaatcactacacatttcccgcacattttgatggtaaactcaataccaatttgcc

SEQ ID NO: 73914 - protein, 91 aa, Zea mays
  misc_feature: Ceres CLONE 1558261
MAATATAMAIATISPAAPIPSAPFPSLPLGLRLRPQPLLFAAYRRRLLHVPKAASWDESGPEDGGDAEESVDAGDDEDNDYKPLPEPVSSS

SEQ ID NO: 73915 - DNA, 955 bp, Zea mays
  misc_feature: Ceres CLONE 1558262
  misc_feature: Encodes the peptide sequence at SEQ ID NO. 73916
  misc_feature (817)..(817): n is a, c, t, g, unknown, or other
  misc_feature (901)..(901): n is a, c, t, g, unknown, or other
ctccccgcggtggcggccgctctagaactagtggatcccccgggctgcaggaattcgtctcacccctagaaaaagacgaaacagacagccggactcaagtcgacgcccggcgaattgcccgatactatggagggagacgatcggagggccccgctgctggcggccggcggcggccgtcccccgtctctgcggcgccgtgactcggcgcggtcgctgcgcagcagcttcctgtcgcggctgcccgacaaggtgcgcgccgggctcgacccggagcacctcgccgacgtcgacctctcccgcgccaaaggcatgtcccgaggtgtgagacagtactacgagaagcagctcgcgaccctgaagaccttcgagcaggtggaggcgcgctgcatgcccggcgaattcgattcggatgtcgaggcctccgactcggaggacgcggagcagaagcagagcgagttcgccatgaagatctccaactacgccaatattgtgctgctggtcttcaaggtgtatgcgacgatcaggacggggtccatggcgattgcggcgtccacgctcgactcgttgctggatttcatggccgggggtatcctctggttcacgcacctttccatgaagagggtcaacatctacaagtacccaattgggaagctgcgcgtccagcccgtcgggatcatcgtcttcgccgccatcatggcaactctaggtttccaggtcttggtccaggccgtcgaacagctggtggagaacaacctggcgagagatgaatcggagcagctgatatggtgtactcatcatgctttcgggcaccgcgtgnaactggctctctggctctctgcagagtcagggaacagtattgtcgggctatgccaagaccactactcgatgtgatacaatgtcnttcgtcttggtgctgctgtcctggggacaattctcgtggtgattgccccccggt

SEQ ID NO: 73916 - protein, 254 aa, Zea mays
  misc_feature: Ceres CLONE 1558262
  misc_feature (231)..(231): Xaa is any aa, unknown, or other
MEGDDRRAPLLAAGGGRPPSLRRRDSARSLRSSFLSRLPDKVRAGLDPEHLADVDLSRAKGMSRGVRQYYEKQLATLKTFEQVEARCMPGEFDSDVEASDSEDAEQKQSEFAMKISNYANIVLLVFKVYATIRTGSMAIAASTLDSLLDFMAGGILWFTHLSMKRVNIYKYPIGKLRVQPVGIIVFAAIMATLGFQVLVQAVEQLVENNLARDESEQLIWCTHHAFGHRVXLALWLSAESGNSIVGLCQDHYSM

SEQ ID NO: 73917 - DNA, 947 bp, Zea mays
  misc_feature: Ceres CLONE 1558263
  misc_feature: Encodes the peptide sequence at SEQ ID NO. 73918
  misc_feature (737)..(737): n is a, c, t, g, unknown, or other
  misc_feature (760)..(760): n is a, c, t, g, unknown, or other
ctggagctccccgcggtggcggccgctctagaactagtggatcccccgggctgcaggaattcgtctcacccctagaaaaaacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccggggatcaaggtggacaagggccttgtcccgctcgccggctccaacaacgagtcgtggtgccagggcctggacagcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaacgtgtgggccgaaaccttctacgccatggcggagaataacgtcatgttcgatggcatcctgctgaagccgtccatggtgacgcccggcgcggaggccaaagacaggccacccctgagcatgtggccgcgtacaccctcaagctcctccaccgccggattcccccctccgtgcccgggatcatgttactctccngcgggcagtcggatgtggatgcnacgcagaacatcacgcctgaacttggggcccatcgctgtgcacgtgtccttctgctacgcgcgggaactgcataaccctgcctcatgactgggccggcagccggaccattcagggtggccaggacccctgctgctggcgccaaggcaaatccgtcgccaatctgtattcaccgcccaaagggagcgt

SEQ ID NO: 73918 - protein, 281 aa, Zea mays
  misc_feature: Ceres CLONE 1558263
  misc_feature (18)..(282): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (253)..(253): Xaa is any aa, unknown, or other
GAPRGGGRSRTSGSPGLQEFVSPLEKTEANRQAYRTLLVTAPGLGQYISGAILFEETLYQSAVDGRKIVDILAEQGIVPGIKVDKGLVPLAGSNNESWCQGLDSLASREAAYYQQGARFAKWRTVVSIPNGPSELAVKEAAWGLARYAAISQDNGLVPIVEPEILLDGEHGIERTFEVAQNVWAETFYAMAENNVMFDGILLKPSMVTPGAEAKDRPPLSMWPRTPSSSSTAGFPPPCPGSCYSPAGSRMWMXRRTSRLNLGPIAVHVSFCYARELHNPAS

SEQ ID NO: 73919 - DNA, 921 bp, Zea mays
  misc_feature: Ceres CLONE 1558265
  misc_feature: Encodes the peptide sequence at SEQ ID NO. 73920
agtctgccccctccgtgaaaccaacgcccctccctccccgcgcgaatggaagttgctcctgcggtgaagcaactcctccccatggcgcggggccccaactccccgtcctcctccaccacctcctcctcgccctcgccctcggccgccgcgccgtccccgccgccgcgccagcagcagtcgcaggcgcccgtgccgcgcatcatcgacaccacgcccttccccaccaccttcgtgcaggccgacacggccagcttcaagcaggtcgtccagaggctcaccggctccgacacgccgccgcctgcccagaagcccgcgaagacccacggccaccaccaccaccacggcggcggcgtcgggcccaagaagccggccttcaagctctacgagcgccggatcggcaagaacaacctcaagatgatcgcgccgctggcggggccgtcgccgtcgccgcggaaggcggcgccggaggtgttgtcgcccagcgtgctcgacttcccttccctggcgctcggtagccccgtcacgccgctgctggccgaccccttcaaccggtcggcgtcggcgtccccgggcgagcaggacgaggccgaggccgcggccatcgcgcagaggggcttcttcctgcacccctcgccgaggggcgccgtcgagccgccgcggctgctgccgctgttccccgtcacgtcccccaagatggcgcagtgatcggggcgggaccccgctgccggagaattcctagtactgccgcttgagatactacttgttcaattaactacttggtgcgtcatgtatttttttttgtttttttttgctcatggtattcaactcttgagcgatcgcgaaggaacggaaagaaagatcacactcttgagcttaaaaaaaaaaaaaaaaaaaaaaaaaaaaagaaaaaaaaaaaaaaaa

SEQ ID NO: 73920 - protein, 219 aa, Zea mays
  misc_feature: Ceres CLONE 1558265
  misc_feature (56)..(86): Pfam Name: VQ Pfam Description: VQ motif
MEVAPAVKQLLPMARGPNSPSSSTTSSSPSPSAAAPSPPPRQQQSQAPVPRIIDTTPFPTTFVQADTASFKQVVQRLTGSDTPPPAQKPAKTHGHHHHHGGGVGPKKPAFKLYERRIGKNNLKMIAPLAGPSPSPRKAAPEVLSPSVLDFPSLALGSPVTPLLADPFNRSASASPGEQDEAEAAAIAQRGFFLHPSPRGAVEPPRLLPLFPVTSPKMAQ

SEQ ID NO: 73921 - DNA, 904 bp, Zea mays
  misc_feature: Ceres CLONE 1558266
  misc_feature: Encodes the peptide sequence at SEQ ID NO. 73922
ctccccgcggtggcggccgctctagaactagtggatcccccgggctgcaggaattcgtctcacccctagaaaaagacctctcctctcctctcctctcgacctctcccttctatctagccaccgaagccaagaccaaggaacggcatggctcagctgctgcacctgccggacctcgcggcggcgcggccgccggcgcggaggaggaggggtgtggcggtggcggtggcgggggggcgcgtcaagcagggggaggcggggcgggtgatcagggtcgccgaccccgtgcgggagggccggatgccgcctcctcttcttgccgcgccggccacgccgtcggagtctccgccggtcgcggggaggcgcggggacgaggacgacgaggtgaggcagaggtactacctcaacatggggtacgcgatccggacgctcagggaggagctccccgatgtgctctacaaggagcccagctttgacatctacagagatgacattgtcttcacagaccctttgaatacattcaagggcctggaaaattacaagacgatattctgggcgcttcgttttactggccggatcttcttcaaggcattgtgggttgatatagttagtatatggcagcctgctgagaacattatcatgattcgctggatcgcccactgcattcctcgagtaccttgggatgggcatggccgcttcgatggtgcttctgtgtataaactcgacaaggatggtaagatctacgagcataaggtccacagtgttgctatgatcccacaaccaaagtcaaaggtctaccggccatgagctatccgaacacttggttgccctcttcggcaaaacaactatttttgaacttcatccccattcggggcgctgggccactctattgaaaatagccggaaaa

SEQ ID NO: 73922 - protein, 219 aa, Zea mays
  misc_feature: Ceres CLONE 1558266
MAQLLHLPDLAAARPPARRRRGVAVAVAGGRVKQGEAGRVIRVADPVREGRMPPPLLAAPATPSESPPVAGRRGDEDDEVRQRYYLNMGYAIRTLREELPDVLYKEPSFDIYRDDIVFTDPLNTFKGLENYKTIFWALRFTGRIFFKALWVDIVSIWQPAENIIMIRWIAHCIPRVPWDGHGRFDGASVYKLDKDGKIYEHKVHSVAMIPQPKSKVYRP

SEQ ID NO: 73923 - DNA, 871 bp, Zea mays
  misc_feature: Ceres CLONE 1558267
  misc_feature: Encodes the peptide sequence at SEQ ID NO. 73924
  misc_feature (799)..(799): n is a, c, t, g, unknown, or other
  misc_feature (800)..(800): n is a, c, t, g, unknown, or other
ctggagctccccgcggtggcggccgctctagaactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccaccgtggcgtgcttcctgctccgcttctcgacgggcgggcaggccacgggcaccttcgggctgacgggcgtgtccgtgtgggaagcgctggtgctggagatcgtgatgaccttcgggctggtgtacacggtgtacgccacggcggtggacccgaagtatggcagcctgggcaccatcgtccccattgcatcgggctcatcgtggggccacatcccggggttggggggcgcttcaacgcgcgtcattgacccccgcgggtccttctgccccgccccggtnngtggggatggggctaccagtggtgggcacggggtcggccccctaatcggggggggcctcccggggttattt

SEQ ID NO: 73924 - protein, 231 aa, Zea mays
  misc_feature: Ceres CLONE 1558267
  misc_feature (13)..(231): Pfam Name: MIP Pfam Description: Major intrinsic protein
  misc_feature (208)..(208): Xaa is any aa, unknown, or other
MPINRIALGSHQEVYHPGALKAAFAEFISTLIFVFAGQGSGMAFSKLTGGGPTTPAGLIAAAVAHAFALFVAVSVGANISGGHVNPAVTFGAFVGGNITLFRGLLYWVAQLLGSTVACFLLRFSTGGQATGTFGLTGVSVWEALVLEIVMTFGLVYTVYATAVDPKYGSLGTIVPIASGSSWGHIPGLGGASTRVIDPRGSFCPAPVXGDGATSGGHGVGPLIGGGLPGLF

SEQ ID NO: 73925 - DNA, 910 bp, Zea mays
  misc_feature: Ceres CLONE 1558269
  misc_feature: Translation starting site: 169
ggagctccccgcggtggcggccgctctagaactagtggatcccccgggctgcaggaattcgtctcacccctagaaaaactctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgctgccgctgccaaagcctcttctaaaagaaagaaagtggtaaatcctccgtccctatggatgtaaaacatgggacgatgagactgatatgaagaagctggaggaggctgtccgcagtgtccagatgaagggtctgacttggggagcatcaaagcttgtgccttggtggaacggcatccagaagatgactatcctgttgacatgggccgacgatcttgggtccctccgacactctaattggaaggaccaccttcagccaggagcccatcaatggagtacctcccgaagtttgccaacttggtggcttccacaaaaattcaaaaagttccattttccgaatttggggaaaagggaaggggcccaactcccgccaagtttggggcgggggaaaaccatt

SEQ ID NO: 73926 - DNA, 914 bp, Zea mays
  misc_feature: Ceres CLONE 1558270
  misc_feature: Translation starting site: 149
  misc_feature (702)..(702): n is a, c, t, g, unknown, or other
  misc_feature (756)..(756): n is a, c, t, g, unknown, or other
  misc_feature (759)..(759): n is a, c, t, g, unknown, or other
ctccccgcggtggcggccgctctagaactagtggatcccccgggctgcaggaattcgtctcacccctagaaaaaatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgcccggcggcggcgcgtggctgggcgggcagctgttctcggccatggtggtgcgcaagccggcgcacctgttcctggacgagctgggcgtggcgtacgacgaggccgaagactacgtggtcatcaagcacgccgcgctcttcacgtccacggtcatgagcctgctcctggcgcgcccaacgtncagctgttcaacgccgtggccgtggaagactcatcgtcaggggaaggcgcgtcngcngcgtcgtcacaactgggcgctcgtgtcatgaacacgacacgcagtcctgcatggacccaacgtcattggagccaagttcgtggcagctcctgcggccacgacgggcccttcggcgccacgggcgtcaagagctccaggaaatcggatgatcacgc

SEQ ID NO: 73927 - DNA, 928 bp, Zea mays
  misc_feature: Ceres CLONE 1558271
  misc_feature: Translation starting site: 111
  misc_feature: SWISSPROT Homolog: EC 3.1.2.6 Hydroxyacylglutathione hydrolase
  misc_feature (779)..(779): n is a, c, t, g, unknown, or other
  misc_feature (795)..(795): n is a, c, t, g, unknown, or other
  misc_feature (797)..(797): n is a, c, t, g, unknown, or other
ggagctccccgcggtggcggccgctctagaactagtggatcccccgggctgcaggaattcgtctcacccctagaaaaaaccaactgacctgacccacgagggatccgcagatgaagatcattccggtcccttgcctggatgacaactatgcctacttgtacgaatcagcccgcatcgcttgttttcactactctttcagttgttcgtttcaaatcgttggattcttgattgctatttgtttcttccgttcgaagaatcgtggacgagagcaccaagaaggcagcggccgttgaccctgtggaaccggagaaggttctcaaggcggccggcgaggtcggcgcctacgtcgactgcgttctcaccacccatcaccactgggatcatgctggtggcaatgagaagatgaggctgcaggtgccagggataaaggtatcttggaggatccctggacaatgtgaaaggctgcactgatcaggtggagaatggaatgaagttgtcacttgggaaggacattgagatactatgcctacacacgccttgccacactaaaggtcatatcagctactatgttactagtaaggaagggtgaagatccagcggtcttcaccagagataccttgttcattgctgggctgtgggaaagttttttgagggttctgcagagcatatgtatcagtcccgttattgatacactgggtgcgctgccaaagtcaacccgagtttactggtgggcatgagtacactgcgaagacctaagattcatgctgacactggagccngagatgagagacgaancngaaactggaatgggctggaaagcacgctagcgaatcagccataggtgcctcgacttttggagatgagtttgagaaaaaacttcccaggcgggtgatctacaaaaaaccgggcgaaatccggggtcaatctc

SEQ ID NO: 73928 - DNA, 930 bp, Zea mays
  misc_feature: Ceres CLONE 1558274
  misc_feature: Encodes the peptide sequence at SEQ ID NO. 73929
  misc_feature (881)..(881): n is a, c, t, g, unknown, or other
ctggagctccccgcggtggcggccgctctagaactagtggatcccccgggctgcaggaattcgtctcacccctagaaaaaatccgaactgctaggagaacttgcataaatattatagtctttccctctctctcctcccaccacacccggtcgtcgttgtcgcggcgtgagcgagcgagaggggaaaacccaaaaccctagcacccccgccccgtcgccgacggccgccggagtacagagatggcggtggacgaggtgaactcggtctacgtcggcggccttccctacgaggccaacgaggagatgcttcgcgacgccttcgggtactacggcaccatcggctccgtcaaggtgattaatgatcatgctgtcaaaggcaagtgttatggttttgttactttcactcaccccagagctgctgagcaagcaattgcgggcatggacggcaagaaattaggcaaccgtattgttcgagtaaatgaagtgcgtacaagaggcccccgcgattttggccgagatggtttcagacgagatccaagaaggtatggtagagatccatactgggacagaagggacaggcaacggagctatgatcgtgaaagagatccctaccatgacagggatagtgatagatcccgtgagcatgatagagaaagagatgatgacatggtggatttaatagagaacttgactatcccatggacgggatcgtgaaggagatgagagacgtcctaaagaactgatcgtacagcagaaatggcatatgtgattcggatatgacaaagataggaccttgtttcagaaaaaaggtcagtcccacaaaagtcgggatgcagaatttttcacattccaggggatgccctcaaaatgttgaaaactccnttggaaaaattttcgatggccgagaacctggaatggagtaaacaattag

SEQ ID NO: 73929 - protein, 157 aa, Zea mays
  misc_feature: Ceres CLONE 1558274
  misc_feature (9)..(79): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAVDEVNSVYVGGLPYEANEEMLRDAFGYYGTIGSVKVINDHAVKGKCYGFVTFTHPRAAEQAIAGMDGKKLGNRIVRVNEVRTRGPRDFGRDGFRRDPRRYGRDPYWDRRDRQRSYDRERDPYHDRDSDRSREHDRERDDDMVDLIENLTIPWTGS

SEQ ID NO: 73930 - DNA, 964 bp, Zea mays
  misc_feature: Ceres CLONE 1558275
  misc_feature: Encodes the peptide sequence at SEQ ID NO. 73931
  misc_feature (756)..(756): n is a, c, t, g, unknown, or other
  misc_feature (759)..(759): n is a, c, t, g, unknown, or other
  misc_feature (794)..(794): n is a, c, t, g, unknown, or other
  misc_feature (831)..(831): n is a, c, t, g, unknown, or other
ctggagctccccgcggtggcggccgctctagaactagtggatcccccgggctgcaggaattcgtctcacccctagaaaaaatccgcatccgcataaatcccagtcaaattgaacgagagcgccactcccctctgctaatcccagtcaaatcgaagcaagcatggccatggcggccgtgggcgtgggcggcgcagtggcgttcctcctcccgcagcgccgccagggcgccgtcccctggagcggcgggcggcggcgggcgcccgtggcggtgcgcgcgtcgtacgaggccggggtgggcgtgatggcgaccaaggtggggatgatgacctacttcgatccggagacggggaagccggtgccggtgaccgtggtcgggttccgggagggcggcaacgtggtgacacaggtgaagacggccgccacggacgggtacgacgccgtccaggtcgggtaccacggcgtgcgcaaggacaagctcacccgcccggagctgggccacctgggcaaggccggcgccccgccgctgcgccacctgcaagagttccggctcaccgccgtcgacgccttcgagcccggacagcccctcgacttcgccgacctcttcaaggagggcgaactcatcgaccccccggggggaaattcattgggcaagggggttcccaagctggcatcaagacgcacaacttcaagcgcgggctgatgacgcacggttccaagagccaccggcagctgggttccatcggagcctggacgacnccngggccgcgtgtacaagggtaagagatgccctgggnaggatgagagttctaagaccaagatcaggaagctcangatcgtcaagatcgacaacaacctccgggtgctcatgatcaaagggggccttggcatgaaatcccgggtaacttctccgcataacccccggcaaaatcgtcggcaagaacatcccaagaactagactcttttt

SEQ ID NO: 73931 - protein, 179 aa, Zea mays
  misc_feature: Ceres CLONE 1558275
  misc_feature (51)..(180): Pfam Name: Ribosomal_L3 Pfam Description: Ribosomal protein L3
MAMAAVGVGGAVAFLLPQRRQGAVPWSGGRRRAPVAVRASYEAGVGVMATKVGMMTYFDPETGKPVPVTVVGFREGGNVVTQVKTAATDGYDAVQVGYHGVRKDKLTRPELGHLGKAGAPPLRHLQEFRLTAVDAFEPGQPLDFADLFKEGELIDPPGGNSLGKGVPKLASRRTTSSAG

SEQ ID NO: 73932 - DNA, 928 bp, Zea mays
  misc_feature: Ceres CLONE 1558277
  misc_feature: Encodes the peptide sequence at SEQ ID NO. 73933
  misc_feature (855)..(855): n is a, c, t, g, unknown, or other
  misc_feature (856)..(856): n is a, c, t, g, unknown, or other
  misc_feature (860)..(860): n is a, c, t, g, unknown, or other
  misc_feature (911)..(911): n is a, c, t, g, unknown, or other
ggagctccccgcggtggcggccgctctagaactagtggatcccccgggctgcaggaattcgtctcacccctagaaaaaagagtccaaccgcacacggcacagacccgtttcgcctcttcgaccgcgactccctccgaccgagctgcagtgcgcgtgctgcctgccttccactgttcctgcttccagacatggcggcgaggccggtcgctctggctctgccgctgctggccctcgtctgcgccctggcagcgtcggccgacgcgacgcagttcagggtgggcgggcagagtgggtggagcgtgccgggcgccggctccgagccctacaacacctgggcggggcgactccggttccagatcggcgaccagctgctgttcgtgtaccccaaggagacggactccgtgctcctggtggacgccgccgcctacaacgcctgcaacacctcgtcctacgtctccaggttcgacgacggcagcacggtgttcacgttcgaccgctcgggggccttcttcttcgtcagcggcaacgaggccagctgccgtgccaacgagaagctcatcgtcgtcgtcctcgccgaccgctccggcagccgcaccccgacgccatcatccgcgccgctgccgagcccgccctcgcctcctgctgctgcccccgcacctgcgacgagcccatcctcgtcgccaccctcgtccgctgctcccgcagccacccccacctcgccgacgtccccagctttagctccggcgcctgcccccacgacaacccctagctcgccaccggcgcccgttcccacgacaactcctagctcgccaccggcgccgactcccgacacaccagcaggaggaagctccccanncgcntacgcttcccgcagcgcgcccggccgctgaaggcggcagctccacacgccngcacagctttcacggct

SEQ ID NO: 73933 - protein, 233 aa, Zea mays
  misc_feature: Ceres CLONE 1558277
  misc_feature (36)..(121): Pfam Name: Cu_bind_like Pfam Description: Plastocyanin-like domain
  misc_feature (223)..(223): Xaa is any aa, unknown, or other
MAARPVALALPLLALVCALAASADATQFRVGGQSGWSVPGAGSEPYNTWAGRLRFQIGDQLLFVYPKETDSVLLVDAAAYNACNTSSYVSRFDDGSTVFTFDRSGAFFFVSGNEASCRANEKLIVVVLADRSGSRTPTPSSAPLPSPPSPPAAAPAPATSPSSSPPSSAAPAATPTSPTSPALAPAPAPTTTPSSPPAPVPTTTPSSPPAPTPDTPAGGSSPXAYASRSAPGR

SEQ ID NO: 73934 - DNA, 939 bp, Zea mays
  misc_feature: Ceres CLONE 1558279
  misc_feature: Encodes the peptide sequence at SEQ ID NO. 73935
  misc_feature (863)..(863): n is a, c, t, g, unknown, or other
  misc_feature (884)..(884): n is a, c, t, g, unknown, or other
  misc_feature (921)..(921): n is a, c, t, g, unknown, or other
  misc_feature (922)..(922): n is a, c, t, g, unknown, or other
ctccccgcggtggcggccgctctagaactagtggatcccccgggctgcaggaattcgtctcacccctagaaaaaacagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggcctgccaggtcgtgctcatgggcgccatcgagtggtaccgcgtcgccggcggcccgctcggagaggtcgtcgacccgctctaccccggcggcagcttcgacccgctcggcctcgtcgacgaaccctgaggcctcgcggagctcaaggtgaggagctcaagaaggccgcccctcgcatgtctccattgtcgggttcttcgtccaaggcatcgtcaacgggcagggcccgctcgagaactcgncgacaacctcgccgacccgtnatcacaacgcatggcctatgcaacacttgtgcggcannaaagggagggggggagt

SEQ ID NO: 73935 - protein, 203 aa, Zea mays
  misc_feature: Ceres CLONE 1558279
  misc_feature (64)..(202): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAIEWYRVAGGPLGEVVDPLYPGGSFDPLGLVDEP

SEQ ID NO: 73936 - DNA, 899 bp, Zea mays
  misc_feature: Ceres CLONE 1558281
  misc_feature: Encodes the peptide sequence at SEQ ID NO. 73937
aaagaaaggaaagcggtgcgagcggaggaggcgaccgaagcgccacttgcttgagtagcgaagcgcgagagcaatggcgtcgctgtcgtgcgcctccacgctgccctggacccccgcctcctacccgcggccctcggcggggcgctgcctcacggcctctcgccgggctccgtcgctggtcatcgtcgcccaggggaaggtcaagaagtaccgccaggtcatattgacagacgacatagaagaggtggggaagaaaggggatacactgaaggtgcgagctggattctaccgcaacttcctccttcccaagggcaaggctacacttctgaccccagaagtcctcaaggaaatgcagctggagcaggagagaatagaagctgaaaagaagcgggtaaaagaagacgcgcaacaacttgctcgagtttttgaaaccattggcgctttcaaactccctcgcaaaggtggaaaaggaaaacagatctttgggagggatgtcgacaagaagctggtgacggttccagaaatccgtgaaatcggagagtatgttgcagagatcaagcttcacccagacgtgacagcgcgagtaaggctgaatgtctatgcgaaatgagctcagcagttacagaacctcgagtaatggactttggcgaagcctgatgtttgccagagattttgctgaaagtgccaggtgctgcggtagacatgaggcctggtctggccgtgacttgcctggttttgatacacaattcactggctcactgcgcatcctattccctatcatgtgaagtcaagttttcaacaattatatctgttgattttgaggtggaaaatataaattgttgtaaagcacaatttgtttgaactgtagagcactacttcgtcaaaaaaaaaaaaaaaaa

SEQ ID NO: 73937 - protein, 178 aa, Zea mays
  misc_feature: Ceres CLONE 1558281
  misc_feature (47)..(94): Pfam Name: Ribosomal_L9_N Pfam Description: Ribosomal protein L9, N-terminal domain
  misc_feature (108)..(178): Pfam Name: Ribosomal_L9_C Pfam Description: Ribosomal protein L9, C-terminal domain
MASLSCASTLPWTPASYPRPSAGRCLTASRRAPSLVIVAQGKVKKYRQVILTDDIEEVGKKGDTLKVRAGFYRNFLLPKGKATLLTPEVLKEMQLEQERIEAEKKRVKEDAQQLARVFETIGAFKLPRKGGKGKQIFGRDVDKKLVTVPEIREIGEYVAEIKLHPDVTARVRLNVYAK

SEQ ID NO: 73938 - DNA, 958 bp, Zea mays
  misc_feature: Ceres CLONE 1558283
  misc_feature: Encodes the peptide sequence at SEQ ID NO. 73939
  misc_feature (900)..(900): n is a, c, t, g, unknown, or other
  misc_feature (932)..(932): n is a, c, t, g, unknown, or other
aaagctggagctcaccgcggtggcggccgctctagaactagtggatcccccgggctgcaggaattcgtctcacccctagaaaaaagccacggatcgagacgtcccaatcgagctaatctcacaccgccagtgccagtgccagcggcagctgctaatccgtgccgtgttccagcagcgatgggagtggagtcggagtgcgacaggataaagggcccctggagccccgaggaggacgaggcgctgcggcgtctcgtggagcgccacggcgcgcggaactggacggcgatcgggcgcggcatcccggggcggtcggggaagtcgtgccggctgcggtggtgcaaccagctgtcgccgcaagtggagcgccgccccttcacgcccgaagaggacgccgcgatcctggccgcgcacgcccggctgggcaaccggtgggccgccatcgcgcgccttctcccggggcgcaccgacaacgccgttaagaaccactggaactcgtcgctcaagcggaagctcgccaccgccacggcgacctccagcggcagcgatgctagagcgggcgtgcaagcgcgcaagccctcggcccggggagccccgacggcgtcggaccgcagcgacctcagccacagctgcggcgccgcgacaagtgttccgtcccgtcacgcgcgccggaggcttcgacgccatcagagtccgcatacgtgctgccctcgcccccgccagcagtcgcagacgaagacccgctcacctcgctctccctctcggtgccggggctgaaccagtccccctcgagcttccaccacgacaagcgcccggagccacttcaggagatctcccacctcgtggtcccccgtcgccgcatctactccacccgcctcccgtccccaggggctccctttcaanccgcccaggccttcaacggccacctggtgcgnccttgcaggaataaaccccggagggc

SEQ ID NO: 73939 - protein, 198 aa, Zea mays
  misc_feature: Ceres CLONE 1558283
  misc_feature (11)..(57): Pfam Name: Myb_DNA-binding Pfam Description: Myb-like DNA-binding domain
  misc_feature (63)..(108): Pfam Name: Myb_DNA-binding Pfam Description: Myb-like DNA-binding domain
MGVESECDRIKGPWSPEEDEALRRLVERHGARNWTAIGRGIPGRSGKSCRLRWCNQLSPQVERRPFTPEEDAAILAAHARLGNRWAAIARLLPGRTDNAVKNHWNSSLKRKLATATATSSGSDARAGVQARKPSARGAPTASDRSDLSHSCGAATSVPSRHARRRLRRHQSPHTCCPRPRQQSQTKTRSPRSPSRCRG

SEQ ID NO: 73940 - DNA, 919 bp, Zea mays
  misc_feature: Ceres CLONE 1558284
  misc_feature: Encodes the peptide sequence at SEQ ID NO. 73941
  misc_feature (793)..(793): n is a, c, t, g, unknown, or other
  misc_feature (807)..(807): n is a, c, t, g, unknown, or other
ctggagctccccgcggtggcggccgctctagaactagtggatcccccgggctgcaggaattcgtctcacccctagaaaaataactggaaaacctcttttcccggggaaaaatgtggtacatcaacttgatataattacagatctccttggaacaccttctcccgaagcaatatcaaggattcgtaatgaaaaggccaggcgctacttgagcagtatgaggcgaaaaaagcctataccgtttacgcaaaagttcccaaatgcagatccacttgcactatgtttgttagagcgaatgctcgcttttgagccaaaagacaggccaagtgctgaagaggctcttgctgatccttattttaagaatatagccagtgtggatagagagccttctgcacaggctgtcacaaagcttgaatttgaattcgagaggcggagagttacaaaggaagacataagggagcttatatatagggaaattcttgagtatcatccaaagatgctgagggagtttcttgagggaactgagtcaagtggtttcatgtacccaagtgcagtagatcattttaaaaagcagtttgcataccttgaagaacattatgccaagggatctacaggaactccacctgagaggcaacataattcattgccgcggccgtctgttgtctattccgacaaccgatcacaaaccacagccaacatcaccgaagatcttttccaagtgtatgctcagatgaaatacacagaagacacatccatattctgcttctagtgcaagtaaatttccacacatgttccntcaggtgatgttgncaggcctgttaaagcattggttcagtgatgcagtacagccatgtccagcgcctgctgccgacgatatgacaacgatgatcgcttgggcaccagcagtgccccatacatatcc

SEQ ID NO: 73941 - protein, 183 aa, Zea mays
  misc_feature: Ceres CLONE 1558284
  misc_feature: SWISSPROT Homolog: EC 2.7.11.24 Mitogen-activated protein kinase
MRRKKPIPFTQKFPNADPLALCLLERMLAFEPKDRPSAEEALADPYFKNIASVDREPSAQAVTKLEFEFERRRVTKEDIRELIYREILEYHPKMLREFLEGTESSGFMYPSAVDHFKKQFAYLEEHYAKGSTGTPPERQHNSLPRPSVVYSDNRSQTTANITEDLFQVYAQMKYTEDTSIFCF

SEQ ID NO: 73942 - DNA, 944 bp, Zea mays
  misc_feature: Ceres CLONE 1558285
  misc_feature: Translation starting site: 736
  misc_feature: SWISSPROT Homolog: EC 2.5.1.18 Glutathione transferase
  misc_feature (752)..(752): n is a, c, t, g, unknown, or other
  misc_feature (779)..(779): n is a, c, t, g, unknown, or other
  misc_feature (780)..(780): n is a, c, t, g, unknown, or other
  misc_feature (823)..(823): n is a, c, t, g, unknown, or other
ctggagctccccgcggtggcggccgctctagaactagtggatcccccgggctgcaggaattcgtctcacccctagaaaaaaaactcgctctcactttactcctatccactgcggcctggacgcgtgcgagagacttgacaaagcagcagcagggatggcgcctctgaagctgtacgggatgccgctgtcccccaacgtggtgcgcgtggccaccgtgctcaacgagaagggcctcgacttcgagatcgtccccgtcgacctcaccaccggcgcccacaagcagcccgacttcctcaccctcaaccctttcggccagatcccggctctcgtcgacggagacgaagtcctcttcgagtcccgcgcgatcaaccggtacatcgccagcaagtacgcgtcggagggcacggacctgctccccgcgacggcgtcggcggcgaagctggaggtgtggctaggaggtggagtcgcaccacttccacccgaacgcgtcgccgctggtgttccagctgctcgtgaggccgctcctgggcggcgcccccgacgcggcggtggtggagaagcacgcggagcagctcgccaaggtgctcgacgtgtacgaggcgcacctggcccgcaacaagtacctcgccggggacgagttcacgctcgccgacgccaaccacgcgtcctacctgctctacctcagcaagaccccataggcgggccgtcgccgcccgcccccacgtcaaggcctggatgggagccatctgcgncccgccccgcgttcatgagtacgtcgnncgcatcccctttgcccctgcgccctcctctcgagatgacctcncctgcgctgcatgggtcgcgatgcttcggagcccgagtcgaataaagaggccgcatctggcttgcattgctgctgcgcatgtgcttaacgccgtggataacccggttgcttcggtgggtct

SEQ ID NO: 73943 - DNA, 1001 bp, Zea mays
  misc_feature: Ceres CLONE 1558286
  misc_feature: Encodes the peptide sequence at SEQ ID NO. 73944
  misc_feature (415)..(415): n is a, c, t, g, unknown, or other
  misc_feature (416)..(416): n is a, c, t, g, unknown, or other
  misc_feature (465)..(465): n is a, c, t, g, unknown, or other
  misc_feature (481)..(481): n is a, c, t, g, unknown, or other
  misc_feature (495)..(495): n is a, c, t, g, unknown, or other
ctccccgcggtggcggccgctctagaactagtggatcccccgggctgcaggaattcgtctcacccctagaaaaagcctgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaagagaaccgccgtgccctccgtgagctcctattctgttgccctggtgctctccagtacatcagcggtgtgatcctcttcgaggagaccctgtaccagaagaccaaggatggggcagccttnntgtgatgtcctcaaggagggagggcgtcctcctggcatcaaggttgacnagggtacaattgaggntcgtgggcactgantagggagacaccacccaaggccatgacgaccttggccagccctgcgcccatgactacgaggcaggggcccgctttgcaaagtggcgccctgtttccaaaaatgggccctatgagcaatcaaggttgccttcaaccttaacccccaggggtggggtcccttaccctttttttggcaagaaaaagggttggggccccatttgtgagcccaaaaccctttgtaggggccccaaaaatttaacgcgggcctttaaaaaaaaaaaaccccttttttgccgttttaagggtcaaaaaaaaaacctttcctccggggggggccccccccaacaccacaatggggcgccccccccccccccaaaaaggaccccccggtgtggttgtttaaaccccccccctccccaaaaaaacacccgcgcgggggggggggtgtttttcttccggggggggagaggaggaaggagcccccccccccttctttaaatatacaaacaaagagagggggggttttt

SEQ ID NO: 73944 - protein, 88 aa, Zea mays
  misc_feature: Ceres CLONE 1558286
  misc_feature: SWISSPROT Homolog: EC 4.1.2.13 Fructose-bisphosphate aldolase
MSAYCGKYKDELIKNAAYIGTPGKGILAADESTGTIGKRLSSINVENVEENRRALRELLFCCPGALQYISGVILFEETLYQKTKDGAA

SEQ ID NO: 73945 - DNA, 1760 bp, Zea mays
  misc_feature: Ceres CLONE 1558290
  misc_feature: Encodes the peptide sequence at SEQ ID NO. 73946
attgcatcctcctccacttcctgcctgcctgcctgcgtagctcgcacaccacaaccgccgcgttcttcttctctcgtccctaagcaagcgccgctgctcctcggttctttcgctcgatcccgcaaggcccgtccttccatggccatcgcctcccgtgccacgaagcgcgcgctgtccaccttcgccgcggccaagctcccggaggaggcgatcgccgccaccgccgcggtgccggtgccgctggcgcccgcgcccgcgtcgtccgagagggcgctgctgcagttcgaggacacggggcggctgttcgcgggggagccgacgccggcgctgctgcgcacgctcgccgcgctgcaggcgctgtccgtgggcccgctggtggacgcggccactgcggcgctgcggtcgccggcggtggccggcagcgcgctgggccgggccgccgccagggccacggcgtaccggcacttctgcgcgggcgagaccgccggcgaggccgcggcggccgtgcgccggctgtggcgcggcggcatgggcgggatcctcgactacgggatcgaggacgccgaggacggcggcgcgtgcgaccgtaacgccgccgggttcgcctccgccgtcgacgtcgccgccaagctgcctccgggctcggcgagcgtgtgcatcaagatcacggcgctgtgcccgatcgcgctgctggagaaggcgagcgacctgctgcggtggcagaagaggcacccgtcgctgaacctgccgtggaagacgcacgacttcccgatcctgtcggactcgagcccgctgcacctcacggcgtcggagccgccggcgctgtcggcggaggaggagagggagctggagctggcgcacgagcgggtgctggcggtgtgcgcgcggtgcgcggagcgcggcgtgccgctgctggtggacgcggagtacgcggcggtgcagccggcgatcgactacctcacgctcgccggcgcgctggcgtgcaacgccgagcgctccatcgtgcacggcacggtccaggcgtacctacgcgacgcgcgggagcggctggagaccatggcgcgcggcgtggagcgcgcgcgcgtgcgcctgggggtcaagctggtgcgcggcgcgtacctggcccgcgaggcccgggtcgcggccgccctcggcgtgccgtcgcccgtccacggcagcatccgggagacccacgactgctacaacggatgcgccgccttcctcctcgaccgcgtccgccgcgggtccgcctccgtcgtgctcgccacccacaatgtggagtcaggccaactcgcggcggcgcgtgctgaggagctggggatccccaggggagaccgcaacctgcagttcgcgcagctgatgggcatggcggacgggctgtcgctgggcctccgcaacgccgggttccaggtcagcaagtacctgccgtacgggccggtggagcagatcgtcccctacctcatcaggcgcgccgaggagaacaggggcctcctctccgcctcctccttcgacaggcagctgctccgggaggagttggtgaggaggttcaaggctgcggtgctgggacgtgagtgaagtgaacctgctgaggctactctgctgtgaagctgggacaagggccagttgaaggctagaagctgtaaatacacccttcaacagtcttcagacattgatgtatccggggctttcttgaataaatcgattgaatggaataatgaggcttatcgagtttaaaaaaaaaataaaaaaaaaaaaaaaaa

SEQ ID NO: 73946 - protein, 478 aa, Zea mays
  misc_feature: Ceres CLONE 1558290
  misc_feature (115)..(462): Pfam Name: Pro_dh Pfam Description: Proline dehydrogenase
  misc_feature: SWISSPROT Homolog: EC 1.5.99.8 Proline dehydrogenase
MAIASRATKRALSTFAAAKLPEEAIAATAAVPVPLAPAPASSERALLQFEDTGRLFAGEPTPALLRTLAALQALSVGPLVDAATAALRSPAVAGSALGRAAARATAYRHFCAGETAGEAAAAVRRLWRGGMGGILDYGIEDAEDGGACDRNAAGFASAVDVAAKLPPGSASVCIKITALCPIALLEKASDLLRWQKRHPSLNLPWKTHDFPILSDSSPLHLTASEPPALSAEEERELELAHERVLAVCARCAERGVPLLVDAEYAAVQPAIDYLTLAGALACNAERSIVHGTVQAYLRDARERLETMARGVERARVRLGVKLVRGAYLAREARVAAALGVPSPVHGSIRETHDCYNGCAAFLLDRVRRGSASVVLATHNVESGQLAAARAEELGIPRGDRNLQFAQLMGMADGLSLGLRNAGFQVSKYLPYGPVEQIVPYLIRRAEENRGLLSASSFDRQLLREELVRRFKAAVLGRE

SEQ ID NO: 73947 - DNA, 954 bp, Zea mays
  misc_feature: Ceres CLONE 1558291
  misc_feature: Encodes the peptide sequence at SEQ ID NO. 73948
  misc_feature (835)..(835): n is a, c, t, g, unknown, or other
  misc_feature (836)..(836): n is a, c, t, g, unknown, or other
ggagctccccgcggtggcggccgctctagaactagtggatcccccgggctgcaggaattcgtctcacccctagaaaaaatacggaaagagggatcccaatgatgtcttggatgacgaaaatgtcgcgtcctcattccaattgatgtccaagacagttgaaggttttgctgatgagaagtatcctgcttacaaagataggcacaaacttgcaactgaacgggagaaggctataaaagagaaggctgggcaagcaagagcacaaaggtttggtggtggccacagttcagctctaatttcctctccaaaaggtgcactccctccaaaacttgctcaaattaaggagagatcccctgcagctaatgctgaatccagtgagcaatccagtgacaaccaaaacaacaccctggtggtgagccagatgaagcttgccaacgttgagaagagagcaacaagagttcccagaccacctccccctcgatcaaccactgcttcaggggctaccagtattgcaagtggagtataaacgccacgagcaccaggtgcaccacctcctccaccaccacctccagggaaagttggtggcccaccgccaccaccgccacctccaggtgctctaccaaggaaccttggtgggggtgacaaggtacaccgtgcgccggagattgtagagttctatcaaagtctcatgaagcgtgaagcaaaaagggagacatctttagggtcaatatcatccaatgtttctgatgccagaagtaatatgatttggagagattgagaacagatcaacattccctcttagctgtaaaagctgatgtggagacacaaaggagatttnngtgatctctagcaaatgaggtccgagcagcaagctcataaattatgacgacgttgctgcatttgttaatggggttgggatgaggagttgtcccttcttggttggatgaaagaacatgc

SEQ ID NO: 73948 - protein, 126 aa, Zea mays
  misc_feature: Ceres CLONE 1558291
MSKTVEGFADEKYPAYKDRHKLATEREKAIKEKAGQARAQRFGGGHSSALISSPKGALPPKLAQIKERSPAANAESSEQSSDNQNNTLVVSQMKLANVEKRATRVPRPPPPRSTTASGATSIASGV

SEQ ID NO: 73949 - DNA, 943 bp, Zea mays
  misc_feature: Ceres CLONE 1558292
  misc_feature: Encodes the peptide sequence at SEQ ID NO. 73950
  misc_feature (512)..(512): n is a, c, t, g, unknown, or other
  misc_feature (579)..(579): n is a, c, t, g, unknown, or other
ggagctccccgcggtggcggccgctctagaactagtggatcccccgggctgcaggaattcgtctcaccccctaaaaaaaaccactgatcaagcactgcgtcgatcgagcatataagcacggagctgttactagaaaccatgttcgatccgtgtatccaccaatggcggcgctctgaggaccgccgaggagggcgtcctcagcggccctgctgctagccttgtttgctgtggccctgggctcccatggccggaccaacctcggccgactgggaacaagaccgaggaggtgaccgagttctggtgcctgaacaacgtcgagggcaagctgctcgaggcctgcgactcgggcctctacaccatggtgatcatgtccttcctcgaatcctacgggccagcacgcgacgctaccagtacgacatgcacctgtgcggccactactacgcacgcatcggggacgacatcatgactgccagctcgttgcgcgtgcccgtgacgctctccgatcgcggttngagctcgggctactatgtccgtggaccatgacgagctggagctgtcgagtacctctggacccccttnctggctgtcaacccgggcgtcccccccccttcgtcaacgctgttggaaacccttgaactgtcccgggagggggttccccccaaacgggacaaggtttggagttaaacctcccaacccaattcctgggaggcccgataaccctgaccctaaaggcagcccccctggggtccccccccggatatcttgccgggccaaaaagggattttggattttcccggggggtttaaaaaaaccccatcttgggcgggggccccccggggaaggagaaaaggggttccccgcaccctttttttggcccccgggagaataaaaaaagggtggctcacaaaaaaaataacaaaccccccccccgaaaagaaaaaac

SEQ ID NO: 73950 - protein, 35 aa, Zea mays
  misc_feature: Ceres CLONE 1558292
MVIMSFLESYGPARDATSTTCTCAATTTHASGTTS

SEQ ID NO: 73951 - DNA, 890 bp, Zea mays
  misc_feature: Ceres CLONE 1558294
  misc_feature: Encodes the peptide sequence at SEQ ID NO. 73952
  misc_feature (283)..(283): n is a, c, t, g, unknown, or other
  misc_feature (305)..(305): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
ctccccgcggtggcggccgctctagaactagtggatcccccgggctgcaggaattcgtctcacccctagaaaaaacacggcttttggcagctacaaaccacccaaaagccacccccagaaaccggcggtccttgggtgttccggatctgagccagcagctgagaagaggatgagcgccgtggccgccatggcgacgtcgtcgctgaaccccaacgcgccgctcttcatcccggcggcgtaccggcaggtggaggtatttctcgcagagtggtacgagctcgtncacacaccgcctggtccgggancactgggtcnnngcagcacagcaccacgaggccgcctttcgccgcgccgacgccgagctcgacgtcgccgcgcttctccccgaagactccgtcaacctcctcgaacccgacgcctctttttatgggcctgaagtccaccaacccccaaaaccccaagcgggggcttgttcccccgggttcaaacctcaaaatggccagggggcttaaacctatattccccccgggggcccccccccggcccttccctttttcctttttgttggcccccccaaaaaaaagggcccggaaaggggcgggcccccccccccgggggggcccccgccccgggtttataaccacaccctctttaaaaaaccccctattttggggggggcccccccgggggttttgcgccccaagcaccccccaaaaaaatttttaggtgtttttggggtgggaaaaaaaaaaaaaaaaaacaaaggggggtgtttttaaaggaggggggttttggttcccccctaaaaaaaacttctcttcttataaaaaaaattttttttttttcttccccccgggaaaaaaaaaaaaaaaagggggggggggggggtt

SEQ ID NO: 73952 - protein, 88 aa, Zea mays
  misc_feature: Ceres CLONE 1558294
  misc_feature (46)..(46): Xaa is any aa, unknown, or other
  misc_feature (49)..(49): Xaa is any aa, unknown, or other
  misc_feature (50)..(50): Xaa is any aa, unknown, or other
MSAVAAMATSSLNPNAPLFIPAAYRQVEVFLAEWYELVHTPPGPGXLGXXSTAPRGRLSPRRRRARRRRASPRRLRQPPRTRRLFLWA

SEQ ID NO: 73953 - DNA, 966 bp, Zea mays
  misc_feature: Ceres CLONE 1558296
  misc_feature: Encodes the peptide sequence at SEQ ID NO. 73954
ctggagctcaccgcggtggcggccgctctagaactagtggatcccccgggctgcaggaattcgtctcacccctagaaaaaagatcagatcgatcagaccagaaagtttgcgctcgtctgcttggtaaaggaaaggagaagtttccgaaataggggcggcgcgccgggcgcattttggttgctggattggaaccgagcgaacgcgccggagtccggatgggctcctcgtccgctccggcggccgcagccgcggccgcgccgagccggcgcaaggtggcgctctacctggccctcctcaccctgcagtacggcgcccagcccctcatctccaagcgctttgtccgcgaagatactatagtgacctcactagttcttgcaacggaagcagcaaaggttatttgcgcaatcattttattgattgcagagggtagtctgaaaaaacagttcagtaactggactctcactggatcactgactgcgtctggactgcctgctgccatttatgccctccagaatagtctgctgcaagtatcatacaagcatctggattccttgaccttttcaatccttaaccagactaagcttttgtggacagcgtttttcacatttcttattttggggcaaaagcaatcttccaggcaaattctagcattggccctcttaattggtgctgccgttcttttaagtggttggggagagcagtagcaaaggttccaagggtggtggctctgactatatctgtgctatatgggatcattccagttacagtcgctttctgtgctgtctgggctggcctctttcattgtgtcagtgggcatctcaggttaaaaacataccctcttattgatgaccatagagatgcctttttattggaaatatgtgcctgggtagcaagtacctatcgctccccagatggagagccatcccggaaatatgaatttttccatgaatggactttcctggactg

SEQ ID NO: 73954 - protein, 162 aa, Zea mays
  misc_feature: Ceres CLONE 1558296
MGSSSAPAAAAAAAPSRRKVALYLALLTLQYGAQPLISKRFVREDTIVTSLVLATEAAKVICAIILLIAEGSLKKQFSNWTLTGSLTASGLPAAIYALQNSLLQVSYKHLDSLTFSILNQTKLLWTAFFTFLILGQKQSSRQILALALLIGAAVLLSGWGEQ

SEQ ID NO: 73955 - DNA, 961 bp, Zea mays
  misc_feature: Ceres CLONE 1558298
ctccccgcggtggcggccgctctagaactagtggatcccccgggctgcaggaattcgtctcacccctagaaaaataaccatatcgatcgcaccagaaagtttgggatcgtctgcttgtgaatcgacaccagatccttctcaactacgaccactacgacgagcgcatttgccttcctagattggaacacagcgaatacggcggaataccgatagacgcctcgtacggtctggcggccgtagacgccgacgtcgcacaggcggctcaaggcggagctcatcctgggcatgctcagcctacacaacggtcccagccgctcatgtctctatactttgtccgcctagatactatagtgacctcactagttcttggtccagatccagcaaaaggtctttgaccatacgctttattgcttgcggaggggagcctgacattacaggtcactaactagactgttcgctgcgacactgacagcatgtggaatgcctgctatcatttgtgcgatcccaaatcggccactatacgtctcatacaaacagctggattcgttgagcctttcaattcttgtacacaacatgctggatctgatacgcgccttgcatgtactgtactggagctgaagcaatcattgcaagaaattcatacgtgtgagcctcatgagtggagcattcgcatctctgtatcgttgacgtagagcatcagcaaatgctttcaaggatggtggatgctactatgtcttgccttgtggggatcattgccactgcagacgcttccgtgctgtcctcggcgcgtccccgtcagtgtgcttatgggctgctcaaagtcaaacacattcctcttagttcgtccacaataattagacattggatgccaggtgagtgcgtcttccgcattaccgatggtctacccacattgaccaggccgtccgggtatttttgatttttacaagaacttggcctggtg

SEQ ID NO: 73956 - DNA, 968 bp, Zea mays
  misc_feature: Ceres CLONE 1558300
  misc_feature: Translation starting site: 131
ctggagctcaccgcggtggcggccgctctagaactagtggatcccccgggctgcaggaattcgtctcacccctagaaaaagccaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggtatcttcatcccggagttcctgaccaagatcggcgtcctcaacacgcccttctggtacaccgccggcgagcagcagtacttcaccgacaccaccaccctcttcatcatcgagctcatcctcatcggctgggccgagggccgccgttgggctgacatcatcaagcccggaagcgtcaacaccgatcccatcttccccagcaacaagctcaccggcaccgacgtcggggtaccctggtggcctgtggtttgacccgctcggctggggctccggctcgccggagaagaatcaggagctgcgcaccaaggagatcaagaacggacgcctcgccatgctcgccgtcaatgggcgcttggtttcaaggcgaagtacacggcaccggccccatcgacaacctcttcgccccactcggcgaaccctgggcacgccaccatctttccaggccttcacccccaaatgagaagctctgaatgaactgggt

SEQ ID NO: 73957 - DNA, 951 bp, Zea mays
  misc_feature: Ceres CLONE 1558301
  misc_feature: Encodes the peptide sequence at SEQ ID NO. 73958
  misc_feature (416)..(416): n is a, c, t, g, unknown, or other
  misc_feature (805)..(805): n is a, c, t, g, unknown, or other
  misc_feature (807)..(807): n is a, c, t, g, unknown, or other
  misc_feature (935)..(935): n is a, c, t, g, unknown, or other
ctggagctcaccgcggtggcggccgctcctagaactagtggatcccccgggctgcaggaattcgtctcacccctagaaaaattcactttccaagttgtccgaaaagaccagactaccctgttcccccgaagtcagagggggagaggaggctagggatagagcagcgtcatcgcaccgctcgccggcgagccagatcatcagtgaggaaggcagcgatggcggtggtggagctgtgggagacgctgaagcaggcgatcgttgcgtacacgggcctgtctccggcggccttcttcacggctggtggcggtggcggccgctctgtaccacgttgtgtcggggctcttcgcggccccgcccccgccgccgccgcgcccacgggaggagcccgagacagagccgctccctcctcccgtgcngattggggggaggtctccgaggaggacctccgccagtacgacggctccgaccctaagaagccgctcctcatggccatcaagggccagatctacgacgtcacccagagcagaatgttctatggacctggcggaccttacgccctgttcgccggcaaagatgccagcagagctctagcgaagatgtcgtttgagccacaggacctcaccggcgacgtctcgggcctaggcccgtttgagctcgacgccctgcaggactgggagtacaagttcatgagcaagtacgtgaaggtcggcacggtcaagaagcacgtcccctgtggaaggcggcagcaccgcgagcaccactgaggctgaagaggcgccgacaaccgaagagaaccaagccgggncnggtgtttgaaaaaggaagcgtgggctaatgaaggggcccaggataactagagcttttctgtgcatgcggcaataattcgacatgggtcccaattttggttcctgtcagggccctggctatccccctcnggggctcgtgtctaat

SEQ ID NO: 73958 - protein, 182 aa, Zea mays
  misc_feature: Ceres CLONE 1558301
  misc_feature (71)..(168): Pfam Name: Cyt-b5 Pfam Description: Cytochrome b5-like Heme/Steroid binding domain
MAVVELWETLKQAIVAYTGLSPAAFFTAGGGGGRSVPRCVGALRGPAPAAAAPTGGARDRAAPSSRADWGEVSEEDLRQYDGSDPKKPLLMAIKGQIYDVTQSRMFYGPGGPYALFAGKDASRALAKMSFEPQDLTGDVSGLGPFELDALQDWEYKFMSKYVKVGTVKKHVPCGRRQHREHH

SEQ ID NO: 73959 - DNA, 969 bp, Zea mays
  misc_feature: Ceres CLONE 1558302
  misc_feature: Encodes the peptide sequence at SEQ ID NO. 73960
  misc_feature (775)..(775): n is a, c, t, g, unknown, or other
  misc_feature (832)..(832): n is a, c, t, g, unknown, or other
  misc_feature (834)..(834): n is a, c, t, g, unknown, or other
  misc_feature (887)..(887): n is a, c, t, g, unknown, or other
  misc_feature (929)..(929): n is a, c, t, g, unknown, or other
ctggagctcaccgcggtggcggccgctctagaactagtggatcccccgggctgcaggaattcgtctcacccctagaaaaaaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctggctcaatgagatcctcttccaccccnttcagaagtggatgctcaagcagcagctcaaccaggacgacgaccctttcatgctgncntgcgtccgcatggacaactgatacaccgtaccgtcgtctctgttgccgttccngtcagtgtgcatggaataaaacggtaactgtgttccctgccnggcaatgcacctgtgattgatgcccaaccaataatggtcc

SEQ ID NO: 73960 - protein, 252 aa, Zea mays
  misc_feature: Ceres CLONE 1558302
  misc_feature (30)..(215): Pfam Name: Ribonuclease_T2 Pfam Description: Ribonuclease T2 family
  misc_feature: SWISSPROT Homolog: EC 3.1.27.1 Ribonuclease T(2)
  misc_feature (227)..(227): Xaa is any aa, unknown, or other
  misc_feature (246)..(246): Xaa is any aa, unknown, or other
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRCPSNNGQSSWKNAWKKAGACSGLSEKDYFETALSFRSRINPLVRLKAKGIEPDFGLYGLKAITKVFKSGINATPVIQCSKGPFDKYMLFQLYFCAAGNGTFIDCPAPQQYTWLNEILFHPXQKWMLKQQLNQDDDPFMLXCVRMDN

SEQ ID NO: 73961 - DNA, 959 bp, Zea mays
  misc_feature: Ceres CLONE 1558303
  misc_feature: Encodes the peptide sequence at SEQ ID NO. 73962
  misc_feature (889)..(889): n is a, c, t, g, unknown, or other
ctggagctccccgcggtggcggccgctctagaactagtggatcccccgggctgcaggaattcgtctcacccctagaaaaaatcccaaaccagttcagcttccaaaaaggcaaagcagagcccgcacgcggagaggctacagaagggtatgggtcacctccgcggcctcaccgccgcgcggctcctcgcggcggccttcctgctctccgttgccgtcccggccgccagagcccaggaagaaaccgagcacgaggaggagttcagctacgtcgtcggcgacgagaacgggccggagcactggggcagcatcaaggcggagtggggcaactgcagcgccgggcggatgcagtcccccatcgacctctcccacgagcgcgtctcgctggtgcggtccctcggctacctcacccactcctaccgccccgccgaggccgccatcgccaaccgcggccacgacatcatggtgaggttcaagggcgacgccggcttcctggtgatcaacggcacggcgtactacctgaagcagatgcactggcactcgcccaccgagcacaccgtcgacggccgcaggtacgacatggagctgcacctggtgcacgagagctcggcgaacaaggcggcggtgatcggcatgctctacgagatcggcgccgaggacccgttcctgcaagcgctggagccgtccatccaccggatcgccgacaggcaggaccgggtagattgccatcttgcgtggtggaccccctgcgcgcgcgcaggatggccagcgtctaactacgctacgtgggctccctcacacggcgccctgcaaccgaggggtcattctgacgtccttcatatgtgtccgcacctgttcaggcaccactgtactgcctaggtaacccctgccnaacgcctgagaaaaacccgggcccgttcggacttcacaaagggaaatacatcttccgcaaagcaacaaga

SEQ ID NO: 73962 - protein, 242 aa, Zea mays
  misc_feature: Ceres CLONE 1558303
  misc_feature (43)..(232): Pfam Name: Carb_anhydrase Pfam Description: Eukaryotic-type carbonic anhydrase
  misc_feature: SWISSPROT Homolog: EC 4.2.1.1 Carbonate dehydratase
MGHLRGLTAARLLAAAFLLSVAVPAARAQEETEHEEEFSYVVGDENGPEHWGSIKAEWGNCSAGRMQSPIDLSHERVSLVRSLGYLTHSYRPAEAAIANRGHDIMVRFKGDAGFLVINGTAYYLKQMHWHSPTEHTVDGRRYDMELHLVHESSANKAAVIGMLYEIGAEDPFLQALEPSIHRIADRQDRVDCHLAWWTPCARAGWPASNYATWAPSHGALQPRGHSDVLHMCPHLFRHHCTA

SEQ ID NO: 73963 - DNA, 946 bp, Zea mays
  misc_feature: Ceres CLONE 1558305
  misc_feature: Translation starting site: 196
  misc_feature: SWISSPROT Homolog: EC 1.1.1.39 Malate dehydrogenase (decarboxylating)
  misc_feature (800)..(800): n is a, c, t, g, unknown, or other
ctggagctccccgcggtggcggccgctctagaactagtggatcccccgggctgcaggaattcgtctcacccctagaaaaaacgcgtctcttaaaaagaaccaccaccgcaccgcaccgtctcggacgcggctgcagctccgagcattggattccgaccaactgaccgagcggcgtgtcagatgatctcgccggcaatgtgtcgttcggcgccgcggcgggccgcgcaggtccggcgcctcctgtcgtcggccgcgcccccggcgcacgccggcgctgccgtgcctgggccctgcatcgtgcacaagcgcggcaacgacatcctccacgatccgtggtacaacaaggatacggcgttccccatgacggagcgcgaccgcctcggtctccgcggcttgctcccgccgcgggtcatgtccttcgagcagcagtacgagcgatttataaactctttccggtcgctggagcacaatacccgcggcgagcctgactccatcgtcgcgctggccaaatggaggatcctcaacaggttgcacgaccggaacgagacattgtactacagggtgctaattgacaatatcaaggattttgccccgataatatacactcccactgttggcttggtctgtgaaaattacagcggtctgttcagacgaccccgtgggatgtatttcagtgcaaaggataaggggggagatgatgtcaatgatttacaactggccagcagaagaggttgacatgatagttgtgactgatgggagtcgcattctgagcttaggtgaccttggtgttcagggcatangtatacgtattggtaaactggatgtttatgttgcagctgctggtattaacccacagaaggtgctccaataatgcgtgatgtgggaaacaataatgaaagcttctggaggaccagctatgtgcgtgagatacttaaccgtgatttct

SEQ ID NO: 73964 - DNA, 949 bp, Zea mays
  misc_feature: Ceres CLONE 1558306
  misc_feature: Encodes the peptide sequence at SEQ ID NO. 73965
ctggagctccccgcggtggcggccgctctagaactagtggatcccccgggctgcaggaattcgtctcacccctagaaaaaaaccaaacttccggtcttctcttctccactacccacccgcctgcccgcccgccttctcctccaccactgccccgccgctaaccaaccactcgtgcgccacaagtctcccgtcgtggaatagggcaaaggccaggcatctcgcttctgtcctctgtcgaggggatcggacccgatcggagaaagaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaggtggagcgccggcccttcacggcggaggaggacgcggccatcgtccgcgcccacgcccgcctcggcaaccgctgggccgccatcgcgcgcctcctccccggccgcaccgacaacgccgtcaagaaccactggaactgctcgctcaagcgcaagctcgccgccgcgtccgccccggcgggttcctccgacgtcgaggcgcgcccgaccaagcgcgtcagcctctcgcccgacagcccgtcggggtcggggtcggggtcagggtcagggtccgggtccgggtccgggtccgaccgtagcgacctgagccacggcgccgggcaggtttaccgccagtggcgcggtccggcgggttcgagccggcggactgcgcgatgagccgccgctgggagaagaaggagatgaaaaggagacccgctccctccctcagcctcttgcttcaggaacggacagcggttcaccacgacgcgccccagcaagtccagagctccagggtcccgccccgccc

SEQ ID NO: 73965 - protein, 184 aa, Zea mays
  misc_feature: Ceres CLONE 1558306
  misc_feature (11)..(57): Pfam Name: Myb_DNA-binding Pfam Description: Myb-like DNA-binding domain
  misc_feature (63)..(108): Pfam Name: Myb_DNA-binding Pfam Description: Myb-like DNA-binding domain
MGSEADCDRIRGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRKLAAASAPAGSSDVEARPTKRVSLSPDSPSGSGSGSGSGSGSGSGSDRSDLSHGAGQVYRQWRGPAGSSRRTAR

SEQ ID NO: 73966 - DNA, 921 bp, Zea mays
  misc_feature: Ceres CLONE 1558307
  misc_feature: Encodes the peptide sequence at SEQ ID NO. 73967
  misc_feature (912)..(912): n is a, c, t, g, unknown, or other
ctggagctccccgcggtggcggccgctctagaactagtggatcccccgggctgcaggaattcgtctcacccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactaccttggcaaccccagcctgatccacgcgcagagcatcctcgccatctgggcctgccaggtcgtgctcatgggcgccgtcgagggctaccgtattgccggcgggccgctcggcgaggtcgtcgacccgctgtaccctggcggcagcttcgaccccctcggcctggccgaacgaccccgagccttcgccgagctcaaggtgaagagctcaagacggccgcctcgccatgttttcccatgtcggctttctcgtcaggccatcgtcaccggcaaggcccgctcgagaactcgctgacacatcgctgaccagtcaaacacacgcaggggctacgccaccaactcgtccccgnaactagctc

SEQ ID NO: 73967 - protein, 238 aa, Zea mays
  misc_feature: Ceres CLONE 1558307
  misc_feature (61)..(228): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGGPLGEVVDPLYPGGSFDPLGLAERPRAFAELKVKSSRRPPRHVFPCRLSRQAIVTGKARSRTR

SEQ ID NO: 73968 - DNA, 961 bp, Zea mays
  misc_feature: Ceres CLONE 1558308
  misc_feature: Pfam Name: Ribosomal_S18 Pfam Description: Ribosomal protein S18
  misc_feature (762)..(762): n is a, c, t, g, unknown, or other
ggagctccccgcggtggcggccgctctagaactagtggatcccccgggctgcaggaattcgtctcacccctagaaaaaaataaagaaataggagcatcgtgtgttcgatttttccaaagaacagaaagagtaagaacttcttattaaatatatagaacatagatagaatactaaatacaaatcaactcatctgattttaggtagatattatttcatatgtatagagggtttttatttttatatatttggattttttatatttttatatagtatattttgatttaatcaatttatatagtatattttgatttaatcaaataatatatggaccaaagaaagactacttcttctggttctggatcaaaaattaataaaagaaagaaatccatttttttttttttcaaattttaaaataaggaataaatcatgtatatatctaaacaaccttttcgtaaatctaagcaaccctttcgtaaatccaaacaaacttttcataaatctaagcaaccttttcgtaaattcaaacaaccttttcgtaaatctaagcaaccttttcgtaaatccaaacaaccttttcgtaggcgttctcgaataggcccgggggatcgaattgattatagaaacatgagtttaattaatcgatttattagtgaacaaggaaaaatattatctagacgaataaatagattaaccttgtaacaacaacgattaattactcttgctataaaacaggctcgtattttatctttcttaccatttcgntactatgagaatgagaagcaattttcagcccaggcaattttcataattactggtcctagacacagaaaaaatagacatattcctcaattacacaaaagttcatttccatcgaaaactagaaactccaccagaattgagaacaacaatcgaaacttagtccccattggtgatgttttattcgaagaccagacccttttta

SEQ ID NO: 73969 - DNA, 947 bp, Zea mays
  misc_feature: Ceres CLONE 1558309
  misc_feature: Encodes the peptide sequence at SEQ ID NO. 73970
  misc_feature (855)..(855): n is a, c, t, g, unknown, or other
  misc_feature (936)..(936): n is a, c, t, g, unknown, or other
ctccccgcggtggcggccgctctagaactagtggatcccccgggctgcaggaattcgtctcacccctagaaaaacatcgaggtccaaaaatccatctggattctggagagaggagaccccaaaatcgcagcgcgcgaatacgcaggatcaacccgccctctcgccaccaccgcccgcgcgctcggcggagaccgatggccccgctcgtgccgatgtcgcagccatgggtggagaaataccggccgaggcaggtcaaggatgtggctcaccaggaggaggtgattcgggtgctcaacaacaccctccagaccgccgacctgccgcacatgctgttctacggcccgccggggacgggaaagacctccaccgcactagccatcgcctaccagctctacggtccagagctgtataagtcaagggttttggagctcaatgctagcgatgatcgtggaattaatgcggtgaggacgaaaatcaagaactttgctgctgttgctgttggtactgcacggaaagctggttatccctgcccaccttacaagattattatacttgacgaagcagattctatgacagaagatgcccagaatgctttgaggcgtacctcagagacttactcctgagtgaccagattcttttttatatgcaactatgtcagcaggataatagaaccacttgcatcttgatgtgcaaagttcaggttcaagcctctctcagaagaagagatgagcagtcgcattatgcatatactgcatgaagcaagcctcaatcttaatgctcatgcgactgtcacactgagtgtattttcgcagcgtgatctcgtcatgctatatctaccttcatagcgcagctcgncttatcggatcgtccatctcatccgcgacctgattgtggttcaagggtttaacctaagaatgtgtcatgcactgcttgcancagaatattag

SEQ ID NO: 73970 - protein, 142 aa, Zea mays
  misc_feature: Ceres CLONE 1558309
  misc_feature: SWISSPROT Homolog: EC 2.7.7.7 DNA-directed DNA polymerase
MAPLVPMSQPWVEKYRPRQVKDVAHQEEVIRVLNNTLQTADLPHMLFYGPPGTGKTSTALAIAYQLYGPELYKSRVLELNASDDRGINAVRTKIKNFAAVAVGTARKAGYPCPPYKIIILDEADSMTEDAQNALRRTSETYS

SEQ ID NO: 73971 - DNA, 1425 bp, Zea mays
  misc_feature: Ceres CLONE 1558311
  misc_feature: Encodes the peptide sequence at SEQ ID NO. 73972
atcatctcttcttgataaagtagatgctgcacctgctctgagttgtatcctatggttattcacttgggaagcgatgcatatttccctttttttttaaaaatcatagcaccttttgtctctctctctctgtgtgcaagcaggaagggtttggaggatgacagaagctgcagttattacaaggtactggtgccatggatgcgagaaggtcatcgaggaggccatgggggaggagatcaagtgcccgttttgcggtggtggattcatcgaagagatggccggggaggattccgaggggttgcagttagagcgggagtggggaacgccgccaggggacagcgaggacgacgatgacgaccatatagcccatgagttcgagggctttatcaggaggcacggacgggcatcagctctgcgccgggtgctcgacagcatccaggacgaccttagagccgacagggaaagggacaactccgtcctcatcaacgccttcaaccaagccctcgcctcgcaaggctcggcgctgctggatgccgacgaggcccgagacggccgaggtggatccagcaacagcaacgacgatggcttgctggaagagtatgatgtcctgggggctgggctgagcctactgcttcagcatctggccgagaacgacccgaaccggtacggcacccctccggcgaagagagaggcggtcgaagctctgcccactgtccagatagcggaggccgtcagctgttcggtctgcctcgacgatcttgagctggggtccccggcgaagcaaatgccctgtgggcataggttccactcttcttgcatcctgccatggcttgagctccacagctcttgccccgtgtgccggttcgagctgccgtctgaagagacgaaagatctgaacgagcctagcgatgtgcacagaagaacagagagcgcccgagagaacgacagcgagagcggtaacagcgcgtggccccttgtaccttggttcttcagcgggctgttctcggtacctgaaccgcacactgacagaggcactctgaccaccgatcaacagagcccttccaccaacccaaatgctggaggaaattgatttcgtcatcctttgtgaataatgctcatacatctgagaatagcaaggagccttgtcagtagatggcttattttttttctgtactgataatccttctcggatgaatcgcaaggtacggagtctgtgtctgctctattgtcaggattctagcgatcgtttcgcctctagttaatctcatagctactgagactgtctgtctgcatcctatgcaaaagatcggttgctttctttgttcttggctcttctgactggatgtctttgagctatttctggaatatgtaaactatcatgccttgtatttattcattgtttagttcaagtaaaaaaaaaaaaaaaaa

SEQ ID NO: 73972 - protein, 310 aa, Zea mays
  misc_feature: Ceres CLONE 1558311
  misc_feature (194)..(234): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MTEAAVITRYWCHGCEKVIEEAMGEEIKCPFCGGGFIEEMAGEDSEGLQLEREWGTPPGDSEDDDDDHIAHEFEGFIRRHGRASALRRVLDSIQDDLRADRERDNSVLINAFNQALASQGSALLDADEARDGRGGSSNSNDDGLLEEYDVLGAGLSLLLQHLAENDPNRYGTPPAKREAVEALPTVQIAEAVSCSVCLDDLELGSPAKQMPCGHRFHSSCILPWLELHSSCPVCRFELPSEETKDLNEPSDVHRRTESARENDSESGNSAWPLVPWFFSGLFSVPEPHTDRGTLTTDQQSPSTNPNAGGN

SEQ ID NO: 73973 - DNA, 929 bp, Zea mays
  misc_feature: Ceres CLONE 1558314
  misc_feature: Encodes the peptide sequence at SEQ ID NO. 73974
  misc_feature (800)..(800): n is a, c, t, g, unknown, or other
ctccccgcggtggcggccgctctagaactagtggatcccccgggctgcaggaattcgtctcacccctagaaaaaatcacactcgcacagtcgcaccacagcgagcgagaacaaggcgcccaagcaaccaccgcgagaacaagtcgcagccaaagagccccgtctcccagcgaagcttgagcttgcatccatactaccatgtcttccatggagctgctccacgccgtcgtcccggagaagcagagcgaggaggaggtcgcgcccgcagcgacgaccacgagcagcagcgccaccgccacgagcggggacgagggcgcccacgtgccccaggggtgggccaagaggaagcgctcgcgccgccagcgatcggaggaggagaacctcgcgctctgcctcctcatgctctcccgcggtggccaccaccgcgtccaggcgccgccaacgccggtcccgtccgcggcgccggccgccgcggagttcaggtgctccgtctgcggcaagtccttcagctcctaccaggcgctggggggccacaagaccagccaccgcgtcaagctgccccccccctttccttctcctactgctgtaactgtcccggcagcagtgcccgtcccggaggcccccgccccgaccaccgtcgtcgtcccgccgctgccgccagtcgatgtcggccgcgagccggccacgtcatccaccggcgcgtcctccgacggggcggcctcgagcagagtccaccggtggctcatctgccacaaggagttcccgacgggcatgcgctcgcgggcacagaagaagcctacnacggggcgtccggaggcccccgcttcacctactcccggcgggccccgcaatactccgccaggtcggagctcccccggcgtgggttctactcaactccgggcgtggcagaattctgttcgggcgcaacct

SEQ ID NO: 73974 - protein, 244 aa, Zea mays
  misc_feature: Ceres CLONE 1558314
  misc_feature (94)..(116): Pfam Name: zf-C2H2 Pfam Description: Zinc finger, C2H2 type
MSSMELLHAVVPEKQSEEEVAPAATTTSSSATATSGDEGAHVPQGWAKRKRSRRQRSEEENLALCLLMLSRGGHHRVQAPPTPVPSAAPAAAEFRCSVCGKSFSSYQALGGHKTSHRVKLPPPFPSPTAVTVPAAVPVPEAPAPTTVVVPPLPPVDVGREPATSSTGASSDGAASSRVHRWLICHKEFPTGMRSRAQKKPTTGRPEAPASPTPGGPRNTPPGRSSPGVGSTQLRAWQNSVRAQP

SEQ ID NO: 73975 - DNA, 946 bp, Zea mays
  misc_feature: Ceres CLONE 1558315
  misc_feature: Translation starting site: 539
  misc_feature (644)..(644): n is a, c, t, g, unknown, or other
  misc_feature (714)..(714): n is a, c, t, g, unknown, or other
  misc_feature (732)..(732): n is a, c, t, g, unknown, or other
  misc_feature (734)..(734): n is a, c, t, g, unknown, or other
ggagctccccgcggtggcggccgctctagaactagtggatcccccgggctgcaggaattcgtctcacccctagaaaaaagccacggatcgagacgtcccaatcgagctaatctcacaccgccagtgccagtgccagcggcagctgctaatccgtgccgtgttccagcagcgatgggagtggagtcggagtgcgacaggataaagggcccctggagcccctaggaggacgaggcgctgcggcgtctcgtggagcgccacggcgcgcggaactggactgcgatcgggcgcggcatcccggggcggtcggggaagtcgtgccggctgcggtggtgcaaccagctgtcaccgcatgtggagcgccgccccttcacgcccgaggaggactccgcgatcctggccgcgcactcccggctgggcaaccggtgggccgccatcgcgcgccttctcccggggcgcaccgacaacgccgttaagaaccactggaactcgtcgctcaagcggaagctcgccaccgccacggcgacctccagcggcagcgatgcttgagcgggcgtgcaagcgcgcaagcctggggcccggggagccccgactgcgtctgaccgcagcgacctcagccacggctgcggcgccgcgcatgtgttccngtcccgtcccgcgctgcggaagcttcgacgccatcagcgccgcagacgtgctgcctccgccccccgcagnagtcgcagacgaggaccngntcacctcgctctccctctcgctgccggggctgggaccatcgccgtcgggcttccaccacgacaacgccggatgcactgcatgagctctccccctcgtcgtccccgtcgccgcagtctactcaccccgctttcctccgaagggggtccgtctcaatcctcgtacccttcaacggcaacctgttgccccaaatctgaattatcccgccagttct

SEQ ID NO: 73976 - DNA, 970 bp, Zea mays
  misc_feature: Ceres CLONE 1558316
  misc_feature: Encodes the peptide sequence at SEQ ID NO. 73977
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
acccgcggtggcggccgctctagaactagtggatcccccgggctgcaggaattcgtctcacccctagaaaaagttcgcgccgccgtagcccccaaaccaccatcaccctccggagcgtcgcagcgatcccaccctcattctcccctttacccgtccatggcggagcgcggcggcgagcgtggcggcgagcgcggcgggtttggccgcggcttcggtcgcggcgggcgcggcgaccgtggcgggcgccgaggcggccgtcgcggcccgcgtcaggaggaagagaagtgggtccccgttacgaagctcggccgcctcgtcaaggagaacaggatcaccaagatcgaggagatctacctccactcgctccccgtcaaggagcaccagatcatcgagaccctcgtgccggggctcaaggacgaggtgatgaagatcacgcccgttcagaagcagacccgcgccggacagcgcacgcgcttcagggcctttgtcgtcgtgggcgactgcgacggccacgtcggccggggagtcaagtgcgcaagggagtggcnnnacgcatccgcgcggcatcatcctcgccaagctctcccgtgttcccgtcagggagagctactggggtaacaagatcgggcagcccgcacaccgtgccttgcaagggcaccggcaagtggggggtccgtcaccgtgcgcctgggtgcttgcccccaggggtcctgggattgttccccgcgcgcgtggcccaaaaaggggccgcaattccctggcattgaggatgctttcccccggcccggtggccccctaaaaccccttggaaactccgtaaaggaacccttcaaggccccaagaaaaacaggggttcctttcccggaatttgggaggaaacaagttcccaggaaccccttccaagaaacaggccggtggaaaacccacagggggttgggggttggccccatataaaaaggggcttaggggg

SEQ ID NO: 73977 - protein, 153 aa, Zea mays
  misc_feature: Ceres CLONE 1558316
  misc_feature (84)..(140): Pfam Name: Ribosomal_S5 Pfam Description: Ribosomal protein S5, N-terminal domain
  misc_feature (131)..(131): Xaa is any aa, unknown, or other
  misc_feature (132)..(132): Xaa is any aa, unknown, or other
MAERGGERGGERGGFGRGFGRGGRGDRGGRRGGRRGPRQEEEKWVPVTKLGRLVKENRITKIEEIYLHSLPVKEHQIIETLVPGLKDEVMKITPVQKQTRAGQRTRFRAFVVVGDCDGHVGRGVKCAREWXXASARHHPRQALPCSRQGELLG

SEQ ID NO: 73978 - DNA, 956 bp, Zea mays
  misc_feature: Ceres CLONE 1558317
  misc_feature: Translation starting site: 172
  misc_feature: SWISSPROT Homolog: EC 1.10.2.2 Ubiquinol--cytochrome-c reductase
ctggagctccccgcggtggcggccgctctagaactagtggatcccccgggctgcaggaattcgtctcacccctagaaaaactctgtctgtcttcctccgtgcgtcccggcgcgaaccctagccgagattagattgaggcgagcgccatcaccggaggaagaggaagacacgatgctgcgggttgcgggaagaaggctctcgtcttccctctcctggcgccccgctgtggcggcggccaggggccccctcgccggcgctggtgcccccgaccgggacgacggctcggctcgcggccggagccagacgcggttctccatcgactctcccttctttgtcgctgccaggggtttctcttcgactgaaacacttgtcccaggaaaccaagatgctggcctagctgacatcccagcaactgtggctgctgtgaagaatcctaaccctaaggtggtttatgatgagtacaatcatgaaagatatcctcctggagatcccagcaagcgtgcatttgcttactttgtcctgagtgggtgggaggttcatatatgcatcactgctgcgtctcctcgtattgaagtttgtcctgagcatgtcagcaagtaaggacgtgcttgcccttgcttcactcgaggtggacctctccagcattgagccaggggacacgggtgactgtgaagtggcgcggaaagccagtcttcatcatgcgccggacggaggacgacatcaagcttgccaacagtgtggatgtggcatccctgcgcaccccgagcaggatgcagagcgtgtgaaagatcccgagtggctgtgggtcattggcgtgtgcactcacctaggttgcatccactacgaaacgccggagactttggcggctgggttctgccatgccatgggtccactacgaaaatttccggaaggatcgccagggaccctgcgccgtttaaccctcgagggtcccgact

SEQ ID NO: 73979 - DNA, 947 bp, Zea mays
  misc_feature: Ceres CLONE 1558318
  misc_feature: Encodes the peptide sequence at SEQ ID NO. 73980
  misc_feature (787)..(787): n is a, c, t, g, unknown, or other
tggagctccccgcggtggcggccgctctagaactagtggatcccccgggctgcaggaattcgtctcacccctagaaaaaaccagaagctcactcactgctcgttgccggctgcccccgcggccccggccagtccatcccctcgctcgctccccaactccagcaggcagatcagatacatccatccattcgcggaccggaagcaggaaaggaagggttgaactatgagcgccgtggcggtttcgtcgtcgctgaacccggacgcgccgctcttcatcccggcggcgctgctgcaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcagggccccgtcgccgccgcccttaagacagattcggtgctcaaggcgctgaacatgacctccccgaagggcggcggcgacgccccgcgggggttccgggagaaacccaggaacgccgagaagccgaccaagtacgccggcagccccaagagcaacgctccccgcgtgatccaccagcctcgctaggttcgctgggggaactcatcaggaaggctgctgcccctcttgcagccttgctcctggctgccgccgctgtcgtggtctgctctttcagtcgaagtaacggtgggtcgagctaatggatagtgtgctccactgtagaagtccnttttgtatagcaagcagtaaaaaaaaaatgaccaaaatataaccaatgcagctgtagttactgctgctccctaagcgggtcagccatccgtgggctaggctaggacccctaaaaatggggagggggatccatccagtgcataattaggatcactctctgt

SEQ ID NO: 73980 - protein, 140 aa, Zea mays
  misc_feature: Ceres CLONE 1558318
MSAVAVSSSLNPDAPLFIPAALLQVEDFSPQWWDLITTTAWFRDHWSRERAHLDEMAEQIDAAGLLPDDEDLFYDDQLEQGPVAAALKTDSVLKALNMTSPKGGGDAPRGFREKPRNAEKPTKYAGSPKSNAPRVIHQPR

SEQ ID NO: 73981 - DNA, 1025 bp, Zea mays
  misc_feature: Ceres CLONE 1558320
  misc_feature: Encodes the peptide sequence at SEQ ID NO. 73982
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (22)..(22): n is a, c, t, g, unknown, or other
ggagagaacgagaacgnnnagnttttttatgctggagctccaccgcggtggcggccgctctagaactagtggatcccccgggctgcaggaattcgtctcacccctagaaaaaatctcaagccaccatcgaccttcagagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgcaacggcgtcaagttcggcgaggccgtgtggttcaaggccggctcccagatcttcagcgagggcgggctggactacctcgggaacccgagcctcatccacgcgcagagcatccttgctatctgggcctgccaggtcgtgctcatgggcgccgtcgagggctaccgcatcgccgtgcgcccgcttgggcgaggtcgtcgacccgctctaccccgggcgcagcttcgaacccgctcgggcttcgcgaacgacccggaggccttcggcgaactcaaggtcagggagctcaagaacggccgcctcgccaggttctccaagttcgggattcctcctccaggccattgttcaccggggaagggcccgcccgaaaaccctcgttgaaacaatttgcgaccccgcaaaaaaaaaaggtggggctaagccaccaatttttgtccccggaaaatgaagtgagggcccccccgggtgaccttttaggtgtccggagt

SEQ ID NO: 73982 - protein, 246 aa, Zea mays
  misc_feature: Ceres CLONE 1558320
  misc_feature (65)..(229): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAVRPLGRGRRPALPRAQLRTRSGFANDPEAFGELKVRELKNGRLARFSKFGIPPPGHCSPGKGPPENPR

SEQ ID NO: 73983 - DNA, 931 bp, Zea mays
  misc_feature: Ceres CLONE 1558321
  misc_feature: Encodes the peptide sequence at SEQ ID NO. 73984
ctggagctccccgcggtggcggccgctctagaactagtggatcccccgggctgcaggaattcgtctcacccctagaaaaaatcatcgagtcatccatctaaacatccgatccgaccatggcggcagacgcacttcggggccttctccccggcgtttacgccgtgctgatggtaatcgccgtcacaagcgccgcctccagcgacgcgtcctcggtggtcgtcggcctcgccaaatgcgccgactgcaccaggaagaacttgaaggccgaggcggcattcaagggtcttgaggtggcgatcaagtgcaagaacagcaaaggcgagtacgagagcaaggccatgggcaagcttgatggcttcggcgccttcagcatcccacttagcacggacctccacggcgctgactgcgttgcacagctccacagcgctgcggggaacccgtgccccggtcaagaaccttccagaattgtgccacaatcgtcaaagggcaacttcgtcgtggtccctggaaagacagactacccatcgaaggaatgtgcgtccgcaaccctgtgtgggtcgatcaagaagcacctactagaccatttccacaagaaacctgtgccaccaaagccaaagccagaacctaagccagagctggagccgaagccagaacctaagccagagccagagaaccacccacctacaccaacatacggatcctcaactccgatctaccatcctccatccaggcagttgtttgacaagaaacacatgtttgataacttccacaagcaccacgactaccatcacttctttgaccacttgcacaagattacagtgtcaccaaagccaataacagaacctatgccatgaactatatccaagcccccagcagagtacaactctccaatctcaacatatggtccgccccacccggatctaccaccctc

SEQ ID NO: 73984 - protein, 245 aa, Zea mays
  misc_feature: Ceres CLONE 1558321
  misc_feature (34)..(245): Pfam Name: DUF1210 Pfam Description: Protein of unknown function (DUF1210)
MAADALRGLLPGVYAVLMVIAVTSAASSDASSVVVGLAKCADCTRKNLKAEAAFKGLEVAIKCKNSKGEYESKAMGKLDGFGAFSIPLSTDLHGADCVAQLHSAAGNPCPGQEPSRIVPQSSKGNFVVVPGKTDYPSKECASATLCGSIKKHLLDHFHKKPVPPKPKPEPKPELEPKPEPKPEPENHPPTPTYGSSTPIYHPPSRQLFDKKHMFDNFHKHHDYHHFFDHLHKITVSPKPITEPMP

SEQ ID NO: 73985 - DNA, 941 bp, Zea mays
  misc_feature: Ceres CLONE 1558323
ctggagctccccgcggtggcggccgctctagaactagtggatcccccgggctgcaggaattcgtctcacccctagaaaaaatcgcgctttctccgcttccttctttcccctcacagggtcagaccccaacgccgggagaataggggattaggagccagacctggcggcgccgggcgtccaagaaacgctgcctaataaaatccctccggcgtctgtcgtcttgaccgcggcggcgcaggcttcttcttttcgctctccacggcagcgtcatgaagattaaggggaacttgcatgtttgatgtacccctgtagcaaaaaattcttgtgataaaatttgttgaattagtcactgtcagggagggatctagttgtcagttgtttgtattaaagctgctggcactttccttgcagggtttctgtagaataaatgggagaaggggtgtgctggcaagtatacactactcagagatgaagaaaacccacggtggacaatctttgagaggcggcttccttgctgtggttgtgggataggatggtcttcttttcttttagggttcttgtgtcctttgatttggtactttgcagccactctttactgctgcaagtactacaacaaggatcctcgagagcgccctgggctagctgcatcagctgttgcggcactcatcttcacagtcctggcactcatcgctctctctgtggcactgataatctatatataaaacgaggaatgaacttgcgcttgcttgaaatgcgtactcaggcactcatcttcacagtcctggcaacatccatagctctctgtggcacagacatctgaaaccccaagcgaggaaaacgcggtagctggacctggcattcagaaggaacttgtaattttagtgatagtagcatatctttgcaatcatcctttcatgtatcactatttcaagttgttgatt

SEQ ID NO: 73986 - DNA, 994 bp, Zea mays
  misc_feature: Ceres CLONE 1558326
  misc_feature: Translation starting site: 149
  misc_feature (487)..(487): n is a, c, t, g, unknown, or other
tggagctccccgcggtggcggccgctctagaactagtggatcccccgggctgcaggaattcgtctcacccctagaaaaactcccgcagagccgccgacaactctctctaccgtccgataccccaagcaccagcgcggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaactgagatccctnagtgaagaagtggcagacattaatcgaagcccatgttgatgtcaagacaaccgacaactatcatgttgcgtttgttctgcatcggcttcacgaagaggcgcccaaaccaggtcaagagaacctgctatgctcaggcatcccagatccgtcagatccgccgtaagatggttggagattatgatcaaccaggcttgctacatgtgacctgaaagaccttgtttcgaagtccattccagaaagctatgggtaaggagatggagaagtctacctccagcatctgccaacttcataacgtcttcatccgcaaggtgaagatatcaaggccccccaagtcgatcctgggaagcccatggaggtcatgcgacaacaaaaaagatgttggtgtgaaacttgaaagcctgtcaagggaattagcctttccggaagtgcccccccccaaaaatttggtgcactccttttctggcgagactgaaaagagtgctttaaaaaaactaaaaatggcccctt

SEQ ID NO: 73987 - DNA, 927 bp, Zea mays
  misc_feature: Ceres CLONE 1558327
  misc_feature: Translation starting site: 269
  misc_feature (595)..(595): n is a, c, t, g, unknown, or other
ctggagctccccgcggtggcggccgctctagaactagtggatcccccgggctgcaggaattcgtctcacccctagaaaaaattccactccatcagtgggcagcgctctgctctcctccactcacgaactcactcactcactccccttgcccccatccatccgctagccactagctccagcaggctcgccgccgacactccactagtgctctgctctctccgctccactcacaaactcgcctcgctccccccccccccacaaatgggcgatggatctgctgctgcggcggcagctgctggacgaggtggccaccgcggctgtgctggccgtgtgcgccttcacggcggcggaggggttcgacatcctgcagatactggggaagcacgacgagttctgcgcacttctgcaagctgatcaacgagacgcacctggccggcgacatcaaccgggaccgcacaatcaccgtgctggacatggccaaacgcgacatgggccacctcgacgacagccactactctgctcgaaccatccaacacatcctcgaagctgcacgtcgtcgccgactactacgacgactagaagccaaggagatgtngcaagacgtcaacacaacgtacgccttgttcctgcgatccggattggcccccgcatggcaggatcgtttaacatacgatgaccgcgggcggaagtgcccgtcctcgagggacacgggggaaaccgaaagccaatcctttcttggaccaaatttagaccccggtagaaaaacccggggccagggaacgggccccgttcccccgggaggcagggaacgtttcccccggggggcccaaaacacaaagaaaccccccaaaaaattccggaagggtgggagggccccccccccaccacaaagtgtttaaacccccccggggggaggaaaaccgcccc

SEQ ID NO: 73988 - DNA, 968 bp, Zea mays
  misc_feature: Ceres CLONE 1558330
  misc_feature: Encodes the peptide sequence at SEQ ID NO. 73989
atgctggagctccccgcggtggcggccgctctagaactagtggatcccccgggctgcaggaattcgtctcacccctagaaaaagccccacaaccgctctatatgactccatcctccccccttccccctccccgtgatggctgcaatggatgacgtaattgtagtggagctgtagaggcggcgggggtgcggttgcgacgggctgtgctgcgccgacaagctgggaggaggaggcggcggcggcgggttgggacttgggatgggtcttctgtcgaaccgggtggagcggtcggagatcaggcccggcgaccacatctacacctggcgggccgtctacgcctactcccaccacggtatttatgttgggggaagcaaagtggtccattttacacgtaagaaagaaactgaaacttcagattcatcagactccacctccagcctggtctcagagatttcatcagagtgccaaacattccctgattgtggatttcagctgtctaatagtggtgttgtcctcacttgcttggactgtttcctccgcaacggctccctctattgcttcgagtatggagtgccatctgcagttttccttgcaaagtttcgtggggggacctgcaccattgccgaatcagacccaccagaagttgttgttcatcgagcgatgtacctgcttcaaaatggtttcggaaactacgacatgtttgagaagaactgcgaagacttcgcactctactgcaagactgggcttctacctgttgaggagcctggcattgggactagtgaggcagcttcttctgctataggtgtgccgttgggcactcttctgtccactccgttaaagctcctgctgctggtccgctgggattgccactgtccccgctggaatttctgggctggcgataccttctgacataggagtaaggaaggactcccaaaatttgaaggggaaaattttctccccccccgctt

SEQ ID NO: 73989 - protein, 216 aa, Zea mays
  misc_feature: Ceres CLONE 1558330
  misc_feature (99)..(177): Pfam Name: NC Pfam Description: NC domain
MGLLSNRVERSEIRPGDHIYTWRAVYAYSHHGIYVGGSKVVHFTRKKETETSDSSDSTSSLVSEISSECQTFPDCGFQLSNSGVVLTCLDCFLRNGSLYCFEYGVPSAVFLAKFRGGTCTIAESDPPEVVVHRAMYLLQNGFGNYDMFEKNCEDFALYCKTGLLPVEEPGIGTSEAASSAIGVPLGTLLSTPLKLLLLVRWDCHCPRWNFWAGDTF

SEQ ID NO: 73990 - DNA, 923 bp, Zea mays
  misc_feature: Ceres CLONE 1558331
  misc_feature: Encodes the peptide sequence at SEQ ID NO. 73991
  misc_feature (738)..(738): n is a, c, t, g, unknown, or other
  misc_feature (877)..(877): n is a, c, t, g, unknown, or other
ctggagctccccgcggtggcggccgctctagaactagtggatcccccgggctgcaggaattcgtctcacccctagaaaaaaggaataggagcaggagatagcgcgggcggggaggggaaggagacaagtgaactcagagaagaactagcgcggcgggcgagcattgcaagccgagctgcaggggcccggagcggagaccggaggagggagacgtcgcttgcgatgtcaccggcagcatccgccgccgaaaccgccgtcgtcgtcgtcgtcgcaagcgtcccgagccagcagcaaagcagccaccgcgccgcggcgccgtccgtcccgtcgtcctacgccgtctgggagaaggagcggtaaggcggctgcagctttacgacgtcgtcgtcgtcgtctgccacctgcctactgctgctgctgctgcaagggaaggaaaaaggaacggaaagggggaaggcatggaggtggaggcggccaagtgcgagtgctgcgggttcacggaggagtgcacgccggcgtacatcgcggctgtgcgcgccgagtacctgggccgctgggtctgcggcctctgcgcctaggcggtgggcgacgagatccggcgcgaggggaccatcaccacggccgaggcgctcgaccgccacgtctcgttcgcgcgcgcaccgcgctgcctgagggcgcccgcggaggacgacctcgtggcggccagtagcgcggatgctccgccgctgcctggaatantcgccctcgtcgtctgggccgaccccgctgtagcgggaaggtggcccacggcccggctgccccgagtgagccgacgcttgaagctgcctgcttaattgaggcatggatatgggggggttggttcccctgccccgggaanaattaggtgtgccggtacaagaataaactccactggcatagatgga

SEQ ID NO: 73991 - protein, 39 aa, Zea mays
  misc_feature: Ceres CLONE 1558331
MEVEAAKCECCGFTEECTPAYIAAVRAEYLGRWVCGLCA

SEQ ID NO: 73992 - DNA, 882 bp, Zea mays
  misc_feature: Ceres CLONE 1558333
  misc_feature: SWISSPROT Homolog: EC 4.1.1.39 Ribulose-bisphosphate carboxylase
ctggagctccccgcggtggcggccgctctagaactagtggatcccccgggctgcaggaattcgtctcacccctgagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaactgcctacttcttcacattcaccgagcaatgcatgcagttattgatagacagaaaaatcatggtatgcatttccgtgtattagctaaagcattgcgtatgtcggggggagatcatatccactccggtacagtagtaggtaacgtagaaggggaacgcgaaataactctaggttttgttgatctattgcgcgatgattttattgaaaaagatcgttctcgcggtatcttttttcaccaagactgggctcccatgccaagtgtttaaaccgtgggctccggggggttttcatggttgggatatagcaacccctgaacgaatcctttggaaaaaaatcccctattaaaaattttggcgaaaggaaattttggaaaaacccttggggaaaataaccctgggcaagaaacaaacggggggcctttaaaaaccttgttaaaaccccaaaaaaaagggggaaactttccccccaaagggataaaaattttcaaacccccctcaaaatgggggggccaaacccccccccctggttaatattggggggagcacaaattttggggttgtttccagggggggggccccccttttaataaaaaa

SEQ ID NO: 73993 - DNA, 960 bp, Zea mays
  misc_feature: Ceres CLONE 1558334
  misc_feature: Encodes the peptide sequence at SEQ ID NO. 73994
ggagctccccgcggtggcggccgctctagaactagtggatcccccgggctgcaggaattcgtctcacccctagaaaaattgtcacaaatgtcatcagggatacaagaaaacctctgcacccacaatatattttaggcatgacagttacacggcttgctattccattgtatatatttggttgccctagtaatttcatgcgtatcgagcccgacaagaaatggtccatagctgttacagtattcatgggtatccaagcagcagtgcttctgcttcagcactatcttggttctcgctgctttattcctcgccagatactgcctgagaaatactgctaccataggaaggtagaggacagcacaaatcagcccatcgattgtgttatttgcatgactacaatcgaccttacccaaagaacaagtgaatacatggtggcaccttgcgagcatatatttcactcaggctgtttacagcgttggatggacattaagatggagtgccctacttgccggcgctccctaccaccagcttagatgaagctttgtatcatatataatagtgaaacagaagtaggtagctcagcttatacaaggtgggggaactgatgtacaataaggtgagggctgcatcgtgtgaaagctatgaacagactgtagaaagttttatactatgatttcagaagtctggggttgggcaactatcctatcagctcccagaaaaaatccgcctttccccccaagcggttaaccgggtggatgccttggcccggcacaaattttcggcccaccttttgggccaacttttggaaaatttttaaaccccgaaaaaattccaaaaggcctttttttttggggacaaattaaaacgtttttgtttaaaaaaaaaacccccccccccctcttttggtgttgtgggggaagaaaaaatattctcccccctttttttcggaaaaaaaataaaaaa

SEQ ID NO: 73994 - protein, 130 aa, Zea mays
  misc_feature: Ceres CLONE 1558334
  misc_feature (80)..(123): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MTVTRLAIPLYIFGCPSNFMRIEPDKKWSIAVTVFMGIQAAVLLLQHYLGSRCFIPRQILPEKYCYHRKVEDSTNQPIDCVICMTTIDLTQRTSEYMVAPCEHIFHSGCLQRWMDIKMECPTCRRSLPPA

SEQ ID NO: 73995 - DNA, 1008 bp, Zea mays
  misc_feature: Ceres CLONE 1558336
  misc_feature: Encodes the peptide sequence at SEQ ID NO. 73996
  misc_feature (818)..(818): n is a, c, t, g, unknown, or other
  misc_feature (821)..(821): n is a, c, t, g, unknown, or other
  misc_feature (987)..(987): n is a, c, t, g, unknown, or other
ctggagctcaccgcggtggcggccgctctagaactagtggatcccccgggctgcaggaattcgtctcacccctagaaaaaagagaagtgacgaccaagcgcgacaccgagtcggacggcgaaggctccaaccccgtcggtggtggcgcgactccgccgcccctagccgccgcccctgtcgtatgcctcctccgctccgccggggacttcggtggcggcgccttcgttggatccatcttcggatatggacaaggcttgatcaccaagaagggttttaagggctcattcagcaatgcagggtcctctgccaaggttagtttatcgtagtttttgttcaaatgtgcgtttctggatagctgttcataacacaaaatatcttggattagacttttgcagttctcaccccaacttgcttgggactaaaagggtttgttgttgttgtagtagacttttgcaattctctctggcgttcagagtttggttttgtgcttgttgcgaaggctacgtggcaaggatgacagtacgtataccttgttatccggtcatatatttgttaacatatctgaacttgtatgtgtaaatatgaactgacatgttctgtcggcagttgtcaatgctaggtatagctggttgttgtactggcctcgctttgggctttccagaggcgccacaggcattgctcccaaagctgtgccaccttcgcagcattctcatgcatcatgggagggctcaataagcagcaagctgcaatggctcgcacgcctgggagggactgcccgcgatggcgtgcatgaaaaaaatggggtggttctgccccgngtncacgcttccacccattccttgaagcatccggatgcctttagcctccaggccggccttagcgttagtaaagccctagcactgactccccccaataaaggggcttgacccaatgggccaaaagaggtacttcaccctccgcgccccttatttgggttaacccccgggnaaatagaattatgttttttgt

SEQ ID NO: 73996 - protein, 107 aa, Zea mays
  misc_feature: Ceres CLONE 1558336
GAHRGGGRSRTSGSPGLQEFVSPLEKREVTTKRDTESDGEGSNPVGGGATPPPLAAAPVVCLLRSAGDFGGGAFVGSIFGYGQGLITKKGFKGSFSNAGSSAKVSLS

SEQ ID NO: 73997 - DNA, 943 bp, Zea mays
  misc_feature: Ceres CLONE 1558337
  misc_feature: Encodes the peptide sequence at SEQ ID NO. 73998
  misc_feature (774)..(774): n is a, c, t, g, unknown, or other
  misc_feature (776)..(776): n is a, c, t, g, unknown, or other
ctggagctccccgcggtggcggccgctctagaactagtggatcccccgggctgcaggaattcgtctcacccctagaaaaatccccttctatctatctactatatatcgatccacccatccctcgcagctccaaagcattgaagcaaagaaccctgcaactgcaacaagccctgacgcttaatacatcggccggcactcgatcggcagcagatcaaagatggcggcggaggagggggagaaggcgaagagcggcggcggcgggcagcagatgacggtggtgcgggggctggacgtggcgcggtacatggggcggtggtacgagatcgcgtcgttcccgtccttcttccagccgcgggacggccgcgacacgcgcgccacctaccggctgctggaggacggcgccacggtgcacgtgctcaacgagacgtggagcaagggcaagcgcgactacatcgagggcacggcctacaaggccgaccccggcagcgacgaggccaagctcaaggtcaagttctacctcccgcccttcctccccatcgtccccgtcgtcggcgactactgggtgctctacgtcgacgatgactaccagtacgcgctcgtcggcgagccgcgccgcaagaacctctggatcctgtgcaggaagacgagcatcgacgaagacgtgtacaaccagctgggtggagcgggcctagggagaaatgctacgacgtgagcaagctgcacaggacgccgcatgacgacccgcctgcggagagcgacgccgcgccacgacancnaggggggggtggggtggtcaagtcgctctttcgggaatgactgcccgtcaccgcaggcgcgcgtgctcccgtaacggtgcttgcagttgcacaaataaaacaagccctgaatggaggaaggatggggattttaacccttggaagactggcccccccatcttgggggt

SEQ ID NO: 73998 - protein, 164 aa, Zea mays
  misc_feature: Ceres CLONE 1558337
  misc_feature (24)..(165): Pfam Name: Lipocalin_2 Pfam Description: Lipocalin-like domain
MAAEEGEKAKSGGGGQQMTVVRGLDVARYMGRWYEIASFPSFFQPRDGRDTRATYRLLEDGATVHVLNETWSKGKRDYIEGTAYKADPGSDEAKLKVKFYLPPFLPIVPVVGDYWVLYVDDDYQYALVGEPRRKNLWILCRKTSIDEDVYNQLGGAGLGRNATT

SEQ ID NO: 73999 - DNA, 961 bp, Zea mays
  misc_feature: Ceres CLONE 1558338
  misc_feature: Encodes the peptide sequence at SEQ ID NO. 74000
  misc_feature (635)..(635): n is a, c, t, g, unknown, or other
  misc_feature (638)..(638): n is a, c, t, g, unknown, or other
  misc_feature (645)..(645): n is a, c, t, g, unknown, or other
ctccccgcggtggcggccgctctagaactagtggatcccccgggctgcaggaattcgtctcacccctagaaaaaggtcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgtccgccaccgtggccggcgaagagcgcgccgtggacatcgacagggccttcacccaccgtgtacataaaggagagggtgtcgcgatgcctcgtagcgatccagcatgccaccgcccacatgtccntgncgcagcngctgattagtgtatgcccgagcagcatcggccgcatggcctcgtcttcctcgggcaccgtggcgggtagccccaacggggtggctgaaccctggctgcctgactaaaggaaaccccgccccccccccgccttgaaagggagctcaagtgggcgacaagaaaaaaaacactgcccccccggtggtgaacccaggggggaaaattccatattttaacccatgtggggcgggtaaaaacccggggtttttatcccacaaaaaaagggtggttttttgggagcccccccccctttttccacaaagcccgtaaagaaaaat

SEQ ID NO: 74000 - protein, 191 aa, Zea mays
  misc_feature: Ceres CLONE 1558338
  misc_feature (6)..(115): Pfam Name: Cyclin_N Pfam Description: Cyclin, N-terminal domain
PRGGGRSRTSGSPGLQEFVSPLEKGHTCYGFGPLTACLAVNYLDRFLSLYQLPEGKAWMTQLLSVACLSLAAKMEETYVPSSLDLQAGDARYVFEAKTIQRMELLVLSTLKWRMQAVTPLSYVDYFLHRLRGGAAPSRRAVLRSAELILCIARGTHCLDFRPSEIALAVVRHRGRRRARRGHRQGLHPPCT

SEQ ID NO: 74001 - DNA, 956 bp, Zea mays
  misc_feature: Ceres CLONE 1558339
  misc_feature: Encodes the peptide sequence at SEQ ID NO. 74002
  misc_feature (896)..(896): n is a, c, t, g, unknown, or other
ctccccgcggtggcggccgctctagaactagtggatcccccgggctgcaggaattcgtctcacccctagaaaaactcccctcccctccccatctcgctcttgcggagatcgaagagaagctgaggcctagcgccgcacccgccgccgcatcagccatcagccatgacgctggccgctcgcctcgtctcgcgctcccgtcagctacattcggttcaagctgcttttgcgaatggaggtgccactcaagttcgctcctttgccaaggatgcagctccagctgaccgccctcctgttagtggggatgatctcctgaagggcatattctttgaggtaaagaagaagttccagacagctcggggcgggggtgaaagggaaaagattactattgatccacatgacccagcggcagtttctcaatatgctcaagtcatgaagactgtaagggaaaaggcggatcttctttctgattctcaaaggattaaatatacccttgagacctttcaccaagggcatccctgatgcacggacttacttgagtactcttcaacagctcagaaaaaagagcggtcttatagatcaaattgggaaccgaaccctttgatgatggaagctcctcgagaagattggaaaacgaatattaacaaaccccccttttaagggaggggacaagaaaaaacatgggcccccccttatagggagaattttggaaaaataaaaaaccaaagccttgggaattccgaaagggaggtattccccccagaagcgagaagaagcttggaattgggaattgcccaaaggaaccttacatgaacccgaaaaaggaaaaggctcaaggcacggggaacccccgcccttaggggagcaagccccacgtgaggggaggcctgggcgcccgnaaacggggcacccaaacatcctcttagggccggcgcggcaaaccccgtgagggctgtacg

SEQ ID NO: 74002 - protein, 118 aa, Zea mays
  misc_feature: Ceres CLONE 1558339
MTLAARLVSRSRQLHSVQAAFANGGATQVRSFAKDAAPADRPPVSGDDLLKGIFFEVKKKFQTARGGGEREKITIDPHDPAAVSQYAQVMKTVREKADLLSDSQRIKYTLETFHQGHP

SEQ ID NO: 74003 - DNA, 960 bp, Zea mays
  misc_feature: Ceres CLONE 1558340
  misc_feature: Encodes the peptide sequence at SEQ ID NO. 74004
ctccccgcggtggcggccgctctagaactagtggatcccccgggctgcaggaattcgtctcacccctagaaaaaattccattccattccattccagtactcgctcatcttgctccgccttctgcttctgcgcatcctccaaggatcgtgatggccatggccacgcaagcctccgcggccacgcgccacctggtggccgccgccgcttccgcctgggcgccgtcggcgaagccgcggcagctaagctcacagctcgcgctgccgccgtcgtcctcccgcgcgccggccccgctccgcgcgaccgccggggaggcggtgaccgaggaggcgcccaaggggttcgtggccccgcagctggaccccagcacgccgtccccgatcttcggcggcagcacgggcgggctgctccgcaaggcgcaggtggaggagttctacgtcatcacgtgggtgtcccccaaggagcaggtgttcgagatgcccaccggcggcgccgccatcatgcgggaggggcccaacctcctgaagctagcgcgcaaggagcagtgcctcgcgctcggcaccaggctgcgctccaagtacaagatcacctaccagttctaccgcgtcttccccaatcgcgaagtgcagtacctccacccaaggacggcgtctacccggagtaagtcacccccggcaggaagggcgtcgggcaataactccgcagcatcgggaaaaaacgtcaccccatcgacgttaagttcacccgcaaaaaccccttcgatttaataacaataagccgcccgcccccccgggcggggataccaattcaaagagactcctctcctccttaataaaaaaataaaaaaaccggcggggtgggcccatataacggccgggtgggtttaaaattttggaaacgggggtgggaattgggtttaaaaattccccggaacccggggggccccgggggaactttttaatt

SEQ ID NO: 74004 - protein, 204 aa, Zea mays
  misc_feature: Ceres CLONE 1558340
  misc_feature (67)..(204): Pfam Name: PsaD Pfam Description: PsaD
MAMATQASAATRHLVAAAASAWAPSAKPRQLSSQLALPPSSSRAPAPLRATAGEAVTEEAPKGFVAPQLDPSTPSPIFGGSTGGLLRKAQVEEFYVITWVSPKEQVFEMPTGGAAIMREGPNLLKLARKEQCLALGTRLRSKYKITYQFYRVFPNREVQYLHPRTASTRSKSPPAGRASGNNSAASGKNVTPSTLSSPAKTPSI

SEQ ID NO: 74005 - DNA, 945 bp, Zea mays
  misc_feature: Ceres CLONE 1558341
  misc_feature: Encodes the peptide sequence at SEQ ID NO. 74006
  misc_feature (704)..(704): n is a, c, t, g, unknown, or other
  misc_feature (931)..(931): n is a, c, t, g, unknown, or other
acccgcggtggcggccgctctagaactagtggatcccccgggctgcaggaattcgtctcacccctagaaaaaatccacacctgagtcccctccgccgcctgccgcactctcccgcgacgccaccaccacacgttcacggtagcgagagcttatcgtcgtcggcggcgaagatggtgtcgctgaagctgcagaagcggctcgccgcgagcgtcctcaagtgtgggaaaggcaaagtctggcttgaccccaatgaagtcagcgagatctccatggctaactcccgccagaacatccggaagttggttaaggatgggtttatcatcaggaagcctcagaaggttcactctaggtcccgtgcaagaagggcacatgaggccaagcagaagggaaggcactctggatatggcaagcgcaggggtaccagggaggctaggctccccaccaagattctgtggatgaggaggatgcgtgttctgaggcgcctgctctgcaagtaccgtgaggccaagaagatcgacaagcacatgtatcatgacatgtacatgaaggtcaagggtaatatgtttaagaacaagagggtgcttatggagagtatccacaagtccaaggctgagaaggccagagagaagacactttctgatcagtttgaggccaagcgtgcaaagagcaaggcaagccgtgagaggaagattgctaggaagggnaggagagctggcccagggcccaagagaaccaacagcacctgtcgcagccccagctccatctactggggtggcaaaagaagcaaagaagtgagtatggaaacaagctgtagctttttggtactatataagcatgacttgggagcactgaagtatttgctggtatatagttcgtgtctcaaataatctgagtcttggatctctaccgttctggtggaatatgcatgccngtagattgtttatg

SEQ ID NO: 74006 - protein, 238 aa, Zea mays
  misc_feature: Ceres CLONE 1558341
  misc_feature (2)..(149): Pfam Name: Ribosomal_L19e Pfam Description: Ribosomal protein L19e
MVSLKLQKRLAASVLKCGKGKVWLDPNEVSEISMANSRQNIRKLVKDGFIIRKPQKVHSRSRARRAHEAKQKGRHSGYGKRRGTREARLPTKILWMRRMRVLRRLLCKYREAKKIDKHMYHDMYMKVKGNMFKNKRVLMESIHKSKAEKAREKTLSDQFEAKRAKSKASRERKIARKGRRAGPGPKRTNSTCRSPSSIYWGGKRSKEVSMETSCSFLVLYKHDLGALKYLLVYSSCLK

SEQ ID NO: 74007 - DNA, 978 bp, Zea mays
  misc_feature: Ceres CLONE 1558342
  misc_feature: Encodes the peptide sequence at SEQ ID NO. 74008
  misc_feature (1)..(1): n is a, c, t, g, unknown, or other
  misc_feature (788)..(788): n is a, c, t, g, unknown, or other
  misc_feature (806)..(806): n is a, c, t, g, unknown, or other
  misc_feature (813)..(813): n is a, c, t, g, unknown, or other
ntccccgcggtggcggccgctctagaactagtggatcccccgggctgcaggaattcgtctcacccctagaaaaaggccgccgcagaccgggagtagccgacgcgccgtcactgaatcctcagatcacggctagccgtaatcacgacactctgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaggccgagcgtgagagaggtatcacaattgatattgctctgtggaagttcgagaccaccaagtactactgcactgtcattgatgcccctggacaccgtgacttcatcaagaatatgattactggcacttcccaagctgactgcgctgttcttatcattgactccaccactggtggttttgaggctggtatctccaaggatggacagacccgtgagcatgctctccttgctttcacgcttggagtgaagcagatgatttgctgttgcaacaagatggatccaccacacccaagtactccaaggcccgttatgatgagatttgtgaaggaagtctcttctaccctgaagaagtttggatacaccctgacaagatccacttcgttcccatctctgggtttcgaaagtgacnacatgattgagaaggccnacaaccnttgacttgtacaagggcccacccctacttgaagctttggacctgatcatggagccgagaggccttcagaaaagccccctgctctcccccctaaggatggtgccaaaattggtggggtttggaacgttcccccgttgggccggtttggactggttctctaaacccc

SEQ ID NO: 74008 - protein, 207 aa, Zea mays
  misc_feature: Ceres CLONE 1558342
  misc_feature (5)..(207): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (200)..(200): Xaa is any aa, unknown, or other
  misc_feature (206)..(206): Xaa is any aa, unknown, or other
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDPPHPSTPRPVMMRFVKEVSSTLKKFGYTLTRSTSFPSLGFESDXMIEKAXN

SEQ ID NO: 74009 - DNA, 765 bp, Zea mays
  misc_feature: Ceres CLONE 1558344
  misc_feature: Encodes the peptide sequence at SEQ ID NO. 74010
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (621)..(621): n is a, c, t, g, unknown, or other
  misc_feature (622)..(622): n is a, c, t, g, unknown, or other
  misc_feature (657)..(657): n is a, c, t, g, unknown, or other
  misc_feature (659)..(659): n is a, c, t, g, unknown, or other
ctccccgcggtggcggccgctctagaactagtggatcccccgggctgcaggaattcgtctcacccctagaaaaaaacggcgccacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgccctggcgcgcgacgccgcggagcagctgcggctgccgcgggccggcacgtcggcgtcggcgtcggcgtcgtcgtcgccgtggcgcgggcgcgaggaccacctccacggccacggcaagacggccaaggtgatgcacctgctgctctggggacccaagtgaagcggcgagaggccaccgtaccgccggcgttgctcgttttgctctgcctgcaatccgccccgcacggactgtactgtactgtacctatacacctatatactacgacgtgcacatgtacgagtctacgacgtgctgctgtaccatactaatactagtgcgctgctgctcccttgccttcttgcttgcaagttgcaccagccactcccgctttttttttaaannnaaaaaaaaannattaaaaaaaaaaaattaaaaaataaaaaaaaaanantacctcttcttggaccttatcccctttgcgggaaaaaccttggcgcggcaaaaaaggggcgcgcttcccttcccggaaaaccggcggggggggccctgggggggct

SEQ ID NO: 74010 - protein, 73 aa, Zea mays; identical to SEQ ID NO: 58678
  misc_feature: Ceres CLONE 1558344

SEQ ID NO: 74011 - DNA, 771 bp, Zea mays
  misc_feature: Ceres CLONE 1558346
  misc_feature: Encodes the peptide sequence at SEQ ID NO. 74012
ctggagctccccgcggtggcggccgctctagaatagtggatcccccgggctgcaggaattcgtctcacccctagaaaaaaactggcaacagccgggccttttgagcgtgctctctctctctctctctcccctatccgtgctttgtgcctgtttggtgcgcgtccacctttcggggtcaccggcttctgctttcttgctacgccaccgcgcctctcgtctatttatggagtcccccgatccatgaagccggggcaggccgagagttgtcaaggacgacgtctgccggcagtgctcctgctcctcctcctccttcctggccgccgcgcgagcttgggttagttagtgtctcttcttcgcggagacctgtgagaggagccatcatcatggccgctgttgagactgttgtcctcaaggttgctatgtcatgcgagggctgcgccggggcggtcagaagagtgctctccaagatggaaggagttgaaaccttcgacatagacctcaaggagcagaaggtgacagtcaaaggcaatgtcaagcctgaggacgtcttccagacggtttccaagtcggggaagaggacctcgtactgggagggcgaagccacggccccggacgctgcggcggctccagaagccgaagcagctcccagcaccgcggcagaagcgcctcctgctgctgctccggcggcgccagagatcacccccagcaaagctgaacgcctgatcgtcacgctattattcactcacatgtgatgctgccgctgcgactccc

SEQ ID NO: 74012 - protein, 122 aa, Zea mays
  misc_feature: Ceres CLONE 1558346
  misc_feature (7)..(68): Pfam Name: HMA Pfam Description: Heavy-metal-associated domain
  misc_feature: SWISSPROT Homolog: EC 3.6.3.4 Copper-exporting ATPase
MAAVETVVLKVAMSCEGCAGAVRRVLSKMEGVETFDIDLKEQKVTVKGNVKPEDVFQTVSKSGKRTSYWEGEATAPDAAAAPEAEAAPSTAAEAPPAAAPAAPEITPSKAERLIVTLLFTHM

SEQ ID NO: 74013 - DNA, 841 bp, Zea mays
  misc_feature: Ceres CLONE 1558349
  misc_feature (704)..(704): n is a, c, t, g, unknown, or other
ctggagctccccgcggtggcggccgctctagaactagtggatcccccgggctgcaggaattcgtctcacccctagaaaaaataggaccctaagtcttctcactacttggtgatcacatatagtccagcgaaatgacaaggaaccgaatggcgaatatcatgatgggcctctcatcgtctggaggctctggggaggtaattaaggtgccgtcctccctcttgtaggatgcctgcggatcgatgaccaagacggcggcgaaggcaaagcccggggacagcatccgagtaaccgtgattacggtcccgacctcgtgctctatctgggtcctctgatcggggcgcccccgagctagatgagaggctacttccagggcgactacggctaggacaccgatctgctgatcgctgaccccagaacgttccccagaaccgggagctggaggtcatccactcccgctgggtcatgttgggcgcgttgagctgcatgttccgcgaggtgctcgctcccaaccttatcaagttcggcgaggcctgtgtagctcaaggccgggtcgcagatcttcatcgagggtgtgctggactacctctgtaaccagagcctgatgcaagagcacaggatcctcaacatctgagactgccacgtcgtgctcatgggagacgtcgaggggtaccgctgtccccgtggcccacgtaggagagacagtngacccgctcgtaccccagtggtagcttacgcccgtctcagactactcggacgaacctgaaggcgtacgatgaccgtcagggtaaacgtacctccagagcagactgcccacgtcatgatcagccattgtcctgagtct

SEQ ID NO: 74014 - DNA, 750 bp, Zea mays
  misc_feature: Ceres CLONE 1558350
  misc_feature: Translation starting site: 144
ctcaccgcggtggcggccgctctagaactagtggatcccccgggctgcaggaattcgtctcacccctagaaaaactcccgcagagccgccgacaactctctctaccgtccgataccccaagcaccagcgcggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaactgagatccctagtgaagaagtggcagacattaatcgaagcccatgttgatgtcaagacaaccgacaactacatggttgcgtttgttctgcatcggcttcacgaagaggcgcccaaaccaggtcaagagaacctgctatgcttaggcatcccagatccgtcagatccgcccgtaagatggttggagattatgatcaaccaggcttcctacatgtgacctgaaaagaccttgttttcgaagttcattcccagaagttattgggtaaggaagattggagaac

SEQ ID NO: 74015 - DNA, 777 bp, Zea mays
  misc_feature: Ceres CLONE 1558351
  misc_feature: Encodes the peptide sequence at SEQ ID NO. 74016
ctggagctccccgcggtggcggccgctctagaatagtggatcccccgggctgcaggaattcgtctcacccctagaaaaaacgccacgctctccaacgccacagcttgcgcccgcaatggcactcgtctccgcctcctcgtcctccaccaccgccgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttgatccctggggcctcggatctgacccagagagcctgcggtggaacgtgcaggcggagctggtgcactgccggtgggcgatgctcggcgcggcgggcatcttcatcccggagttcctgaccaagatcggcgtcctcaacacgcccttctggtacaccgccggcgagcagcagtacttcaccgacaccaccaccctcttgatcatcgagctcatcctcatcggctgggccgagggccgccgctgggctgacatcatcgagcccggtagcgtctacaccagacccatcatcgccagcaacaagctcaccggcacagacgtcaggtaccctgatgggcatctggattgacccgctcggctggggcagcagatcgtcggaggaaatcaaggagctggcgcaccaggagatcatgacgggagcctcgccttgct

SEQ ID NO: 74016 - protein, 192 aa, Zea mays
  misc_feature: Ceres CLONE 1558351
  misc_feature (63)..(193): Pfam Name: Chloroa_b-bind Pfam Description: Chlorophyll A-B binding protein
MALVSASSSSTTAVTALPRNGQRASSSFLGGKTLLRQAEAARPSFAVRAAADPNRPIWFPGSTPPPWLDGSLPGDFGFDPWGLGSDPESLRWNVQAELVHCRWAMLGAAGIFIPEFLTKIGVLNTPFWYTAGEQQYFTDTTTLLIIELILIGWAEGRRWADIIEPGSVYTRPIIASNKLTGTDVRYPDGHLD

SEQ ID NO: 74017 - DNA, 812 bp, Zea mays
  misc_feature: Ceres CLONE 1558353
tggagctcaccgcggtggcggccgctctagaatagtggatcccccgggctgcaggaattcgtctcacccctagaaaaaaaccgccgagccagaagcacccggagcagcgcacagcaacagagcacacgccgcacaccgccgcctccgcagcagcagcaatggcgcgcgccggcgctctctgcctggtgctgctctgcctcgtggccgcgcactcagccgcggcgcagaagtccacgacagccccggccgccgcgccggccgccgccaccaccccgccggcgaccccgaccaagaagacgcccgcgcccgccgccgcgccgcccaccaccccggccaccctggccccggccgccgcgccgcccaccacgccggccacccccgcgcccgtcgctgcggcgcccactaccccggccaccctggcacccgccgcggcgccgcccaagtccgcccccaaggcgtcccctcccgccccgtcgcccaagaccaaggccaccccgccggtggccgagcttgcgcccgccgcctcagctcccgccccagcccccgcctccccgtccaacaagcccgctgaggtcacccgagccgcgcccgtcaagaaagaagaggaagccctcctcgtcgtccaaaaacaaaaagaagaagtccaaggccccggcttccagccccggttgccgaaacaacccaccaagcaccaagcgctcaaagggtaaaggacctttccggccaaggaaaacggaaccacaccgggcccgggtcgggggaatggaggggcccccccaacacccccggggtgctgggaaaaagaccgtggt

SEQ ID NO: 74018 - DNA, 747 bp, Zea mays
  misc_feature: Ceres CLONE 1558356
  misc_feature: Encodes the peptide sequence at SEQ ID NO. 74019
ctgaagctcaccgcggtggcggccgctctagaactagtggatcccccgggctgcaggaattcgtctcacccctagaaaacgtctgcaccgttccgagttttctccccaccctcctccgcggctgccagtcccgccggagcgcagcgcgtgctgctctacggacgccgcgcgccgttcgcgggagcgctcctgtttttcagcatcggcgccgtcaacgctgcggtcgcgttcaggacagggtgcgccatctcccaccgacgtccccccttcctcggggcaagaggtctcagttcaactagaatggagtcagcttcgaccacagtgccatccattgtcgtgtatgtgacagttccaaacagggaagcagggaagaagctgtcacagagcatcatcagcgagaagcttgctgcttgtgtcaatatagtacctggcattgaatccgtgtactggtggggagggaaggtacaatctgatgctgaagaattactcatcatcaagaccagggaatcacttctggatgccttgactgcacatgtcaaagccaatcatggaatatgatgttccctgaagttattgctctgcccataaactggtggtaacaccaagggatttgggaatggatcaaagaacagcaccccggggacaagtggatctcctttttttttttttttttggaggctcgacataaatgcggaatgatcgaagtgccccatgggctcccttaagctctttccagggggccttgca

SEQ ID NO: 74019 - protein, 85 aa, Zea mays
  misc_feature: Ceres CLONE 1558356
  misc_feature (10)..(86): Pfam Name: CutA1 Pfam Description: CutA1 divalent ion tolerance protein
MESASTTVPSIVVYVTVPNREAGKKLSQSIISEKLAACVNIVPGIESVYWWGGKVQSDAEELLIIKTRESLLDALTAHVKANHGI

SEQ ID NO: 74020 - DNA, 747 bp, Zea mays
  misc_feature: Ceres CLONE 1558359
  misc_feature: Encodes the peptide sequence at SEQ ID NO. 74021
ggagctcaccgcggtggcggccgctctagactagtggatcccccgggctgcaggaattcgtctcacccctagaaaaaagcatctaatcaatcaagacagccccgtgctagctcacccgccggggctcgccacgatgagaggcctcctcgcgtgcgccaccctcgcccgccgcgccgccgcctcctccgcgcccgcgcgcgtccgccacctggcgggcgccgcggaggcggcggaggccgagctcaagaggacggcgctctacgacttccacgtcgcccacggcggcaagatggtgccgttcgccggctggagcatgcccatccagtacagggactccatcatggactccaccgtcaactgccgcgccaacggcagcctcttcgacgtcgcccacatgtgcggcctcagcctcaagggccgcggggccatccccttcctcgagtccctcgtcgtcgccgacgtcgccgcgctcagggacggcaccggcaccctcaccgtcttcaccaacgagcagggcggcgccatcgacgactccgtcatcgccaatgtcaccgaccaccacatcttacctcgtcgtcaacgccggatgcagggacaaggacctcgcccacatcgaggcgcacatgggagggtttcaacaagaaggggcgggggacgtcaaggtggcacattccacgaccaaccgattcgcggctcgcattggcaagggcctcctttgcttgaacctactctggcagttgctgacaa

SEQ ID NO: 74021 - protein, 204 aa, Zea mays
  misc_feature: Ceres CLONE 1558359
  misc_feature (82)..(203): Pfam Name: GCV_T Pfam Description: Aminomethyltransferase folate-binding domain
  misc_feature: SWISSPROT Homolog: EC 2.1.2.10 Aminomethyltransferase
MRGLLACATLARRAAASSAPARVRHLAGAAEAAEAELKRTALYDFHVAHGGKMVPFAGWSMPIQYRDSIMDSTVNCRANGSLFDVAHMCGLSLKGRGAIPFLESLVVADVAALRDGTGTLTVFTNEQGGAIDDSVIANVTDHHILPRRQRRMQGQGPRPHRGAHGRVSTRRGGGRQGGTFHDQPIRGSHWQGPPLLEPTLAVAD

SEQ ID NO: 74022 - DNA, 734 bp, Zea mays
  misc_feature: Ceres CLONE 1558360
  misc_feature: Encodes the peptide sequence at SEQ ID NO. 74023
  misc_feature (160)..(160): n is a, c, t, g, unknown, or other
ctcaccgcggtggcggccgctctagaatagtggatcccccgggctgcaggaattcgtctcacccctagaaaaactctcctctccctccctccctccttccccgccgccgtctaccagtacagctcgagcgaacgacgtctcgacagtcccggtgccgctngagaacttgccgcgggagggagagcagcagcggcagcatcagacatgtcgtcggggcggtacatggcctactcgccctcgccatggccgaacaggagaagtaccttgccgaactgctcgcggagaggcagaagcttggcccgtgcgtcccagtgatcccgcatagtgtacgcttgctgaatcaagaaattttacgtgtttccacactattggagaacgcatccctttttaatcaaagtggccttgaacatggtagtcccactacaacaggaggattatattcaaatggagcagctactgacatgaatgtgtggacatcagcatttcaaccagaaaagtcaccagcttatagctgggcttggaggattccaggggcagctccctctgggacttattgtcaaagaaaaccatggaaggtcgatttcccaggtagaacaaatattccaacattccattttcgtttgggccgcatcccctgggtcccaaaagggaaattcccttgaaaccggggggggaggcaaaataccgagaccgggccgggggggcaaaataaaaaaggggccctggggcaacca

SEQ ID NO: 74023 - protein, 139 aa, Zea mays
  misc_feature: Ceres CLONE 1558360
MAEQEKYLAELLAERQKLGPCVPVIPHSVRLLNQEILRVSTLLENASLFNQSGLEHGSPTTTGGLYSNGAATDMNVWTSAFQPEKSPAYSWAWRIPGAAPSGTYCQRKPWKVDFPGRTNIPTFHFRLGRIPWVPKGKFP

SEQ ID NO: 74024 - DNA, 800 bp, Zea mays
  misc_feature: Ceres CLONE 1558361
  misc_feature: Encodes the peptide sequence at SEQ ID NO. 74025
  misc_feature (677)..(677): n is a, c, t, g, unknown, or other
  misc_feature (779)..(779): n is a, c, t, g, unknown, or other
ctccccgcggtggcggccgctctagaactagtggatcccccgggctgcaggaattcgtctcacccctagaaaaactttccctttctggccgcattccctcgtcctccggcagccgtcgccagcttccgatggtccggaaggagacggccatgaggctgcccccgcagcaccagggcctggaggtcaagatccccagcttcttccgctgccccatctcgctggacgtcatgcgctcgcccgttagcctctgcaccggcgtcacctacgaccgcgcctccatccagcagtggctcgactccggcaacaccacgtgcccggccaccatgctcccgctcccctccaccgacctcgtccccaacctcactctccgcagcctcatcgcccactgggccgcctccgccgcctcctgttcccccaccgccgccggcggcgccggagtcgccgactcctcttcggcacgtacttcttctcccgcgagcctcgtccgccaggtggcttcgtccggcgtggacccctcgccggccctccgcgagctggcagcctatctctccgacgacgacgtcgacgacttcgaaaagaacgcgcttgtgggcgccggccgcgccgccgagaccgtcgcgtcagttcttcagagaagagcagaggataccggcgtcgtaagcgtggaagcggccacnagagtgctagccttgatcttggccttggacggcatcgacgactctaacaagaagcggtggccactgggcctccgcgcggacgcggcgtccttcgacgcgtcnctggcgcgcgtgatgcacggc

SEQ ID NO: 74025 - protein, 224 aa, Zea mays
  misc_feature: Ceres CLONE 1558361
  misc_feature (20)..(94): Pfam Name: U-box Pfam Description: U-box domain
MVRKETAMRLPPQHQGLEVKIPSFFRCPISLDVMRSPVSLCTGVTYDRASIQQWLDSGNTTCPATMLPLPSTDLVPNLTLRSLIAHWAASAASCSPTAAGGAGVADSSSARTSSPASLVRQVASSGVDPSPALRELAAYLSDDDVDDFEKNALVGAGRAAETVASVLQRRAEDTGVVSVEAATRVLALILALDGIDDSNKKRWPLGLRADAASFDASLARVMHG

SEQ ID NO: 74026 - DNA, 795 bp, Zea mays
  misc_feature: Ceres CLONE 1558363
  misc_feature: Encodes the peptide sequence at SEQ ID NO. 74027
  misc_feature (594)..(594): n is a, c, t, g, unknown, or other
  misc_feature (683)..(683): n is a, c, t, g, unknown, or other
  misc_feature (724)..(724): n is a, c, t, g, unknown, or other
ctggagctcaccgcggtggcggccgctctagaactagtggatcccccgggctgcaggaattcgtctcacccctagaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggcagctacggtggcggcggcggctaccgtgggtggtggcggcggctacngcggtgggcaccgtggcggcggctacggcaactccgacgggaactggaggaactgaggcgtggggcccgcgcgggcaagttatcctggntcgctaccgtgttgttttaccctagtcaggagggtttatcntcgttcgtctcatggtttgttgttggcccattctgtgtttttgattgcaaagccgcctttgtgttcagttg

SEQ ID NO: 74027 - protein, 205 aa, Zea mays
  misc_feature: Ceres CLONE 1558363
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (139)..(139): Xaa is any aa, unknown, or other
  misc_feature (169)..(169): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGSYGGGGGYRGWWRRLXRWAPWRRLRQLRRELEELRRGARAGKLSWXATVLFYPSQEGLSSFVSWFVVGPFCVFDCKAAFVFS

SEQ ID NO: 74028 - DNA, 747 bp, Zea mays
  misc_feature: Ceres CLONE 1558365
  misc_feature: Encodes the peptide sequence at SEQ ID NO. 74029
  misc_feature (569)..(569): n is a, c, t, g, unknown, or other
ctggagctcaccgcggtggcggccgctctagaactagtggatcccccgggctgcaggaattcgtctcacccctagaaaatcacaaacgccttgtagttctgaaacgcagccaagaaatagaatgcagtgtatgtttggatcgtgtgctttcaaagcctactgctgctgaaaggaagtttggactcttatccgaatgtgatcatcctttctgtattgaatgcattagaaattggcgtagcaattctcctgcatctggtatggatgtgaactcagcattgagggcttgtccaatatgtcggaaactttcatactatgtcattccaagtgttctttggtacttctcaaaggaagagaaagaggagatcactgaaagctacaaatccaagctcaagtctattgattgcaagtacttcgactttgggactggctcatgccctttcggaacaagttgtttctataagcatgcctacagagatggccgcttggaagaggtaatactgcggcatcttgatgctgatgatggaagtacagtaattgcaaaaagtatcaggttatcagacttccttggntaggatgggatctttaggggaccagcaagctgtattgatatcaaaatgcatttctggggatatcctttatcccaaccaatttattttacaatatttcttgaaagatatcaattttaaccctttgaggccattccttccggaaaaagtaacaagcttttttttcctcccatttttaaaa

SEQ ID NO: 74029 - protein, 189 aa, Zea mays
  misc_feature: Ceres CLONE 1558365
  misc_feature (41)..(98): Pfam Name: zf-C3HC4 Pfam Description: Zinc finger, C3HC4 type (RING finger)
GAHRGGGRSRTSGSPGLQEFVSPLENHKRLVVLKRSQEIECSVCLDRVLSKPTAAERKFGLLSECDHPFCIECIRNWRSNSPASGMDVNSALRACPICRKLSYYVIPSVLWYFSKEEKEEITESYKSKLKSIDCKYFDFGTGSCPFGTSCFYKHAYRDGRLEEVILRHLDADDGSTVIAKSIRLSDFLG

SEQ ID NO: 74030 - DNA, 789 bp, Zea mays
  misc_feature: Ceres CLONE 1558366
  misc_feature: Translation starting site: 164
  misc_feature (740)..(740): n is a, c, t, g, unknown, or other
ggagctccccgcggtggcggccgctctagaactagtggatcccccgggctgcaggaattcgtctcacccctagaaaaaagggtttcgtcgcttccagccgccgccgcgtccgcctcgccaagcgcagcagccgccgcagcacatcgctctctcgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcgggacgttactccaagaagcggttccgcaaggcgcagtgcccgatcgtcgagcgcctcacaaactcgctcatgatgcacgggcgcaacaacggcaagaaggtcatggctgtccgcatcatcaagcataccctggagatcatccacctgctcaccgatgccaaccccatccaggtcgtcgtcgacgcgatcatcaacagtggaccccgtgaggatgccacccgtattggttccgctggtgtttgtgaggaaagcaggccgtggatatctcacccctggaggagggtgaaaccaggcatctacctcctcaccactggtgcccagggagagtgctttccggaacatcaaaaccattggccgagtgccttgcagatgagctgatcaacgctgccaaaggctcatccaacagttacgccatcaagaagaaaggacgagnattgagcgtggtgcccaaggccaacccgttgaactggagcttggtatcc

SEQ ID NO: 74031 - DNA, 793 bp, Zea mays
  misc_feature: Ceres CLONE 1558367
  misc_feature: Translation starting site: 413
ctggagctccccgcggtggcggccgctctagaactagtggatcccccgggctgcaggaattcgtctcacccctagaaaaaacctagctcaccgctcactcaagcacgctgcgaaacacatacacacacagatcgaagcggaggatgaaggtggaggtggtggagacgacgctggtgccgccgagcgaggcgacgccgcggcacgcgctgtggctgtccaacctggacctggcggtgcccaagacccacacgccgctcgtctactactacccgaggcccgccgcgccggtgccggggaggagggagagggagaatggaaggacaagggtcggtcccccacggcgcactgctgcatcatgcaccgcctcacgaactcgcgcatgatgcacgggcgcaacaacggctagaaggtcatggctgtccgcatcatcaagcttaccctggagatcatccacctgctctccgatgccaaccgcatccaggtcgtcgtcgacgcgatcatcaacagtggaccccgtgaggatgccacccgtatcggttccgctggtgttgcgaggaggcaggccgtgcatatctgacccctgaggacggtgaaccatgtcatctacctcctcaccactggtgcccggggagagtgctttcccgaacatcataaccgttgccgagtggcttgcatatgagctgatctacactgcccaggcctccctccaacggcttccgccttctagaagataggacaaaattggagcttggtgcccaaagccaaccgctggaaactgagccttgtatccctg

SEQ ID NO: 74032 - DNA, 792 bp, Zea mays
  misc_feature: Ceres CLONE 1558368
  misc_feature: Translation starting site: 396
  misc_feature: SWISSPROT Homolog: EC 3.3.2.10 Soluble epoxide hydrolase
  misc_feature (248)..(248): n is a, c, t, g, unknown, or other
  misc_feature (576)..(576): n is a, c, t, g, unknown, or other
  misc_feature (752)..(752): n is a, c, t, g, unknown, or other
ctcaccgcggtggcggccgctctagaactagtggatcccccgggctgcaggaattcgtctcacccctagaaaaagcccatccgttcggctgcctcgcacgccccaaaatcccctgctgcgcctccaaagccagcagccggcaggtcccgctacaaaagcaggcggcatgcgcgtgcgcgacaggtagcagctgcctgagccagtgcgcctcggtgagcagacaggacgacataggatagagatggcgngccgcggtggagggggtgcggcaccgaacgctggaggcgaatggagtgcgcctgcacgtggcggaggctgggcccgaggaaggcagcgccccagtggtgctgctccttcacggcttcccggacctctggtacggctggcgccaccagatgtccgccctggcggcgcgcggctaccgcgccgtggccccccggacctccgcggctacggcgactccgactccccgcctgatgcgtccagctacaccaccttccatgtcgtcggggacctcgtcgcgctcatctccgacctcggccagcggcaggtggttcgtggtggggcacgactggngagccatcgtggcgtggcagctttgtctgcttcggccggaactggtgcgggcgctcgtgaaccttagccgtcgtgtaccacccgcggcgtgcgggagatgaagcccgctccagggccatcagagctgccctgcggcgaagaaccactacatggtgccgcttcccaggaattttggntgttgcctggaagctgaaatttgctctaaatgacattccc

SEQ ID NO: 74033 - DNA, 815 bp, Zea mays
  misc_feature: Ceres CLONE 1558370
  misc_feature: Translation starting site: 177
  misc_feature (507)..(507): n is a, c, t, g, unknown, or other
  misc_feature (510)..(510): n is a, c, t, g, unknown, or other
aagctggagctccccgcggtggcggccgctctagaactagtggatcccccgggctgcaggaattcgtctcacccctagaggctcgttaaattatctccgacccgacgcgacccgacacacaaatatctccaccccctgttccggcgacgactacgatttgggaggaaggtaagcgaatgggtgaggaggcggtcgacgactacgagctccacatggtgtgctacggcggcggcggcgaggacgagcgcgtgatggagtgggagtcaggtctcccgggcgccgacgagctgaccccgctgtcgcagccgctggtgccggcgggtctggcagcggcgttccgcatcccgccggaggccgggcggacgctgctggacgtgcaccgcgcgtcggctgccacggtgtcccggctgcgtcgcgcgccgcccgccgtcgtcgtcgggcagcggagggagctcctccttcgcgcccttccatccggcggcgaggggggacgaaggggcggactcntcngcggcgggcggcggggcggccgccaccacgaacgcaacaataacatgagcagcagcagcaagcggccccgggctggtgtggacgccgcagctgcacaagcggttccgtgaacgtggtggcccaccttggggatgaagaacgcggtgcccagaccatcatgcacctgatgaacctgaaaggctgaccccggaaaacccgggcccgcaccccgcaaaattccgccccctccttaaagggaatgcagggccccccccaaaaaaggccccttcccctccaaccatatttttgaatcccccccggtggcc

SEQ ID NO: 74034 - DNA, 793 bp, Zea mays
  misc_feature: Ceres CLONE 1558371
  misc_feature: Encodes the peptide sequence at SEQ ID NO. 74035
ctccccgcggtggcggccgctctagaactagtggatcccccgggctgcaggaattcgtctcacccctagaggctcgttaaattatctccgagccgacgcgacccgacacactaatatctccaccccctgttccggcgacgactacgatttgggaggaaggtaagcgaatgggtgaggaggcggtcgacgactacgagctccacatggtgtgctacggcggcggcggcgaggactagcgcgtgatggagtgggagtcaggtctcccgggcgccgacgagctgaccccgctgtcgcagccgctggtgccggcgggtctggcatcggcgttccgcatcccgccggaggccgggcggacgctgctggacgtgcaccgcgcgtcggctgccacggtgtcccggctgcgtcgcgcgccgccgccgtcgtcatcgggcagctgatggagctcctccttcgcgcccttccatccggcggcgaggggggacgaaagggcggactcgtcggcggcgggcgacggtgcggctgccacgacgaacggcaacgataacatgagcagcagcagcatgcggcccctgctggtgtggacgccgcagctgcacaagcggttcgtggacgtggtggcgcacctggggatcgatgacgcggtgcctacgaccatcatgcagctgatgaacgtggaagggctgacacgggagaacgtggactgccacctgcagaagtacggcctctgcatcaagcggatgcagggcctctccgaacgagagcccgtcgacgttcagactcatgcttcgaatcc

SEQ ID NO: 74035 - protein, 82 aa, Zea mays
  misc_feature: Ceres CLONE 1558371
  misc_feature (9)..(59): Pfam Name: Myb_DNA-binding Pfam Description: Myb-like DNA-binding domain
  misc_feature: The sequence is a functional homolog of SEQ ID NO 1994 in the 11/479,226 US patent application
  misc_feature: The sequence is a functional homolog of SEQ ID NO 1988 in the 11/479,226 US patent application
  misc_feature: The sequence is a functional homolog of SEQ ID NO 1986 in the 11/479,226 US patent application
  misc_feature: The sequence is a functional homolog of SEQ ID NO 1984 in the 11/479,226 US patent application
  misc_feature: The sequence is a functional homolog of SEQ ID NO 512 in the 10/666,642 US patent application
  misc_feature: The sequence is a functional homolog of SEQ ID NO 1450 in the 10/666,642 US patent application
  misc_feature: The sequence is a functional homolog of SEQ ID NO 1796 in the 11/479,226 US patent application
  misc_feature: The sequence is a functional homolog of SEQ ID NO 2616 in the 10/374,780 US patent application
  misc_feature: The sequence is a functional homolog of SEQ ID NO 648 in the 10/225,066 US patent application
  misc_feature: The sequence is a functional homolog of SEQ ID NO 888 in the 10/412,699 US patent application
  misc_feature: The sequence is a functional homolog of SEQ ID NO 1992 in the 11/479,226 US patent application
  misc_feature: The sequence is a functional homolog of SEQ ID NO 1232 in the 10/666,642 US patent application
  misc_feature: The sequence is a functional homolog of SEQ ID NO 1089 in the 11/479,226 US patent application
  misc_feature: The sequence is a functional homolog of SEQ ID NO 1990 in the 11/479,226 US patent application
  misc_feature: The sequence is a functional homolog of SEQ ID NO 935 in the 10/666,642 US patent application
MSSSSMRPLLVWTPQLHKRFVDVVAHLGIDDAVPTTIMQLMNVEGLTRENVDCHLQKYGLCIKRMQGLSEREPVDVQTHASN

SEQ ID NO: 74036 - DNA, 886 bp, Zea mays
  misc_feature: Ceres CLONE 1558374
  misc_feature: Encodes the peptide sequence at SEQ ID NO. 74037
  misc_feature (382)..(382): n is a, c, t, g, unknown, or other
  misc_feature (720)..(720): n is a, c, t, g, unknown, or other
  misc_feature (886)..(886): n is a, c, t, g, unknown, or other
ctggagctcaccgcggtggcggccgctctagaactagtggatcccccgggctgcaggaattcgtctcacccctagaaaaacactcgcttgagcatcgtgtgctcttctcttcctcttccagttggtattctttatctgaaagactgaaacatagtacagaggaggagaggagagcgagagctaagaagatgaccggcaaggtcctgcttgtggccgtcctcttggtgggcgtggcctctcgatgctcgggcagtaggggcctgcagggcgatcacgttgctgaacagaagttcggtggcggtggctatggaggtggcggtgggtacggaggctacggtggcggtggaggaggaggtgccggtggggtaattgcaacccgganaaccctgctgcgggaacgtgcagggtggagctggtgcaactgccgggtgggcggatactccggcacaggcgtgccttcgttcatcaacggatttcgcgggacaagatcgggcgtcccctcatacgcacctttcggatacccccgcccgggcgagctgggttgtattttaacgatatccgaccagcctttcttgagtgatccgaagcttcatccttcaatcgggttgggaccaaaggggccccacgccgggggcttgagaatactccagtgcccgggaaggggtttaaccaccgtgtaccctctttatttcccccaataaaaaaaagtttaaacggggnagccgaaacgtccggggtttcccgtgaggggggcaccccggggtatgaacaccgccctctccggccgtgggggcacatccctgactcctctccctggtggaaaaaaacaataggggtgactttgtcccaccccatggtgaggaatttatataaaaccgtttatccn

SEQ ID NO: 74037 - protein, 170 aa, Zea mays
  misc_feature: Ceres CLONE 1558374
  misc_feature (65)..(65): Xaa is any aa, unknown, or other
MTGKVLLVAVLLVGVASRCSGSRGLQGDHVAEQKFGGGGYGGGGGYGGYGGGGGGGAGGVIATRXTLLRERAGWSWCNCRVGGYSGTGVPSFINGFRGTRSGVPSYAPFGYPRPGELGCILTISDQPFLSDPKLHPSIGLGPKGPHAGGLRILQCPGRGLTTVYPLYFPQ

SEQ ID NO: 74038 - DNA, 784 bp, Zea mays
  misc_feature: Ceres CLONE 1558375
  misc_feature: Encodes the peptide sequence at SEQ ID NO. 74039
  misc_feature (698)..(698): n is a, c, t, g, unknown, or other
  misc_feature (728)..(728): n is a, c, t, g, unknown, or other
ctggagctccccgcggtggcggccgctctagaactagtggatcccccgggctgcaggaattcgtctcacccctagaaaaaggagccgcggagggaaccgagtggccccggcgacgcgaggccgaggcgagctaatctgacggcggcagtgacgactccaacgaccaggcgcggaggctgcactgctccagcgaaggcaccatgtcattcatgtctccattcccggggatggatctaagtaaaatggatcccgggactctgaccctccttggggcagctggttgtgtaatgctgactatgcatttcactgtgcaattggtgtcacaacatctcttctattggaaaaaccccaaggagcagaaagccatacttattattgtgctgatggctccactatacgctatctcttccttcgtgggtcttcttgatatccagggtagcaagacatttttcacattcttagatgctgttaaagaatgctatgaggcactggtgattgctaagtttatggcattgatgtacagctacttgaatatatctatcagcaagaacatagtccctgatgaaacaaaggggagggtgcttcatcattccttccctgtttctcttttcctgcccccgcatgtccgattggagcacaagacattgaagcttctgaagtattggacctgggcattttgtattgttaggcccagtatngtccattctgattattgcactccagcttcntggggctgtaccccagctgggtcagctgggacgtttagtattataccggaactttt

SEQ ID NO: 74039 - protein, 194 aa, Zea mays
  misc_feature: Ceres CLONE 1558375
  misc_feature (18)..(194): Pfam Name: DUF300 Pfam Description: Domain of unknown function
  misc_feature (166)..(166): Xaa is any aa, unknown, or other
MSFMSPFPGMDLSKMDPGTLTLLGAAGCVMLTMHFTVQLVSQHLFYWKNPKEQKAILIIVLMAPLYAISSFVGLLDIQGSKTFFTFLDAVKECYEALVIAKFMALMYSYLNISISKNIVPDETKGRVLHHSFPVSLFLPPHVRLEHKTLKLLKYWTWAFCIVRPSXVHSDYCTPASWGCTPAGSAGTFSIIPEL

SEQ ID NO: 74040 - DNA, 830 bp, Zea mays
  misc_feature: Ceres CLONE 1558376
  misc_feature: Translation starting site: 165
  misc_feature: SWISSPROT Homolog: EC 3.4.22.16 Cathepsin H
ctggagctccccgcggtggcggccgctctagaactagtggatcccccgggctgcaggaattcgtctcacccctagaaaaagctcgtgccagcgcccagcagggcattctgctcgccttactccctcacagaacccagtaaaatattgccagtcccgccgtcgagatggccccacgccgcctgctcgtcctcgccgtcctcgccctcgcggccaccgccgccgcggccaactccggcttcgcggactccaagccgatccgccctgtcaccgaccgcgcggcctccgcgctcgagtccaaggtcttcgccgcgctcggccgcacccgcgacgcgcttcgcttcgcacgcttcggcgtcaggtacggcaagagctaccagagcgcggcggaggtccataagcggttcaagatcttctccgagagcctccagctggtccgctccaccaaccgcaaaggccgctcctaccgcctcggcatcaaccgcttcgcggacatgagctgggaggagttcagtgcgacccggctcggcgcagcccagaactgctccgccacgcttgacggcaaccaccggatgcgcgccgacgccgttgcgctgccggagactaaagactggacggaagatggggattgtcgacccctgtgaaaataccagggcccactgtggatcatgctggacctttcgccactactgggggcacttggaggctgcattatacccaggggtactgggcaagcccaatctctcctctcttgaacaagcaccttggttggaactggggattttgcaatccaaaaaagtttccggaatgcaacccgaaggcctttccaatcc

SEQ ID NO: 74041 - DNA, 559 bp, Zea mays
  misc_feature: Ceres CLONE 1558377
  misc_feature (184)..(184): n is a, c, t, g, unknown, or other
tggagctccccgcggtggcggccgctctagaactagtggatcccccgggctgcaggaattcgtctcacccctagaaaaatcgaccggccggccactcgctgtccctctacctcgctagaaagttccaaacgactacggcatcctctgactccccccgctctcgggtccgcatttccattgtgcntttctccagttgcatagcagcctcgcgtctcttctcgcatctagccctccgcctcagctcacaccacgaccccgagggaaaaggggacatggggagtagggggaccaaatgggcgaagctccccagggctgcgaaaaacccccgccggcccctgaaacccgggccttggggggaaaagggaaaagggccttctaaaaaaggtttttgggggggggcttaaagggccaaattttggccggggccccccaaaggaaaacccccaagggggggcgccccccttttccccccccctttgtttttgcgacaaaaaaaaatttttttttgggggggtttttttcaaaaaaagagaccccccccccatttttttttttgtgg

SEQ ID NO: 74042 - DNA, 805 bp, Zea mays
  misc_feature: Ceres CLONE 1558378
  misc_feature: Encodes the peptide sequence at SEQ ID NO. 74043
ctggagctccccgcggtggcggccgctctagaactagtggatcccccgggctgcaggaattcgtctcacccctagaaaaaaccatcagccatccccttttgctgcaaatctttctctgaattgtgggtctccgacaatggcggcgctagctccatccaagattctgggcacccagctcaacttcgcgggctcctcccgctacgacaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccagagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaagcctgcaacaagttcggcgctaactgtggccctgaggctgtctggttcaagaccggcgcgctgctcctggacagaaacaccctcaaatacttcggcaacagcatcccaatcaacctggtggtggccgtgatcgcggaggtcatcctcgtcggcggcgccgagtactaccggatcacagcagactggacctagaggacagctgctccccggtgggccattcgacctgctgggcctggccagcgaccccggacatgccgccatcct

SEQ ID NO: 74043 - protein, 198 aa, Zea mays
  misc_feature: Ceres CLONE 1558378
  misc_feature (83)..(199): Pfam Name: Chloroa_b-bind Pfam Description: Chlorophyll A-B binding protein
MAALAPSKILGTQLNFAGSSRYDTAAPTAGAQKIVSLFSKKPAQKPKPAAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLDRNTLKYFGNSIPINLVVAVIAEVILVGGAEYYRITADWT

SEQ ID NO: 74044 - DNA, 804 bp, Zea mays
  misc_feature: Ceres CLONE 1558380
  misc_feature: Encodes the peptide sequence at SEQ ID NO. 74045
ctccccgcggtggcggccgctctagaactagtggatcccccgggctgcaggaattcgtctcacccctagaaaaagttcccacacccctcaccgcgtccgcctcccctaccatctagggtttctagggttttcgaggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttacggcggcggcggcccccgcggctaccggggggaggaagcgaccgtggctacggcggcggcgaccgtggttacgggtggaggtggcgaccgcggctacggcggcacccgtggcttaccgggggaggcgggcggctatggcggtggggtaccggtggaggccgccggtggaaagccggcccccgcttgctttccagttggcggcgaggaagggccaccatgggcaagggactgctcccaggcggggcggggtttccggagaaggggggagaagggggtggtcgtaggcccccccgaaaaccaaaattttttataaaatttgcggggcacaaggagagggccaatcatttctctcccggcc

SEQ ID NO: 74045 - protein, 204 aa, Zea mays
  misc_feature: Ceres CLONE 1558380
  misc_feature (5)..(72): Pfam Name: CSD Pfam Description: 'Cold-shock' DNA-binding domain
MASDRVLGTVKWFNGTKGFGFITPDDGSEDLFVHQSSIKSDGYRSLNDGDAVEYTVGSGNDGRAKALDVTAPGGGPLAGGERPDGGNGGGRGGYGGGDRGYGGGGPRGYRGEEATVATAAATVVTGGGGDRGYGGTRGLPGEAGGYGGGVPVEAAGGKPAPACFPVGGEEGPPWARDCSQAGRGFRRRGEKGVVVGPPENQNFL

SEQ ID NO: 74046 - DNA, 759 bp, Zea mays
  misc_feature: Ceres CLONE 1558381
  misc_feature: Encodes the peptide sequence at SEQ ID NO. 74047
aagctggagctccccgcggtggcggccgctctagaactagtggatcccccgggctgcaggaattcgtctcacccctagaaaaaaggccacttacctgcagtcaccactcccaagccagtacccacagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctcctccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggcgtcagcggcctcaacgccggcaacgccgccagcatcccctccaagtgcggcgtcagcatcccctacaccatcagcacctccaccgactgctccaggggtggactaaaaccctagacacgcgcgacgaccgccgccctgatcgatcgaccaacccattccgccgtcgccgccggccgggatcatcggagcgtcctcactgatgatttctatcaaacctacccgtgaatgatccgatgggctacttgtctacctgctattgtactacctaaataaaaacctcccccccccctggggtggtacaaccttaacgccttgcaatgtggca

SEQ ID NO: 74047 - protein, 124 aa, Zea mays
  misc_feature: Ceres CLONE 1558381
  misc_feature (32)..(117): Pfam Name: Tryp_alpha_amyl Pfam Description: Protease inhibitor/seed storage/LTP family
MARTQSAVAVAVVAAVLLLAAAATTSEAAITCGQVSSSIAPCLSYARGTGSGPSASCCSGVRNLKSAASTAADRRAACNCLKNAARGVSGLNAGNAASIPSKCGVSIPYTISTSTDCSRGGLKP

SEQ ID NO: 74048 - DNA, 834 bp, Zea mays
  misc_feature: Ceres CLONE 1558383
  misc_feature: Encodes the peptide sequence at SEQ ID NO. 74049
ctggagctccccgcggtggcggccgctctagaactagtggatcccccgggctgcaggaattcgtctcacccctagaaaaaaagtgctatccccgaccattcgtcaccagccaggtcccggaaccttatcaccaaatcctcaagtcatggaggccgcgctcttctccacctcgctctcgccccgcttcctcgccctatcctccccgaagccagccgcgcccgcgggctcggccttcctccccttcacgctgccgctgcgctctgtgtcggcgccggcgccagcgaggcgggtcttcgagcccgttgcacgtcgcggtgtcgtcagagtacgggaccgagggcgcggagcaccaggacggggagttctccgaggacatcaagctgttcggcggaaacctgccgttcagcgtagacagtgcgcagctggccgggctcttcgagcaggcggactccgtcgagatggtcgaggttgtatacgatacaatgactgggcggagccgaggatttggattcgagacaatgtcttcagctgaagaagccggagctgctgtcgagcaattcaacggatatacatctcaaggaagacctctgagggtgaactgcgggccaccgccacctagagatggatccgcatcaagagcacaaagggttggtggattggtgacgacagcagcaaacatccttgtcgattcaagggaactaattatatcgtgaggaaactttgcatagaagcgttgaccactacaactccgggagaacttattcagtgaatcaaaggacaggatgctgagatgcctaacgtcatcctactacatggtataagcgcagggtacaa

SEQ ID NO: 74049 - protein, 236 aa, Zea mays
  misc_feature: Ceres CLONE 1558383
  misc_feature (127)..(198): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
GAPRGGGRSRTSGSPGLQEFVSPLEKKCYPRPFVTSQVPEPYHQILKSWRPRSSPPRSRPASSPYPPRSQPRPRARPSSPSRCRCALCRRRRQRGGSSSPLHVAVSSEYGTEGAEHQDGEFSEDIKLFGGNLPFSVDSAQLAGLFEQADSVEMVEVVYDTMTGRSRGFGFETMSSAEEAGAAVEQFNGYTSQGRPLRVNCGPPPPRDGSASRAQRVGGLVTTAANILVDSRELIIS

SEQ ID NO: 74050 - DNA, 751 bp, Zea mays
  misc_feature: Ceres CLONE 1558384
  misc_feature: Encodes the peptide sequence at SEQ ID NO. 74051
  misc_feature (418)..(418): n is a, c, t, g, unknown, or other
  misc_feature (427)..(427): n is a, c, t, g, unknown, or other
  misc_feature (433)..(433): n is a, c, t, g, unknown, or other
  misc_feature (462)..(462): n is a, c, t, g, unknown, or other
  misc_feature (463)..(463): n is a, c, t, g, unknown, or other
tggagctccccgcggtggcggccgctctagaatagtggatcccccgggctgaggaattcgtctcacccctagaaaaaaaaaagtacaacaccatcccctctctaccttcttatctctgtctcctcgtgcaccagcaacaaaggtggcaggcacagagagagctagctttggccaggcgtccacagcagccagcacaagatgtcgacggtggtcatgggggtggatcttgagtgccacaagtgctacaagaagatcaggaaggtcctctgcaaggtccaagacaaggtgagcatcaggaccatctcctacgacgagaagaacaacacggtgacggtgtccgggcccttcgacgccgaggaggtcgccgacaggctcaccgccgacgccggcaaggtcatcaccgacatacacgtcgtcnggggcttcngcttcngctttgggcggggggcggaagcggaagcnngaggaaacaacagatgcaccggggccgtccccccccggttaaggcgcccaagccaggggtaaggcaacggggaaacggggacggcccagggccgggcacgggaaggcgaaggccttggccggggcaccgccggccgccggcggccaaaagcaaagggggaagggcccttggggaaagccccgcgcgggcccggaaagggggaaggccccccggcggggggaaggccaaacccgggtaaaaaaaaaaacccccccaagtttcacaaaaaattgggaaatggggaaacgg

SEQ ID NO: 74051 - protein, 108 aa, Zea mays
  misc_feature: Ceres CLONE 1558384
  misc_feature (74)..(74): Xaa is any aa, unknown, or other
  misc_feature (77)..(77): Xaa is any aa, unknown, or other
  misc_feature (79)..(79): Xaa is any aa, unknown, or other
  misc_feature (89)..(89): Xaa is any aa, unknown, or other
MSTVVMGVDLECHKCYKKIRKVLCKVQDKVSIRTISYDEKNNTVTVSGPFDAEEVADRLTADAGKVITDIHVVXGFXFXFGRGAEAEAXGNNRCTGAVPPRLRRPSQG

SEQ ID NO: 74052 - DNA, 764 bp, Zea mays
  misc_feature: Ceres CLONE 1558385
  misc_feature: Encodes the peptide sequence at SEQ ID NO. 74053
  misc_feature (651)..(651): n is a, c, t, g, unknown, or other
ctggagctccccgcggtggcggccgctctagaactagtggatcccccgggctgcaggaattcgtctcacccctagaaaaaacgcctgttacagatcgcccccgtcttttcttctcgtgttctcccctccccgcgtgcgctcccttgcgtggcgcgactggacaaccgcctctgtacaccagctgctcagatctcgtcgggccccttcgccggcgaccatcacctgtaagtgaactcacggagtccattggatgtcatcaaagaggtctacgattgtggaaccaagcccgccatattttggggcctcgggcagcaacactggaggtgccagtggaggcttctagcagcccttcaacaccagcaacttacctagtgcatgggctagcactgcggtcaagaactcttcaacgtgtacggctgcgaggtctccctgttgattgctatgacattgatatctgcaaggtctatgtgagactggacatcacggaccgcctgctgcttgacaagaacggacgcttcgctagggaggctcttgtggtcctgccaacggctatgcagacagaatttgctctgcatcgtaacaggcagaaatgggccagacgcattgttcaggcgtgcacatgcaggaagccgcagtactacgatgcactanccaacgaggctagccaggtaagaatacttcgagtcagtagtacgactggtccttgctcttgcagagacacctaagaaccctgctgaagacaaggccagctgcagtcacacgaa

SEQ ID NO: 74053 - protein, 240 aa, Zea mays
  misc_feature: Ceres CLONE 1558385
  misc_feature (217)..(217): Xaa is any aa, unknown, or other
GAPRGGGRSRTSGSPGLQEFVSPLEKTPVTDRPRLFFSCSPLPACAPLRGATGQPPLYTSCSDLVGPLRRRPSPVSELTESIGCHQRGLRLWNQARHILGPRAATLEVPVEASSSPSTPATYLVHGLALRSRTLQRVRLRGLPVDCYDIDICKVYVRLDITDRLLLDKNGRFAREALVVLPTAMQTEFALHRNRQKWARRIVQACTCRKPQYYDALXNEASQVRILRVSSTTGPCSCRDT

SEQ ID NO: 74054 - DNA, 761 bp, Zea mays
  misc_feature: Ceres CLONE 1558387
  misc_feature: Encodes the peptide sequence at SEQ ID NO. 74055
  misc_feature (709)..(709): n is a, c, t, g, unknown, or other
ggagctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggagtgctggagaagtgggtgcgcgtggacttcaaggagcccgtgtggttcaggccggcgcgcaatcttctcggagggcgggctggactacctgggcaaccccaacctggtgcacgcgcagagcatcctggccgtgctcggcttccaggtcatcctcatgggccctcggtcgaggggctccgcatcaacggncctcaacgggcgtcgggaagggcaaaaaacctctaccccgggcggccagtac

SEQ ID NO: 74055 - protein, 201 aa, Zea mays
  misc_feature: Ceres CLONE 1558387
  misc_feature (69)..(201): Pfam Name: Chloroa_b-bind Pfam Description: Chlorophyll A-B binding protein
  misc_feature (184)..(184): Xaa is any aa, unknown, or other
MASTIMAATSRIVAAKTPFLGQGRAAAAAANASPLRDVAAAAAGGRITMGNDLWYGPDRVKYLGPFSAQTPSYLTGEFPGDYGWDTAGLSADPEAFARNRALEVIHGRWAMLGALGCITPECWRSGCAWTSRSPCGSGRRAIFSEGGLDYLGNPNLVHAQSILAVLGFQVILMGPRSRGSASTXLNGRREGQKTSTPGGQY

SEQ ID NO: 74056 - DNA, 795 bp, Zea mays
  misc_feature: Ceres CLONE 1558388
  misc_feature: Encodes the peptide sequence at SEQ ID NO. 74057
ctggagctcaccgcggtggcggccgctctagaactagtggatcccccgggctgcaggaattcgtctcacccctagaaaaaagatgcgcaccgcctgcctccgccccaccattcgaataaaaccctcccctccgcctccctccttccgctactcctaggcccattcccaccagcaccagcctcggccgccgccgccgcacccacggtcccgcctcgccgtggcatgagaagatggccgcgtgctccaggggcctcacgtggccgccgttcgatctgaccacggcgaggggggcggcgtcctggccgcgccgccgcgccacgatccggtgctgctgcgccgggacggacccagagccgcggaggcgactctcgagggcggccgcggccgcgcccgagcgtgccgaggagtggcgcgtcgatgggaacaagccgtctgccgcggcaccgggccggcggcgcgctagtctcaccgccatgcccccgctccccttcccggcacctcgtatagttctagaagacagttcaagcaacaggacttctacccacggtgcacgccgaggggcccggctcctcaatcctgtgaatccccacccagagagacactggtattgctagtgagaaagaaatggggaatcaaactgctggacgaagcggtcaaaggagtcttgaaataaatgaagatggaagcacttgggtatagggagaaggggaaaaagatactggcgaaaaatggggtacccgctgcccgcttgggcaaataatggggaggacaggaacccttggatggttccccccc

SEQ ID NO: 74057 - protein, 127 aa, Zea mays
  misc_feature: Ceres CLONE 1558388
MAACSRGLTWPPFDLTTARGAASWPRRRATIRCCCAGTDPEPRRRLSRAAAAAPERAEEWRVDGNKPSAAAPGRRRASLTAMPPLPFPAPRIVLEDSSSNRTSTHGARRGARLLNPVNPHPERHWYC

SEQ ID NO: 74058 - DNA, 764 bp, Zea mays
  misc_feature: Ceres CLONE 1558391
  misc_feature: Encodes the peptide sequence at SEQ ID NO. 74059
ctggagctccccgcggtggcggccgctctagaactagtggatcccccgggctgcaggaattcgtctcacccctagagtcgcctccgtgcgtgccccgggggccttgatcgcgcgcaccggtcagctcagcccgtctgattcgcgtgctgccagccctccgccgatcgtgaaacacaaccgtcggtggtttgcttgcttgatcgctgatcctcgcggacgctcacggtcatggcgcctcagcctttgcgcgctccgaggctgagcgcccccgctggccacgcggcgtgcaggtgctcggccgcgccgctattcgggaagcgggcgccccccgtcgtcgcgttcccccgcgcccgtagcggcggcgccgtcgcctcgtgctcggccgtgcaggagtcgtccacctccaccactgttagcaagaagaaggatgccgcggacggggccaaggaggccacagcggaagcggcgaagccggccgcggccgccaagccaaagaaggccgcggcgctgccgctgccggagatgatgcagcaggagatcatcccaccgctgaaagatgccttggaggcggaggacgacgtgtcccaggtgcagctcgcttccaaaacaacacgctggagggatccttcataaaagacgacgtccccttattaatttttgggccttctttcccaaaaggagacctcaccaggacccgagggctttttgcgctatcgtccctacagcaacggaagtgagcaacattccgagcccgtttcctgatc

SEQ ID NO: 74059 - protein, 134 aa, Zea mays
  misc_feature: Ceres CLONE 1558391
MAPQPLRAPRLSAPAGHAACRCSAAPLFGKRAPPVVAFPRARSGGAVASCSAVQESSTSTTVSKKKDAADGAKEATAEAAKPAAAAKPKKAAALPLPEMMQQEIIPPLKDALEAEDDVSQVQLASKTTRWRDPS

SEQ ID NO: 74060 - DNA, 797 bp, Zea mays
  misc_feature: Ceres CLONE 1558392
  misc_feature: Encodes the peptide sequence at SEQ ID NO. 74061
  misc_feature (531)..(531): n is a, c, t, g, unknown, or other
ctggagctcaccgcggtggcggccgctctagaactagtggatcccccgggctgcaggaattcgtctcacccctagaaaaaattagtcgcaaatcttttccaaatggctcgtgaaaatgccccttccattatctttattgatgaaattgattctttatgcggtcaacgtggagaaggtaatgaaagtgaagcatctaggaggattaagactgaacttcttgtgcaaatgcagggtgttggtcataatgatgataaagttcttgttcttgctgccacgaatacgccatatgctctggaccaggctgtgcggcgaagatttgacaagcgtatctacattccgctacctgacacgaaagcaaggcagcatatgtttaaggtccatctcggggatacaccacacagcttaactgaaagcgatttcgagagcttggcccgtcgaacagatggattttctggttctgatgttgctgtttgtgttaaggatgtcttatttgaacctgtgcgcaaaacacaggatgccatgttcttcttncaggcagacggtgacatgtggatgccatgtggaccaaaacaaccggggcgctgtacagaccacaatgcaggagcttgcatccaagggcctcgctgcaaagattctttccacacctatctcaaggacggatttttgagaaggtcttgtcgaggcagaagccgacagttagcaagaaggatcctggaagtgcatgaagaggttccactaagagttccgccgaagagggcctgatccacccgcgcgcgggaaccacccccatgcacagc

SEQ ID NO: 74061 - protein, 219 aa, Zea mays
  misc_feature: Ceres CLONE 1558392
  misc_feature (1)..(134): Pfam Name: AAA Pfam Description: ATPase family associated with various cellular activities (AAA)
  misc_feature: SWISSPROT Homolog: EC 3.6.4.3 Microtubule-severing ATPase
  misc_feature (143)..(143): Xaa is any aa, unknown, or other
MARENAPSIIFIDEIDSLCGQRGEGNESEASRRIKTELLVQMQGVGHNDDKVLVLAATNTPYALDQAVRRRFDKRIYIPLPDTKARQHMFKVHLGDTPHSLTESDFESLARRTDGFSGSDVAVCVKDVLFEPVRKTQDAMFFXQADGDMWMPCGPKQPGRCTDHNAGACIQGPRCKDSFHTYLKDGFLRRSCRGRSRQLARRILEVHEEVPLRVPPKRA

SEQ ID NO: 74062 - DNA, 798 bp, Zea mays
  misc_feature: Ceres CLONE 1558393
  misc_feature: Translation starting site: 163
  misc_feature (638)..(638): n is a, c, t, g, unknown, or other
  misc_feature (761)..(761): n is a, c, t, g, unknown, or other
ctggagctcaccgcggtggcggccgctctagaactagtggatcccccgggctgcaggaattcgtctcacccctagaaaaaaccagcaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggagaccttcgcgcgcaaccgggagctagaggtgatccactcccggtgggcgatgctgggggcgctgggctgcgtgttcccggagatcctggctaagaacggcgtcaagttcggcgaagcggtgtggttcaaggccggcgcgcagatcttctcggagggcgggctggacttactggggaacccaacctggtgcacgcgcagagcatcctggccatctgggcgtgccangtggtgctcatggagctcgtcgaaggctaccgggtcggcggcagcccgctcggggaagggctcgaccaggtggaccccggcggggcttttcacccggtggggcttgccggacgacccggaaancggcgcccaagctcaaggtgaaggaactccaagaacg

SEQ ID NO: 74063 - DNA, 1156 bp, Zea mays
  misc_feature: Ceres CLONE 1558397
  misc_feature: Encodes the peptide sequence at SEQ ID NO. 74064
  misc_feature (11)..(11): n is a, c, t, g, unknown, or other
  misc_feature (1132)..(1132): n is a, c, t, g, unknown, or other
gtttaagatanggagaggagaagagggagggaaaaggggggggggggggggggggtggaatttttgtgataattaagaagtgtggggctccccacggtggcggccgctctagaactagtggatcccccgggctgcaggaattcgtctcacccctagaaaaaagcgagccaggcacggaggaggcgcgtgctctgctccactccacctcccccccccccctgcgccactgacgccgctcgttcgcgcagttttggtcttctggccagcagggcagggggggaacccgcgggagcgaggcgcgcgagcgagcgagcggagggaggaggaagatgatgcacgccaagtcggagtcggacgtgacgagcctggcggcgtcgtcgccgccgcggtcgccgaagcggggcgttgccgccgccggcaccggcggcggcggcggcggcggcggctactacatgcagatcccgtcgcgggagtcgcacaacagccgcagcagcgtctgcggcggggtacaaggcctccgccgattgcaagcacacgccggttgtacaacaactagccccaggggagtcggccgttcacaagcccatcctaccggaacgccgacgtccctgcatcccttccttgcagtaaggacgacgtttctccggaggggtacctccagacgggggggtggtgccgacaccttacgttgggggtggaggtccatgtgacgggcctttccacatcggaaacacatatggtagccatgggagccccaccataaaaagtgggcggtgcgccagtcccactttcgggaacgcgcatgttgtaatagggaggcccccccgtcaatacggaaagcgagggcctctcccaggacggcgcccgcgggggtgaaaaagaagcaggtgtactatttttattcaacaaatacctatatttgatatgccgagtatatcccaatatccgttcatgtagctttgtgccatataacgctcttatacagtccctctcctcctcatattacgacaggggtatggtacctgagccctgttggagtggaaaagtatgagggggaggtcacaggccttttctctatgatacctaaagtcccgcaaaagaatcctgcggcggcgcaatggagaatcatgtntgggagaagtgagaacaaaactct

SEQ ID NO: 74064 - protein, 126 aa, Zea mays
  misc_feature: Ceres CLONE 1558397
MMHAKSESDVTSLAASSPPRSPKRGVAAAGTGGGGGGGGYYMQIPSRESHNSRSSVCGGVQGLRRLQAHAGCTTTSPRGVGRSQAHPTGTPTSLHPFLAVRTTFLRRGTSRRGGGADTLRWGWRSM

SEQ ID NO: 74065 - DNA, 798 bp, Zea mays
  misc_feature: Ceres CLONE 1558402
  misc_feature: Translation starting site: 696
  misc_feature: SWISSPROT Homolog: EC 3.1.1.3 Triacylglycerol lipase
ggagctccccgcggtggcggccgctctagaactagtggatcccccgggctgcaggaattcgtctcacccctagaaaaagcaactgcgtcacggaacgaaaccagcaggtgagcagtcgaacatcgtggtcgcctctgctcagcccagatctccgatggccaccgcacccgccgccccgccgccggcctccgcggacgacgagatcatctacgagtccatgccctgcatccgcgtctacaaggaccgcgtggagcgctacttcggcaccgagttcgtcgccgcctcgacgaacgactccaccggcgtggcctccagggacgtcgtcatctcccccaacgtctccgcgcgcctctacctcccgcgcctggacgacgggaacgccaagctccccatcttcgtctactaccacggcggcggcttctgcatcggctccgccttcaaccccatcttccacgactacttcaactgcctcgtggccctcgccgacatcctcgtcgtctccgtcgagtaccgcctcgccccggagcaccccgtccccgccgcctacgccgactcctgggaagcgctcgcctgggtcgtctctcacctcggccccgccggcgacggcgcccggggacccgtggatcgcggggcacgccgacttctcccgcctcttcctgggcggcgagagcgcgggctccaacatcgcgcaccacatggcgatgcgcgctgccgcggaggggctggcccacggcgcccggatccggggactcttcatgatcaacccctacttcctggccacggacaaggtgccctccc

SEQ ID NO: 74066 - DNA, 1241 bp, Zea mays
  misc_feature: Ceres CLONE 1558403
  misc_feature: Encodes the peptide sequence at SEQ ID NO. 74067
  misc_feature (28)..(28): n is a, c, t, g, unknown, or other
  misc_feature (32)..(32): n is a, c, t, g, unknown, or other
  misc_feature (34)..(34): n is a, c, t, g, unknown, or other
  misc_feature (38)..(38): n is a, c, t, g, unknown, or other
  misc_feature (39)..(39): n is a, c, t, g, unknown, or other
ggggggtggggggggggtgtggtatggnacgnanaggnnacggtggtgtgggttttttggtggtgctttttgggggggggggggtccccgcggtggcggccgctctataactagtggatcccccgggctgcagagaattcgtctcacccctagaaaaatactgctccctccaacggacttgaccactaaaagctaatcacacccccggccatggagctcgcgtccacctccgccaccacacccgctgccgtgctcaagaccccgttcctcggtgccaggagcgcgctcgccaatgctgccgcgcccaagcccgcgccgcgccgcgcgctcctcgccgtctccgcggccgccgccaagaagtcgtcggatccccgccctcaagagcgacgccgagttcatcaacccgccctggcgcgacagatcgctccctggagacttccggtccaatacgggtgggggctggggaaggacccggcggtcctcaacacctattcatgagggtgtagctggatatccgcccggcggtggggatcctatttgggctggccggagcgggagcaatatttgcgtgggaggaggatcacccgggtaagggggaatccccagggggattacgagaggagacaggcacccggaacacggggagcgaaccattgcgcgagacgcctcttttactgcactgtcgcggaggataaggtctggggtggggcgggggcaggctagtaaggactgtgatacctggattcccataatgtggtgtatgattgtgtagtgaagtttagagagaggttttctctaaaaatacggcccccgcctgtgttggggggtctcgcgttaagaggtatgtcggtgtgatatagaaattagacggggagaatactgtgtgtcaatagatagcgacggaggtgagtggaatatgtttgcgggggcggaagagggtgctgtgggggagggggtccacattttacagtgtatgagggtagagggatctagagtattcgtctcgagaaaaatctcgtggttacccgcgggtggggagcaccacgtgtgtctgtttgtctatatttgggtccgaggccataaaatattaccagacatgagataagagggaagatggagaagcactttggggtttgcgggtttctcgtgtgcagagggggagagggtggagagaatacgcatattcataaaactgagctgttcgcgaataaagagattctagtagtctagagaatgatggg

SEQ ID NO: 74067 - protein, 95 aa, Zea mays
  misc_feature: Ceres CLONE 1558403
MELASTSATTPAAVLKTPFLGARSALANAAAPKPAPRRALLAVSAAAAKKSSDPRPQERRRVHQPALARQIAPWRLPVQYGWGLGKDPAVLNTYS

SEQ ID NO: 74068 - DNA, 768 bp, Zea mays
  misc_feature: Ceres CLONE 1558404
  misc_feature: Translation starting site: 542
  misc_feature: SWISSPROT Homolog: EC 2.7.11.1 Non-specific serine/threonine protein kinase
  misc_feature (617)..(617): n is a, c, t, g, unknown, or other
ctccccgcggtggcggccgctctagaactagtggatcccccgggctgcaggaattcgtctcacccctagaaaaacccctagaaaaatagaaaaaagaaaaattcgactcccagcacgggcggacctgcctgcaccacgcgtcctacttcggccacgtcggctgcctgcaggccatcctcacggcggcgcggaccacgccggtggccaactcatggggtttcgctcggttcgtcaacgtgagagacgaccacggcgccacgccgctccacctcgccgccaggcagggccgccccggctgcgtgcaggcgctgctggagaacggtgccatcgtctccgctttgaccggctcatacgggtttcctggtagcacgtcgctgcacctcgccgctcgcagcgggagcctggattgcacccggaagctgctcgcctggggagcggatcgtctccggagggatcagcagggaggatcccttacgccgtggcgctgaagcgcaaccacgaggcgtgcgcggcgctgctgaacccgtcggcggcggagcccatggtgtggccgtcccccgttcagttcatcagcgagctggagccggaagccaaggcgctccttgaagcggcctacngaagccccacagggagaagggggggagaagatcctcaggggcaccaagcactcctccgaatcctccccacctgggaccacgcgagcgacgccgccgacgccgaagccattggaagaacgctccctcaaaatgcagcggccagcgacccgga

SEQ ID NO: 74069 - DNA, 782 bp, Zea mays
  misc_feature: Ceres CLONE 1558405
  misc_feature: Encodes the peptide sequence at SEQ ID NO. 74070
  misc_feature (630)..(630): n is a, c, t, g, unknown, or other
ggagctccccgcggtggcggccgctctagaatagtggatcccccgggctgcaggaattcgtctcacccctagaaaaaatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgagcgccggctccgcggagctgtcctgcgcgtacgagctctccaaggaccccgccgtgagcatcgccatcgtggagcagtcggtgtcgcccggcggcggcgcgtggctggtcgggcagctgttctcgggcatggtggtgcgcaagccggcgcaccttttcctggaccagctgggcgtggcgtacgaacaagcccnaggactacgtgggtcatcaaggacgccgcggctcttcaagtccacgggtcatgaaccctgctcctgggcgcggcccaaacgtcaaagcttgtcaacgacccgggccctgggaggaacctcatcttcaggggaaggggccgttccgcggggtt

SEQ ID NO: 74070 - protein, 210 aa, Zea mays
  misc_feature: Ceres CLONE 1558405
  misc_feature (64)..(210): Pfam Name: Thi4 Pfam Description: Thi4 family
  misc_feature (160)..(160): Xaa is any aa, unknown, or other
MATAAASSLLKSSFAGSRLPAATRTTPASLVVATGPRGAGAGPICASMSMSSSNPPYDLTSFRFSPIKESIVSREMTRRYMTDMITYADTDVVIVSAGSAELSCAYELSKDPAVSIAIVEQSVSPGGGAWLVGQLFSGMVVRKPAHLFLDQLGVAYEQAXGLRGSSRTPRLFKSTGHEPCSWARPKRQSLSTTRALGGTSSSGEGAVPRG

SEQ ID NO: 74071 - DNA, 767 bp, Zea mays
  misc_feature: Ceres CLONE 1558407
  misc_feature: Encodes the peptide sequence at SEQ ID NO. 74072
  misc_feature (661)..(661): n is a, c, t, g, unknown, or other
  misc_feature (731)..(731): n is a, c, t, g, unknown, or other
ctggagctcaccgcggtggcggccgctctagaatagtggatcccccgggctgcaggaattcgtctcacccctagaaaaagcaatcggccccatcactcttccgtcgtgtcttctcgcgcttccactcccaacgagatccatcacccccgacctctgtaagcttcccttgacgtcgtcgtcgtcatccatggagagcaaggacggcacccacgatcccgccacgacggccgcgccaccggccggcgcgccgcaacccgcgatgccttccgcggagacggcgcggtggggcacgcggcagatgggcccgccggcggcccccggggcgcacccggagaaccaggaggcggcgcggtggacggccgcgcgcggggaccaggagctgccgccgtacgtcatcatcggtgagccccgtggcggcgccgccgccgccacagcataggggcaagggggacagccccatggagcacatcctcgacttcttcaacacctggagccgcaaggccgaggagctggcctccaacatctggttcaatctgaatgccgcgccatccatgtcggacgccgcgatggggaagctaagcctcggcgcgaaggcgctgtcggagggcggcttcgagaagtgtacaagcagacgttctcgtccagccccgacgagcactgnaagaagacgttcgcatgctacctctccacgggcacggggcccgtccccggcacgctagtactgaccaacntgaacgtcgctttctgcagcgacggccgctctcttc

SEQ ID NO: 74072 - protein, 83 aa, Zea mays
  misc_feature: Ceres CLONE 1558407
MESKDGTHDPATTAAPPAGAPQPAMPSAETARWGTRQMGPPAAPGAHPENQEAARWTAARGDQELPPYVIIGEPRGGAAAATA

SEQ ID NO: 74073 - DNA, 815 bp, Zea mays
  misc_feature: Ceres CLONE 1558409
  misc_feature: Encodes the peptide sequence at SEQ ID NO. 74074
  misc_feature (735)..(735): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
ctccccgcggtggcggccgctctagaactagtggatcccccgggctgcaggaattcgtctcacccctagaaaaaacatcaggaaccccccccgacgccgcaggaggagacacatctaggttagcacgacgaagcacatctaccttgacggccaagtggaagaagatccgcatggatgaggctcaagaggaagctgcacatagatgaggcacagatccaagtaggcacatcgagatgaattgtggacctgatgacatgcgtgggtacatacatttcttccgatgccttggtgtgcctgtggagagatgtcaacctgccatggtgtcactgtccgacatcacttgatcgtcttacctgctcttcactaagacacttttcatggctctagttgtatttgaatccaacgcctgccactaagataaatcagactgtcactttgtgatcctattatgatggagctttctttgctgttgaaaggttgctaataacagcatccgctatgctgatgttaaccctgtcatcaccgaatgagatccgatttcctcaagatgaatccgggactccatgcagaagctaactatcacacgcgagacgacatcgtccactagattgcagctcctgccttgaatgcatcctacaatattgatgtgtcacaaagtgctagtacgaagcacaacatctcctactgtctagggtgcactggtgactaataccactatgtggtatacgcggcacnagatgattatcttaannnnnnnnnnnnnnnnnnnnnnnnnnnnngnnnaaaaaaaaatatttaagacccttggggttagt

SEQ ID NO: 74074 - protein, 45 aa, Zea mays
  misc_feature: Ceres CLONE 1558409
MTCVGTYISSDALVCLWRDVNLPWCHCPTSLDRLTCSSLRHFSWL

SEQ ID NO: 74075 - DNA, 741 bp, Zea mays
  misc_feature: Ceres CLONE 1558411
  misc_feature: Encodes the peptide sequence at SEQ ID NO. 74076
  misc_feature (568)..(568): n is a, c, t, g, unknown, or other
tggagctccccgcggtggcggccgctctagaatagtggatcccccgggctgcaggaattcgtctccccctagaaaaagttaggattcccccttccgtcggctgcattcctacgcgcgtgttctgtctgtctctctcggccccctctcgctctccgacgactggtgggccgctgccggcgccgccgccttaacccaggtgttgaggctttctttggtctcctcgccgtcgacgagcacccaccaggatgaattctaacgtaggaggagtcatagcccagttgaatacaaggaaggccgtgacaaagattatgggacttctggaaagaagaataagtcaagagatctagatgacacatgtgatgctagaagaggtcatgaaaccgataggcactctgataagcattcctttggaacatcacgtgaatccaagaagcatgatgactatcggaggtacccatgatagtatggtgatgattatggtagggagccatcccaagagcctctcggtcagaccggggaatcaaaggctgataccttattatgatcggctcaaagcatgattacacantctggtagattacggtggtgatcaaccgaagattttgggccgtaggtaccggaaaaaaatctggttaatcgggatttcggaggggtttttaatggaaggaaagccgggagtccccttcgtgggctttaaaaaaaaagaatggcgggaaaaaacattaaaacctttgggttgcc

SEQ ID NO: 74076 - protein, 33 aa, Zea mays
  misc_feature: Ceres CLONE 1558411
MNSNVGGVIAQLNTRKAVTKIMGLLERRISQEI

SEQ ID NO: 74077 - DNA, 788 bp, Zea mays
  misc_feature: Ceres CLONE 1558416
  misc_feature: Encodes the peptide sequence at SEQ ID NO. 74078
ctggagctcaccgcggtggcggccgctctagaactagtggatcccccgggctgcaggaattcgtctcacccctagaaaaacatcatccagaccaccattaccagagtgctctgctctcgctggaggccgtggttcattcacgctcatggaggccgccgccattcccaccagtgccccggaaaccaggattgccgttgtcaccggcggcaacaaaggcatcgggctagaggtgtgccggcagctggccggcgccggcgccggcgccaccgtcgtcgtcttaacagccagggacgagacgaggggtgcagccgctgcagaagagctcagagaatctgggctctccaatgtcatcttccatcagctggacatcaccgacgctgcgagcgtcagtcggctggctgagttcctcaaggctcgttttggaaagctagatatcctggtaaataatgccgcagttggtgctgttgagtacgtccaagatcctgctgacggtgcaacgagcgaggaagagctgagtggcatggacatggaccaaaggcttcagtgcatgttttagagagtccgggagacctacgacgctgcgacagaaggcatcaagacaaactactatggcataaagcatgtgatcgaagccttgctgcctctgcttcaagcttcctccgatggggaggatcgttaacgtcctcctctgaagtcggccctgctaaggctgatcaacaacgaggagctaaggcaggagctaaacgacgtggaagagctcacccaagaaaggctgggacaagtgcttg

SEQ ID NO: 74078 - protein, 136 aa, Zea mays
  misc_feature: Ceres CLONE 1558416
  misc_feature (14)..(136): Pfam Name: adh_short Pfam Description: short chain dehydrogenase
  misc_feature: SWISSPROT Homolog: EC 1.1.1.184 Carbonyl reductase (NADPH)
MEAAAIPTSAPETRIAVVTGGNKGIGLEVCRQLAGAGAGATVVVLTARDETRGAAAAEELRESGLSNVIFHQLDITDAASVSRLAEFLKARFGKLDILVNNAAVGAVEYVQDPADGATSEEELSGMDMDQRLQCMF

SEQ ID NO: 74079 - DNA, 840 bp, Zea mays
  misc_feature: Ceres CLONE 1558418
  misc_feature: Translation starting site: 177
  misc_feature: SWISSPROT Homolog: EC 2.5.1.18 Glutathione transferase
ctggagctccccgcggtggcggccgctctagaactagtggatcccccgggctgcaggaattcgtctcacccctagaaaaactagaaaaaaaggaaactcactcccactttactcctatccactgcggcctggacgcgtgcgagaggcttgaccaagcagcagcagcagcagcagcgatggcgcctctgaagctgtacgggatgccgctgtcccccaacgtggtgcgcgtggacaccgtgctcaacgagaagggcctcgacttcgagatcgtccccgtcgacctcagcaccggcgcccacaagcagcccgacttcctcgccctcaaccctttcggccagatcccggctctcgtcgacagagacgaagtcctcttcgagtcccgcgcgatcaaccggtacatcgccagcaagtacgcgtcggagggcacggacctgctccccgcgacggcgtccgcggccaagctggaggtgtggctggaggtggagtcgcaccacttctacccgaacgcatcgccgctggtgttccagctgctcgtgaggccgctcctgggcggcgccaccgacgcggcggtgcgtggagaagcacgcggagcagctcgccaaggtgctcgacgtgtacgaggcgcacctgggccgcaacaagtacctcgcccagggacgagttcacgctcgccgacgccaaccaggcgtcctacctgctatacgtgcagaagaactccaagggccgggctcgtctgcagcccgcccccacgttaagaccatgctggggaggtcatcggcagcccgacgcgcgatgcataaagacagttgccgcctatcccttttgccccaggctgccgtc

SEQ ID NO: 74080 - DNA, 813 bp, Zea mays
  misc_feature: Ceres CLONE 1558420
  misc_feature: Encodes the peptide sequence at SEQ ID NO. 74081
ctggagctccccgcggtggcggccgctctagaactagtggatcccccgggctgcaggaattcgtctcacccctagaaaaaggaaggtcccggcagaagaacttggcgggcgaaaggcgaaaccgacgtgctcccgggcgggcggcgacagcggcatggagcgagagcggcaggcagtggcgaggaacaggaaggtggtgctgcgcgggtacatcgaccgcgcgcccagggaggaagacatggagctcgtcgacggcggcgccgtggagctgcgcgtccccgagggcggcggcggccccgcggtgctggtgaagaacctctacctatcctgcgacccttacatgcgcggcaggatgcgggacttccgcaactcctacatcccgcccttcaaacctggatcagtgagcttccctcgtttaccttttcatttttttgggggagcttgcccgcttgggctcttttggttagctgctgaagctgcaggctgcaaagtcgggtgggcgattcgtgcgctgattgagcaattccttgatctgtgaagcctattgaagggtttggcgtggcggagggtggtcaactccactcatccaggattcagtgctggtgacgttgtttccgggatgactggatgggtagactacagtctgatcaccaagcctgaacagctcaggaagatccagcatagcgacataccactctcctatcatctgggccttcttggcatgcctgggcttacagcttatggtggaattctatgagatctgttcaccaaaaaaaggggagttttgtttttgtttctgctgcatcgggagca

SEQ ID NO: 74081 - protein, 127 aa, Zea mays
  misc_feature: Ceres CLONE 1558420
MERERQAVARNRKVVLRGYIDRAPREEDMELVDGGAVELRVPEGGGGPAVLVKNLYLSCDPYMRGRMRDFRNSYIPPFKPGSVSFPRLPFHFFGGACPLGLFWLAAEAAGCKVGWAIRALIEQFLDL

SEQ ID NO: 74082 - DNA, 789 bp, Zea mays
  misc_feature: Ceres CLONE 1558421
  misc_feature: Encodes the peptide sequence at SEQ ID NO. 74083
ctggagctccccgcggtggcggccgctctagaactagtggatcccccgggctgcaggaattcgtctcacccctagaaaaagccacaactgcgtcgaatgcgccagtcgagtccatgagcgggatcatgcgctggcactgcttcacgacgtccgcgacggcgtgccacagccagtgcagcatctctcgccgtccacggcagcggcgacactgagctgtcccacggcgaggccgacaaggtccccgcgaccgccgcgctacccaacccgcgcgagaagatctgctgtcggttcgtcgacaggacgaagctgtcccgccacgtccgcctcatccacttctccctaccgtcgccggaccaggcgctcggcatccccaccggcacgcatgtcttcgactgcaccagcgttgacgggaagccgtgtatgcgatcgtacacgcagacgagcaaggaggacgaggttctcgccactacgcccaacaggtgtttgatgaattgcttcaacctcatacacagtgctttcagctgggatgcagttccacatcggcaaccttggccaccaccacatttgcacgtacaaatgggagcaggaactcatcaacgaagtactggcagtagagagtcgtcgaacctgtgtttggtgtggctgtggattttgcagactctgatgggtgcacagaggcgaatgcttgctcgtcgccaccttgcggttgctgctatgattgaggaattggtgagagattctcgctccgctgttttatgggaggtatcaaatcacggaagaccgcacgga

SEQ ID NO: 74083 - protein, 123 aa, Zea mays
  misc_feature: Ceres CLONE 1558421
MRSYTQTSKEDEVLATTPNRCLMNCFNLIHSAFSWDAVPHRQPWPPPHLHVQMGAGTHQRSTGSRESSNLCLVWLWILQTLMGAQRRMLARRHLAVAAMIEELVRDSRSAVLWEVSNHGRPHG

SEQ ID NO: 74084 - DNA, 788 bp, Zea mays
  misc_feature: Ceres CLONE 1558422
  misc_feature: Encodes the peptide sequence at SEQ ID NO. 74085
  misc_feature (509)..(509): n is a, c, t, g, unknown, or other
  misc_feature (534)..(534): n is a, c, t, g, unknown, or other
  misc_feature (623)..(623): n is a, c, t, g, unknown, or other
  misc_feature (747)..(747): n is a, c, t, g, unknown, or other
  misc_feature (749)..(749): n is a, c, t, g, unknown, or other
  misc_feature (750)..(750): n is a, c, t, g, unknown, or other
  misc_feature (774)..(774): n is a, c, t, g, unknown, or other
ctccccgcggtggcggccgctctagaactagtggatcccccgggctgcaggaattcgtctcacccctagaaaaaaccaacctcagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttnggcctccagcggttccgccaatgcnacctcatccacgggcgctgggccatgctcgcaaccctcggcgcccttttccgtcaaatggctccccggcctccactggcaaagaccccngcaaggtggaaacgggtgaacgggtcccccctacctgggccagcccctgccgtttctccattttggaagcttcatatggggatggaggggccctccggaatggggctacccccaaagttcaccngnnaacgccccaaacgcccgacccggnaaaaaaaggacctt

SEQ ID NO: 74085 - protein, 224 aa, Zea mays
  misc_feature: Ceres CLONE 1558422
  misc_feature (63)..(196): Pfam Name: Chloroa_b-bind Pfam Description: Chlorophyll A-B binding protein
  misc_feature (131)..(131): Xaa is any aa, unknown, or other
  misc_feature (140)..(140): Xaa is any aa, unknown, or other
  misc_feature (211)..(211): Xaa is any aa, unknown, or other
  misc_feature (212)..(212): Xaa is any aa, unknown, or other
  misc_feature (220)..(220): Xaa is any aa, unknown, or other
MASSVAAAASTFLGTRLADPAPQNGRIVARFGFGLGGKAKPAPKKVAKTSTSSDRPLWFPGAVAPDYLDGSLVGDYGFDPFGLGKPVEYLQFELDSLDQNLAKNEAGGIIGTRFESSEVKSTPLQPYSEVXGLQRFRQCXLIHGRWAMLATLGALFRQMAPRPPLAKTPARWKRVNGSPLPGPAPAVSPFWKLHMGMEGPSGMGLPPKFTXXRPKRPTRXKKDL

SEQ ID NO: 74086 - DNA, 790 bp, Zea mays
  misc_feature: Ceres CLONE 1558425
  misc_feature: Encodes the peptide sequence at SEQ ID NO. 74087
ctggagctccccgcggtggcggccgctctagaactagtggatcccccgggctgcaggaattcgtctcacccctagaaaaagcagagaatcccgtcaacccatggccaccacaccgctgcttgcactagatactaggcttgctctcatcctttccactcgtcgtcttccacggcttccacgccttgccttgctgctgatgctactccatttcctcccccggtacatgcctgacccaacaaacgcacccccaagctaccaacgcacgcaaagcacggacgggcgcatacagctttccctttcgagagtgcgtgccccttctcttctctagttctcttctccgtcgcgtcagagatcagggagagaccagagcaaacaacaaccaccgcttgtttcatcaagaatcgcggaggaaaaccgaaaggtgtagtagccttttccggtagggcatctgctagagccagccggtgtgaagaggggagcgagacgaggagggcagccgagcatgagcatcgcagtggtggttaagcagcagcaacgacgacgacgacgacgctgagaggtttccccgttcccgacggacgtcccaaccgaggcggcgccatcgcaatgggtcctctggcgccgctgatgtgtaacccgccgccgccgatctgcaaatcagctgggtcactgctgctgctgtccaagtcgatcaccctctactgctgagccgatccccctccctctatcagatgcaatggcgcccgtggtcctcatcagcagggtgggagccgcggcacgtcattggaac

SEQ ID NO: 74087 - protein, 33 aa, Zea mays
  misc_feature: Ceres CLONE 1558425
MGPLAPLMCNPPPPICKSAGSLLLLSKSITLYC

SEQ ID NO: 74088 - DNA, 800 bp, Zea mays
  misc_feature: Ceres CLONE 1558426
  misc_feature (772)..(772): n is a, c, t, g, unknown, or other
ctccccgcggtggcggccgctctagaactagtggatcccccgggctgcaggaattcgtctcacccctagaaaaactactggtccctcggacggacttgaccacgagaagataagaacatccccggccatggtgctcgcgtcaaatttcgcatgggcgcccgctgccgtgctcaagaccccgttcctcggtgccaggagagcgctcaccaatgcctggcgctgcctagcccgctacgaggcgcgcgctcatcgctgtcgccgcggccacctcctagaagtcttgaatacccgccttccagagcgacgccgagttgatcatacccgccctggctcaactgatcgctccctggcgacttccggttctatacgatgggaatgggcaacgacccagcgttcctcaagtggtatccggaggctgatctaatccatccgccgtgggcaatggctgccatgatgagtcatcttcgtgggggaggcctggagcagcatctcgtggttcgaggccagtgccgactcgggcgccatcacgcccttctccttcggttcgctgatgggcacgcagctgctgctcatgtggtgcgtggactcgaagccgtgggtggacttcttcagcacggactggatctccgtcaagtgagacacgccatgcttcttcactggcgaggagttcgccaacttcaacggtcgacatggactagccgaggcgcaatttcttcgtagcgctgggccctcgccggcacgatcaggaaaagcgtctacgttccccacctcntgcatgctcaacgacttgagccggccaa

SEQ ID NO: 74089 - DNA, 789 bp, Zea mays
  misc_feature: Ceres CLONE 1558427
  misc_feature (595)..(595): n is a, c, t, g, unknown, or other
ctggagctccccgcggtggcggccgctctagaactagtggatcccccgggctgcaggaattcgtctcacccctagaaaaaacaaggccacttgttctgcttctctctttgcctgacctgatgcgttctcctgatgcaacctgggtgttggcgtcatcaagcgctctgaggagattccaagctgcgggtatggcccttctgctggcgcattcctattggtacagccggctggggccattctaccccgtaccatgctcttctggacgaggctggtgtccgcgctaggaatgcccatgaccgcctcatctgttacacgttgacgagagctcatattgtaatatctttgctcaaggcaccttgcctgatgacaccgacggataacctcgtctagctgcaagaatcggaaaggtgcgtctgccatgcgagcatgactgatgtcacgcgcttctctatgtcacgaaactctagacccagactgatattcttaggattctgcacgagcaatgtgccacccttggcccgctcaagtagctgtgcatcacgctggttgactgactactgccacctttctgcgtgatagatctccatggccaccnccttagaagatctgcaagtcaatgcgtctatgcgacacggggatgaagattacccctaccgccccggtagagtatttgtggtttgtcacagaatgctggtagttgagattactatcatcgcttagagatccagaatggagccgtgaactattctagcctttccacagaatctgcatcaaagacgccagactatt

SEQ ID NO: 74090 - DNA, 777 bp, Zea mays
  misc_feature: Ceres CLONE 1558428
  misc_feature: Encodes the peptide sequence at SEQ ID NO. 74091
  misc_feature (533)..(533): n is a, c, t, g, unknown, or other
ctggagctcaccgcggtggcggccgctctagaactagtggatcccccgggctgcaggaattcgtctcacccctagaaaaaagcgcgagtggtggcacccacgcatactcttctcccccccagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggaagccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaagcccaaggcgagcacggagtacatcgcgtacagcggcgacggcttcaagctgctgatcccgtccaagtggaaccccagcaaggagcgggagttccccgggcaggtgctccgctacgaggacaacttcgacgcnacagcaacgtgtccgtcatcatccagcccacgtccaagaggaccatcgccgactacggctcttccgaggagttcctctcccaaggtcgactacctgcttcggcaggcatgcctacggcggcaagaccgactccccagggccgggtcgaaaacgggcggccgtggccaacccgccaacggtcctggaagagctcccccccccgtggatcgaccgcaaagcagttactacccccggggtcccttgg

SEQ ID NO: 74091 - protein, 210 aa, Zea mays
  misc_feature: Ceres CLONE 1558428
  misc_feature (57)..(207): Pfam Name: PsbP Pfam Description: PsbP
MASTSCCLLHQSTARLGASPRLAAAPPRSAQLLVCKARKQEAAADQSDVSRRAALALLAGVTAAAGAKVGPAAAAYGEAANVFGKPKASTEYIAYSGDGFKLLIPSKWNPSKEREFPGQVLRYEDNFDATATCPSSSSPRPRGPSPTTALPRSSSPKVDYLLRQACLRRQDRLPRAGSKTGGRGQPANGPGRAPPPVDRPQSSYYPRGPL

SEQ ID NO: 74092 - DNA, 755 bp, Zea mays
  misc_feature: Ceres CLONE 1558429
  misc_feature: Encodes the peptide sequence at SEQ ID NO. 74093
  misc_feature (274)..(274): n is a, c, t, g, unknown, or other
  misc_feature (690)..(690): n is a, c, t, g, unknown, or other
  misc_feature (709)..(709): n is a, c, t, g, unknown, or other
  misc_feature (710)..(710): n is a, c, t, g, unknown, or other
ctggagctcaccgcggtggcggccgctctagactagtggatcccccgggctgcaggaattcgtctcacccctagaaaacttccccttccgctcgagtctgctctagggtttttgccaagccgccgtcgccgtcgctctgccctcgtatcccctcccacgacaccgagacaccaagatgacggcgcagaccgcggaggagctcgccacccagatcgagcagcagaagctcgaggagcagaagaccgaggcagaggaagttgtggtggaggatgangaggaggaagatgaggacgatgacgatgatgacaaggatgatgatgaactcgatggggatgccagtggcaagtcaaagcaaagcaggagtgagaagaagagccgcaaggccatgctgaagcttggcatgaagcccatcactggtgtcagccgcgtcactgtaaagaaaagcaagaatatactctttgtcatctccaaaccagatgtgttcaagagcccgaattccgacacgtatgtcatattcggcgaggctaagatcgaggacctcagctcccagctgcagacccaggcagcagagcagttcaaggctcctgacttgagccagatgatcttgaatccagagacgtctggcccgggacaggagggacaatgatgaggaggtcgaccgaaactgggtgttgaggccaaggacattgnagctgggtgatgaccccanngcatctgtttcaaaggcccaaaggctgtcaaggcccctcaaggct

SEQ ID NO: 74093 - protein, 156 aa, Zea mays
  misc_feature: Ceres CLONE 1558429
  misc_feature (62)..(121): Pfam Name: NAC Pfam Description: NAC domain
  misc_feature (33)..(33): Xaa is any aa, unknown, or other
MTAQTAEELATQIEQQKLEEQKTEAEEVVVEDXEEEDEDDDDDDKDDDELDGDASGKSKQSRSEKKSRKAMLKLGMKPITGVSRVTVKKSKNILFVISKPDVFKSPNSDTYVIFGEAKIEDLSSQLQTQAAEQFKAPDLSQMILNPETSGPGQEGQ

SEQ ID NO: 74094 - DNA, 804 bp, Zea mays
  misc_feature: Ceres CLONE 1558430
  misc_feature: Encodes the peptide sequence at SEQ ID NO. 74095
  misc_feature (620)..(620): n is a, c, t, g, unknown, or other
  misc_feature (729)..(729): n is a, c, t, g, unknown, or other
ctccccgcggtggcggccgctctagaactagtggatcccccgggctgcaggaattcgtctcacccctagaaaaagtcacagcgagtaccgagtaggagcaaccgcttgcgtcagacgcacactgacggagagtgatcactgatttctggtcatggcaaccgtaactgaggaagttgctccggtcgtcaccgtctccgaggagccggcgccggaagcggcgaaggaggtgcgtggagaagccggaggaggggaagaagcccgacgaggagggtgacgagaggaagaaggccgaccccgccgccgagaaggagaagaaggcgaggaagccgcggagcaggaagcccaagtccgccgggctgcaccacccgccctatttcgagatgatcaaggaggcgatcctgtcgcaggacggcgggaaggtcggggcgagcccgtacgcgatcgccaagcacatgggggagaagcaccgggacgtgctcccgcccaattaccgcaaggtgctggcagtgcagctgcgcggcttcgccgccaagggccgcctcgtcaaggtcaaggcttccttcaagctcgccgccgccgaagagaggaagccctccgcggccgcgaatgcgaagaagaangcgtcggcgggaatgccaagcgcaagagggccgccgcgccggccaagaagaagcctgctgccgctgcctcggcgccgtcgaggaggcacctttaaagtgcgcgcgatcnagcgaagaaagggggccccggcgcccgcgcagcccaagcctagcaagccccgggccgccggctccggtgcccgcc

SEQ ID NO: 74095 - protein, 141 aa, Zea mays
  misc_feature: Ceres CLONE 1558430
  misc_feature (1)..(65): Pfam Name: Linker_histone Pfam Description: linker histone H1 and H5 family
  misc_feature (80)..(80): Xaa is any aa, unknown, or other
  misc_feature (117)..(117): Xaa is any aa, unknown, or other
MIKEAILSQDGGKVGASPYAIAKHMGEKHRDVLPPNYRKVLAVQLRGFAAKGRLVKVKASFKLAAAEERKPSAAANAKKXASAGMPSARGPPRRPRRSLLPLPRRRRGGTFKVRAIXRRKGAPAPAQPKPSKPRAAGSGAR

SEQ ID NO: 74096 - DNA, 782 bp, Zea mays
  misc_feature: Ceres CLONE 1558431
  misc_feature: Translation starting site: 296
  misc_feature: Pfam Name: PBD Pfam Description: P21-Rho-binding domain
ctggagctccccgcggtggcggccgctctagaactagtggatcccccgggctgcaggaattcgtctcacccctagaaaaagtcacagcgaagtaccaaataaaggacgcggcagcccggagcgcactgcgggatctgcggggagccgacgactccttgaactgcgcggacaagaggcggcggaggaggaagaggagcggtggtccttcttggcgctgctctttgagctactgcggaagtcgttgctcgggtgcaggaccgtgggcggcggcgaaggcgaacacggcggctgcgggatggagattgggttgcccacggacgtgcagcacgtggcgcacgtcacgttcgataggttccacggattcctaggcctgcccgttgaattcgagcccgaagtgccccgccgtgctcccagtgccagtgcaagtgtcttcggtgtttcaacagaatcaatgcagtgttcctatgattcccgaggaaacagtgtcccaacaatccttttgatgatgcagagacgcctttatgaacagggtggccttcaggcagaaggtatcttccgtataaatgcagaaaatagccacggaagagtttgtgagagaccaactaaatagtggaattgttccagatgggatttgatgtccactgttttggcaggtctaatctaaagcctggtttagagaaagccggagggggcgtactggaccctatcccaactggacaggggtgatggcatgccaatctgaaagagacctgtgctgcgcgtagcgaaatgccttccaccag

SEQ ID NO: 74097 - DNA, 633 bp, Zea mays
  misc_feature: Ceres CLONE 1558432
  misc_feature: Translation starting site: 172
  misc_feature (136)..(136): n is a, c, t, g, unknown, or other
  misc_feature (153)..(153): n is a, c, t, g, unknown, or other
  misc_feature (384)..(384): n is a, c, t, g, unknown, or other
ctggagctccccgcggtggcggccgctctagaactagtggatcccccgggctgcaggaattcgtctcacccctagaaaaaatcagtcatcacccaccgcctccgccgccgacaacagcgtagtgtagtgtagttcncggagagggttggggangagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggangtggaaggggtcgagctcggtggccatcagcaagtacgtcgaggggaagcatggcggcaagctccccaccaacttccgcaagcagctcactgtgcagctgaagaagctcgctgccgccggcaagctgacgatgggtgaagaactgccttcaagcttgccgggccatccgacgccatagcccaagggccgccatagccccaaggtcacccaaagggcccgcgccccaaagccccaagccccctcgcccga

SEQ ID NO: 74098 - DNA, 751 bp, Zea mays
  misc_feature: Ceres CLONE 1558434
  misc_feature: Encodes the peptide sequence at SEQ ID NO. 74099
ctccccgcggtggcggccgctctagaactagtggatcccccgggctgcaggaattcgtctcacccctagaaaaacgaatgcgttggccgctgggagaaggagcagttccgctctctcgtttgggtggacgacgaggaagaggaggccaacgcccacagcaacaggcgaccagcccgcgaagacgtggcaccaggataggtgctcctgtcctgagcttcaaatccgcaccccgcggccaagctgttacttgcgctgcggccttagcatgaggtggccgctggcgatctcgactcgccgccgccccctcctccttttcatccttctcgtcgtcctctacacgattcctgggacattttcatcgaggcaagtcacactcgatactgttgagatattttctactcatgaatggtttggcaaaccaacagtcgttttcgggtgcaatggagagaataaaacagatttgccagatgtgagggaggtgcacacgctatataccttttagggtgaagaatcatggcagcccttaacagagcttccagaaaagaatgcaagcgaagtggtttgtatgaagaggaacaattacacctgatgatgtctttgatgaatgggaaattgggtccagtgatttcaagggtggggaattcccccgggtaaggaaggcccgttcattggcaatttctttgtccaaactggcctggcccaactgggaatgaaaaccgggaacctgggggaaatttgggaaactaaaaga

SEQ ID NO: 74099 - protein, 78 aa, Zea mays
  misc_feature: Ceres CLONE 1558434
MRWPLAISTRRRPLLLFILLVVLYTIPGTFSSRQVTLDTVEIFSTHEWFGKPTVVFGCNGENKTDLPDVREVHTLYTF

SEQ ID NO: 74100 - DNA, 781 bp, Zea mays
  misc_feature: Ceres CLONE 1558438
  misc_feature: Encodes the peptide sequence at SEQ ID NO. 74101
ctggagctcaccgcggtggcggccgctctagaactagtggatcccccgggctgcaggaattcgtctcacccctagaaaaagaactgcaggacctcccctcccgccacccacacgtgctcacatggccgccaccgcgatctcagtccgcctccacccaaccgccgcgcgccatgtggcctccgcccgccgcgcccgcctcggggccgtccgcgcgcagtccgcgccggcggcggcggcggcggcgctgacgcaggacgacctcaagcggctggcggcggtgcgcgccgtcgagcacgtgaagagcgggatggtgctcgggctcgggacgggctccacggccgccttcgccgtcgccgagatcggcgcgctcctggccgcgggcaagctcgagaagatcgtcggcgtgcccacatccaagcgcaccttcgagcaggcgcagtcactcgacatcccgctctccacgctcgacgacaacccgctcatcgacctcgccatcgacggtgccgacgaggttgaccctgacctcaaccttgtgaaagggcggggtggtgctcttcttcgagagaagatggctgaggcagcatcggacaagtttattgctattgttgacgagacaaaactagttgatgggtaagggaaggtagtggtctagccatgcccagcggaagttgtgcagttctgctggaagtacaaccttgcaagattgcatgtactgttctaaggacgtacgagtcgaggcaaagcctaagtttgtaaggcgtaccagccctatggtactgac

SEQ ID NO: 74101 - protein, 170 aa, Zea mays
  misc_feature: Ceres CLONE 1558438
  misc_feature (92)..(171): Pfam Name: Rib_5-P_isom_A Pfam Description: Ribose 5-phosphate isomerase A (phosphoriboisomerase A)
  misc_feature: SWISSPROT Homolog: EC 5.3.1.6 Ribose-5-phosphate isomerase
MAATAISVRLHPTAARHVASARRARLGAVRAQSAPAAAAAALTQDDLKRLAAVRAVEHVKSGMVLGLGTGSTAAFAVAEIGALLAAGKLEKIVGVPTSKRTFEQAQSLDIPLSTLDDNPLIDLAIDGADEVDPDLNLVKGRGGALLREKMAEAASDKFIAIVDETKLVDG

SEQ ID NO: 74102 - DNA, 834 bp, Zea mays
  misc_feature: Ceres CLONE 1558443
  misc_feature: Encodes the peptide sequence at SEQ ID NO. 74103
  misc_feature (730)..(730): n is a, c, t, g, unknown, or other
  misc_feature (767)..(767): n is a, c, t, g, unknown, or other
  misc_feature (794)..(794): n is a, c, t, g, unknown, or other
ctggagctccccgcggtggcggccgctctagaactagtggatcccccgggctgcaggaattcgtctcacccctagaaaaaccctctcgcccgtctcgatcccacaggatccgagagacctcacaagccgccacgccaggtccccatcccatcgcggcgcctgccccacccccgccctgctcccgcccggtagtagtagcagagcctcgccgccgctgccgagaatagatggggttcgtgtccttcgtcgggcgggtgctcttcgtcgccgctttcctcctctccgcctaccaggagtttaatgaatttggcgctgatggtgggccagcagctaaggcccttcagcccaagttcaatgtgtttgtaaaaaatatctctgcacatctgggagtagctgtcccgcacattgagttgaagcatgtgattgctgctacaattgctcttaagggacttggaagtctcctttttattttgaccagctccctcggtgcttatctcctgctgctgtacctcgctctgatcagtcctatcgttcacgacttctacaactacgacacggagaaggaagaattcgcgcggctgtttgcgaagttcacccaggacgtggcgctagttggagctctcctcgtcttcctgggcatgaagaatccacccctaagcgagcaggcaagaagaatgctcacaaggcgaagacgaacctagtaagaggttgctcgctcggccctcaggcnggtgtcaggacacgaagtagtgacctgtgcgaagcantcgatgcgcatcgagctgtcagctgcncttttacatgtatcggatattcagattccattttgcgggc

SEQ ID NO: 74103 - protein, 157 aa, Zea mays
  misc_feature: Ceres CLONE 1558443
  misc_feature (1)..(138): Pfam Name: HR_lesion Pfam Description: HR-like lesion-inducing
MGFVSFVGRVLFVAAFLLSAYQEFNEFGADGGPAAKALQPKFNVFVKNISAHLGVAVPHIELKHVIAATIALKGLGSLLFILTSSLGAYLLLLYLALISPIVHDFYNYDTEKEEFARLFAKFTQDVALVGALLVFLGMKNPPLSEQARRMLTRRRRT

SEQ ID NO: 74104 - DNA, 773 bp, Zea mays
  misc_feature: Ceres CLONE 1558447
  misc_feature: Encodes the peptide sequence at SEQ ID NO. 74105
ctggagctcaccgcggtggcggccgctctagaactagtggatcccccgggctgcaggaattcgtctcacccctagaaaaaagaccagcagcagaacgaaagggatctccggtccccgggccccggctcctcccctcccgattccaatctggtctcaccgggcctggcggcgagggagagatggggaagaaccaggcgtacaaggcgatgcagcgggcgcggctggggtcctcgtccggcgcgccgggcgccgccgacgcccccgaagacggcatggcttccagccgctgaggaattttggctaccatcccactttcgctttgggtgaaagataaagaaaaagaactttggctaacgagggccgtcgcagacggacggttcattccattctccagagtggcatgcggcgcgcctggccagccttaacaagacgcacaccctcacctgggaggagttcaagaagaagcagaaggaagaggaactgaaaaggggtgagctggaggctgacaaagacaaaatgatgagagagtatagagctcaactggatgctgaaagagctcaaaagctagcaaacggaagaaatcactcaaggtcaaactcaaaatcatcatcttccaagaaagagaggaaggataaggacgcaaagaaaagaagtaaaaagaggagaaagcacaaagttcatcagagtcaagttccagttcatcttcagaatcttcaagcagcgacgatgaaggatagggggtccagaaagtcccgatcacgggtcgagatcga

SEQ ID NO: 74105 - protein, 85 aa, Zea mays
  misc_feature: Ceres CLONE 1558447
MMREYRAQLDAERAQKLANGRNHSRSNSKSSSSKKERKDKDAKKRSKKRRKHKVHQSQVPVHLQNLQAATMKDRGSRKSRSRVEI

SEQ ID NO: 74106 - DNA, 787 bp, Zea mays
  misc_feature: Ceres CLONE 1558449
  misc_feature (438)..(438): n is a, c, t, g, unknown, or other
ctggagctccccgcggtggcggccgctctagaactagtggatcccccgggctgcaggaattcgtctcacccctagaaaaagtgtacatggcgaagctcgccgagcaggcagagaggtacgaggaaatggttgagttcatggagaaggtagcgtaaaactgtctgactgcggaggatgctcactgtggtaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctgccgagtccaaggtcttctatctcangatgaagggtgactactacagataccttgctgagttcaagactggagctgaagagaaggacgctgcttgagaacaccatgggtgccatacaaaggctgcccaggacatttgctttggctgaacttgcctccacctcaccctattagggctgggactgggcactcaacttctccaggggtccaccatgagattcccaaattcacccaattgggcctgcagttcttggaaaagccaggctttttgacaaaggcctttccggaaactgggaacccgtggggggaggatcccttaagggaacaggccttttaatttggaagccccccttctggaataactttgacccccttgg

SEQ ID NO: 74107 - DNA, 806 bp, Zea mays
  misc_feature: Ceres CLONE 1558451
  misc_feature: Encodes the peptide sequence at SEQ ID NO. 74108
  misc_feature (710)..(710): n is a, c, t, g, unknown, or other
ctggagctccccgcggtggcggccgctctagaactagtggatcccccgggctgcaggaattcgtctcacccctagaaaaaagagctgcagccgccgccgccgcttctgtgacagctgcctatgctgtaattactgccacagatgagaaaaccagagatattgttgctacagatgattttgatatcaagagagctcaacctgcaagtaattccaaaaagtttgttgctgaaattgatgtacttaatggagagaatggtaaactagcggctagattggcagaggttcgcgatgaaaactcaaaactaaaggataaattagacatgacaaacttgtcatatggtgaattagcaaaggaacttaaatcagttcaagatcaactagcagcagagggttcaagatgccagaagcttgagtcccaaattgctgctgcacggaagagactggaatctgctggttctttggagaatgaactagaagtattgcatcaacatatatctcaggtggaggaaaccattgcaactactcagagaagaaaatctgggggtgtttggaagtgggtgggcgagttaaatacagaggtctctgacgatgaatagtaagtcctatctgcagcatgcttggatggaacaatgctttatgtactcaggggttccgctacagttgtagctttatatcttctatttcgcacgacctttgtggtcagaaactgntgaaatagagtttgactcatgaattgtctagagcacagtagcacactgcatcatgctgttgctaagtggactctgtttcaaaatggaaagtcgttt

SEQ ID NO: 74108 - protein, 197 aa, Zea mays
  misc_feature: Ceres CLONE 1558451
GAPRGGGRSRTSGSPGLQEFVSPLEKRAAAAAAASVTAAYAVITATDEKTRDIVATDDFDIKRAQPASNSKKFVAEIDVLNGENGKLAARLAEVRDENSKLKDKLDMTNLSYGELAKELKSVQDQLAAEGSRCQKLESQIAAARKRLESAGSLENELEVLHQHISQVEETIATTQRRKSGGVWKWVGELNTEVSDDE

SEQ ID NO: 74109 - DNA, 801 bp, Zea mays
  misc_feature: Ceres CLONE 1558453
  misc_feature (692)..(692): n is a, c, t, g, unknown, or other
  misc_feature (702)..(702): n is a, c, t, g, unknown, or other
  misc_feature (731)..(731): n is a, c, t, g, unknown, or other
ctggagctcaccgcggtggcggccgctctagaactagtggatcccccgggctgcaggaattcgtctcacccctagaaaaactactgttgccgctgctgctcctctcctcccatctgaccacagcgcgccctcccatcctatccctctgagccccgtcgtccaaccactttccttcctctgcgtgctcctcccgagcgcccgtcgctccacccgccctgcctccaccagcacaacgcaagggatctctggtcctcgagccctggttcgtccccctccgattcccctctggtctcgccgagcctggcgaccagggagagatggggaagaaccaggcgtacaaggcaatgcagtgggcgcggctggggccctcgtccgacgcgctgggcaccgccgacgccctcgaagacggcatggtcggtccccttcctctcccctaggagatctctgtttcccatctgcacttccgagttccaggcttccaaccgctgtggaattttggctaccatcccactttcgctttgggtgaaagataaagaaaaagaactttggctaatgagggtcgtcgcatgaattcagtgagaacacaaagaatgtgctcttgtcatgtgcattcatacacttggaaaaagaaggagttcatcaagcagtttggctgagatttcatcaataaaccaacgaaattttgttattcnggtccagcangggttctgagatttatcagggaaacattnggtaaaggcacttgcgaaaacatttttggtgctagaaaacttcttgtcgtggattacgacttttgctacc

SEQ ID NO: 74110 - DNA, 1477 bp, Zea mays
  misc_feature: Ceres CLONE 1558456
  misc_feature: Encodes the peptide sequence at SEQ ID NO. 74111
agcactacccagtacccagtagtcagtaaccacatctcctcccccctctcctgcaaagacaaggccgctgtccatggccgtccaggcgcagcacctactcaaccccgccttcctgccccacgacatggggcacgccttcagggcgctggagggcgccacggtcggcggcggcggcggctccgcgttcctggaagagctcggcttcggcgggtgcgcgccggcgccggcgcccatcgaggtcgccgcgtttggcgacacccagccgcgcagcgagctcacctgcaacggcggcggcggcggcgacaacagcaacgtgtttctcccgaggaagcgtgcacgcgtcgcgcccgggttcctggatgatgcccaccagcaggggttggttctgcccctgccggtgccggtgccggtgccgcagggccaggtgttcgccggcgacgtgcagagcagggagggagggtgcggcgcggcgtccaccagcggtcgggcggcggccaccaccaacggcgtcctgtcgctgctctaccgccagggcatggagatcgacgcgctggtgcggctcgagaccgagaggatgcgtgcggggctgcaggaggcgcggcggaggcacgcgcgcgcggtggcggcggccgtggagcgcgccgcggcggggcggctgcggctggcggaggccgagctggggcacgcccgccgccgcaacgccgagctggaggagaggctccggcagctggccgccgaggggcaggcgtggctgggcgtcgcccggagccacgaggccgtcgccgccgggctccgcgccacgctggaccagctgatgctgcagcagcagcccggcgtcgaggcggaggacgcgcggtcctgctgcttcgagacctccccgccgggccccgtcgccgacgactgcgacgccgcgtcccggggctcctcgccgccgtcgtgcaagtcctgcggaggcggcgacgcgtccgtgctgctgctcccgtgccgccacctctgcctgtgccgcgcgtgcgaggccgccgccgaggcgtgccccgtctgcggcgctagcaagaacgcctcgctccaggtcctgctgtgacgaggcgggtgggccctgccggcgtgttggtcccgcgcggtggcggcactcgtcgtccaatgagatccgctggctcccggggccaggcggcgagctttgttgagtagtacatgtagagatgctccaagttgcagcatagtaggctaattttagacgcagttagctgtactactggtaattggcactaacttctgttctcccctcgaatatctttctggtaccttgtttctcagatgtgctagtagtatcttttctggggtagtgttggcttgttttgtattaatgaggagatcggctaaagcttagatacgaaaagctatggtattctactatacttggagcttccctcgacatgtattattgtttcagcgtgacgcctaaaaaaaaaaaaaaaaa

SEQ ID NO: 74111 - protein, 335 aa, Zea mays
  misc_feature: Ceres CLONE 1558456
MAVQAQHLLNPAFLPHDMGHAFRALEGATVGGGGGSAFLEELGFGGCAPAPAPIEVAAFGDTQPRSELTCNGGGGGDNSNVFLPRKRARVAPGFLDDAHQQGLVLPLPVPVPVPQGQVFAGDVQSREGGCGAASTSGRAAATTNGVLSLLYRQGMEIDALVRLETERMRAGLQEARRRHARAVAAAVERAAAGRLRLAEAELGHARRRNAELEERLRQLAAEGQAWLGVARSHEAVAAGLRATLDQLMLQQQPGVEAEDARSCCFETSPPGPVADDCDAASRGSSPPSCKSCGGGDASVLLLPCRHLCLCRACEAAAEACPVCGASKNASLQVLL

SEQ ID NO: 74112 - DNA, 751 bp, Zea mays
  misc_feature: Ceres CLONE 1558458
  misc_feature: Encodes the peptide sequence at SEQ ID NO. 74113
  misc_feature (625)..(625): n is a, c, t, g, unknown, or other
ggagctcaccgcggtggcggccgctctagaactagtggatcccccgggctgcaggaattcgtctcacccctagaaaaagaattcattccacccccgtctcctccgatcggacaggaccaccgggccagcagcggggcggatcgcgtcagcagccatggtgcaaggcctaccccacggtgaacgaggactacctcaaggcggtcgacaaggccaagcgtaagctccgcggcctcatcgccgagaagaattgggccccgctcatgctccgcctcgcatggcactccgcgggcaccttcgatgtggccacacaaaaccgggggccccttcggcaccatgaagaaccccgccgagcatgcgcacggagccaacgccggactggaaattgccatcaggctgctagagcccatcaaggagcagttccccatcctatcctacgctgacttctaccagcttgctggagtcgtggcagtcgatgctaccggcggaactgatgtcccccttcaccctgagacgcaagacaagcctgagcctccaccggtaagaccgcatgcctgatgccaccccaaagtatctgatcacctccaggcacgttttctccaccccacaatgggtttgaaccacccangaaaattgttggccctttactgggtgggcaacccctggggaaaatggccccaagggaaagggggtgggattttcaggagaagcctggaaagcgcgaaacccctttttttcttttgggaaaaaacca

SEQ ID NO: 74113 - protein, 85 aa, Zea mays
  misc_feature: Ceres CLONE 1558458
  misc_feature: SWISSPROT Homolog: EC 1.11.1.11 L-ascorbate peroxidase
MWPHKTGGPFGTMKNPAEHAHGANAGLEIAIRLLEPIKEQFPILSYADFYQLAGVVAVDATGGTDVPLHPETQDKPEPPPVRPHA

SEQ ID NO: 74114 - DNA, 791 bp, Zea mays
  misc_feature: Ceres CLONE 1558461
  misc_feature: Encodes the peptide sequence at SEQ ID NO. 74115
  misc_feature (673)..(673): n is a, c, t, g, unknown, or other
  misc_feature (674)..(674): n is a, c, t, g, unknown, or other
ggagctccccgcggtggcggccgctctagaactagtggatcccccgggctgcaggaattcgtctcacccctagaaaaacttgttcatcttcgatctcctccatctcccttcatcctctctctcgctgtttgaggagaactgcctgcccctgctccctcttccgctcctccccgcgccccgctcgccatccccagacttcatttcaggccgggatggacgactacgcccgggagatgatggagctcaagacgctcgtcacccgcaccctcgagaagaagggcgtcctcgccaagattagggctgagctaagagcaagcgtgtttgaagccattgaagaggaggatcgggtggagaatgatgatggaggcaaccctgctttgcttggtagctgtaatgaccgagctaagcaactgcatgcttcaccttcaggtaggttactaactgcacttgtatgcgaatacttggagtgggcgcaactaagtcacacaatgaaagtttacttgccagagtgtaacctgcccaaggacttctggaagaatgaactgaaagacttctctaacaaaagtggagctgaagggagcacgagtgctgagagtggtccaatgcttttagatgttctcgaaagttatctgaaatatgagaatttgtctcaaacaatgatgggcggcagganngatgatgagtgcagaatctgatccatcactaaatgttgaacatcggaagcatgaggaggcaccattatcgtcagctgggaaacctgcctcctatggggagcccatctgctcatcgca

SEQ ID NO: 74115 - protein, 160 aa, Zea mays
  misc_feature: Ceres CLONE 1558461
  misc_feature (154)..(154): Xaa is any aa, unknown, or other
MDDYAREMMELKTLVTRTLEKKGVLAKIRAELRASVFEAIEEEDRVENDDGGNPALLGSCNDRAKQLHASPSGRLLTALVCEYLEWAQLSHTMKVYLPECNLPKDFWKNELKDFSNKSGAEGSTSAESGPMLLDVLESYLKYENLSQTMMGGRXDDECRI

SEQ ID NO: 74116 - DNA, 789 bp, Zea mays
  misc_feature: Ceres CLONE 1558462
  misc_feature: Encodes the peptide sequence at SEQ ID NO. 74117
ctccccgcggtggcggccgctctagaactagtggatcccccgggctgcaggaattcgtctcacccctagaaaaacagttcgtggagtggagtcaccacagaatcaaagaaaagctttcccccgatcctctcgcggacaccagcgatgggttcccgctacgaggtggaggtcaccgtcggctccgcccgggacctcaagaacgtcaactggcgcaacggcgacctcaagccctacgccgtggtgtggatcgactccggcagcaagtgctcgacccgcgtcgacctcgacaacggcgagagcccggcgtgggacgagaagctgctcgtcccgctcccgcccacctcccgcctcgacgacgccgtcctctacgtcgacgtcgtccacgccaacgccgcccagggcgtcaagccgctcgtcggctccgcgcgcctcccgctccgcgacgtcctcgacgacgccgggggtcgggggcaaggcctcgcgcagcctccgcctcaagcgcccctcgggccgcccccacggccgcctcgacgtccgcgtcgccgtcaaggagccgtccaggtactacgaacccaacccttacccggcccccgcggcctacgccaacaccgggcggggggcaccccgtgaacccctacgggttcgtccgcctgctggctgcccggcgggcctactaccgggctccgggaaggcggataccggtttccggtggtggggcccccaccaaaagggtgggggggggggggggtttatagggggggccccgtggcaaatccccttttaaaccca

SEQ ID NO: 74117 - protein, 161 aa, Zea mays
  misc_feature: Ceres CLONE 1558462
  misc_feature (7)..(95): Pfam Name: C2 Pfam Description: C2 domain
MGSRYEVEVTVGSARDLKNVNWRNGDLKPYAVVWIDSGSKCSTRVDLDNGESPAWDEKLLVPLPPTSRLDDAVLYVDVVHANAAQGVKPLVGSARLPLRDVLDDAGGRGQGLAQPPPQAPLGPPPRPPRRPRRRQGAVQVLRTQPLPGPRGLRQHRAGGTP

SEQ ID NO: 74118 - DNA, 780 bp, Zea mays
  misc_feature: Ceres CLONE 1558464
  misc_feature: Encodes the peptide sequence at SEQ ID NO. 74119
  misc_feature (706)..(706): n is a, c, t, g, unknown, or other
ctccccgcggtggcggccgctctagaatagtggatcccccgggctgcaggaattcgtctcacccctagaaaaaaaatccaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacagctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcatggagcggcatcccgtggttcgaggccggcgcggacccgagcgccatcgcgcccttctccttcgggtcgctgctgggcacgcagctgctgctgatggggttgggtggagtcaaaaccgttgggtggacttcttcaacccggactcccagggccgtggagtgggccaccccgtgggtcccgcaccgcttgagaacttcgccaactttcaccgggcgagcagggctacccggggcggcaagtttcttcgacccgntcgggccccttggccggggaaccggtaaaagggaacggggtcctaacatccccccgaacgtccgaacaagcctt

SEQ ID NO: 74119 - protein, 216 aa, Zea mays
  misc_feature: Ceres CLONE 1558464
  misc_feature (54)..(193): Pfam Name: Chloroa_b-bind Pfam Description: Chlorophyll A-B binding protein
  misc_feature (192)..(192): Xaa is any aa, unknown, or other
MALAPTSAAVLKTPFLGARRALAKPAPRRALVIAAAAAAKKSWIPAIKSDAEIVNPPWLDSSLPGDFGFDPLGLGKDPAFLKWYREAELIHGRWAMAAVLGIFVGQAWSGIPWFEAGADPSAIAPFSFGSLLGTQLLLMGLGGVKTVGWTSSTRTPRAVEWATPWVPHRLRTSPTFTGRAGLPGAASFFDPXGPLGRGTGKRERGPNIPPNVRTSL

SEQ ID NO: 74120 - DNA, 776 bp, Zea mays
  misc_feature: Ceres CLONE 1558467
  misc_feature: Translation starting site: 161
ctggagctcaccgcggtggcggccgctctagaactagtggatcccccgggctgcaggaattcgtctcacccctagaaaaaacagtatttcatgtattcatcctcttcctctccacagaaaacgagcgcaagcacatccaccgcaaagagcgtacaggatcatggccctgtcctccacaccctctgccggcaaggatctgaacgtcccgtcgtctcgcttcggccaggacggcgtgacgatccgcatcagagccgacaacgcaaatccagatgcaaactcctgtagcctgtggtaccgacccgaccgagtgctctacctgggatggctgtccggcgcgcccccaagctacatgacgggcgagttacagggcgatctacggctgggacacagataggttgtcagccgacccagagaccttagccaataacgggtactggacgtcatccactcgcgatgagccatgctgggcacgttgggatgcgtgttcccggagctgctattccgtcacgacgtcatattcgaccagtcttctggctcaacgccgggacggaaatcctcatcgagcgtgggctagactatctggcgaacacgaggctgatcccgcgggaaggatcatgcctgctgggcattccagggatgctcatggtagcatcgaaggggtatcgttgcccgccagtcccctcggaatggtgtctacctgctctaccaagtcgaaaatgagaacaggtcgcctttgccatttacggtgaagcctgcgggtacccaaaggtagatct

SEQ ID NO: 74121 - DNA, 824 bp, Zea mays
  misc_feature: Ceres CLONE 1558470
  misc_feature: SWISSPROT Homolog: EC 1.14.17.4 Aminocyclopropanecarboxylate oxidase
  misc_feature (809)..(809): n is a, c, t, g, unknown, or other
acagaagaagaagcagccctccaactagtggatcccccgggctgcgtgattcgtctcacccctagaaaaagcgtgtgcatatctgctccgctctccattttggcccaaccgagcgcaaacctctcacattttgtccgtcctgtccttgtccacacggcacacgccgccgccgggggatacgagaggaggggaccggcctcttcgacggatacgaacgggagggtgctgacagggccgaaaacggggcgggcatagccaatggctgcgaggagcggggactcttcgggctcgggaacgtcggcatcacgctggagctgctcgagcgcgccgagaaggtgtgctctgactgctaccgcctccgggagggcggggtcttggcgtcggagccagtgcactcgatggaagcgctcgtcgactccgaactgcgcatacagggtgcggcgcacgtgtacgacctggtacgggaggacatcttctacgtacactacggatgcccgtgggctttcgaaccccccgggcgtttacggcgttcatgcgcctagtacaccggccttccggaagatagttccacaagccctctgatggaaggcgcacggaactttagccggggccccccggggggggacccaacaaaaggcaaacaggggccctgacgctagggcgggaaagggacaccctccttgggcgaacaaaggtgggggaaccaaaccctgcctgggaacccgagggccccgagaacataattcctggaggccgtgggagcggaagttgaatcctttataccaggggggagctgttaaattttagantgattacccagtgaa

SEQ ID NO: 74122 - DNA, 786 bp, Zea mays
  misc_feature: Ceres CLONE 1558472
tggagctcaccgcggtggcggccgctctagaactagtggatcccccgggctgcaggaattcgtctcacccctagaaaaaatgacatgtcagcatcatcagctaagaactagtcttcctcgccacaagggaatgcaaaacaagacacctcaagtgctgttctcataagcttccctctcgttctgtgcctcgtcctctgatcagttccaccacgctaaatctagacgcaaacggagctacacaaaccgccacctgaaaataccgttctaatcgctgcgttgactcgaagttgggtcgacacatattatgatctctacaagaaatgccagtcgcttcatgatggacgacatatgcctacgtatgtggccaatgtctgctcgtgatgcgctttctctggatgtcatgtgattaataaccagctactacgtgaagtccatataccagcgccaaactactgtctgacagaggtaggtgatttgtcaacttgtcgcatttcttatatactcaacattccaaaagccccttcgtgaatcgtgacatccctcaaagatcgcgactgtagatcatctgaacttatagaaaaaaggtacggcaccacgtgtcaagaactaatgtcagagcatgcggtcggttgacccatcaaatgatccagcccagtctacccaagaagattgggccgccagcataaagagcaaatggcttaaaaaaatcagggactggaagcaacctaggtggttgcctccggaaacctttttggccctatatgggaaacggggtagaaatgggcc

SEQ ID NO: 74123 - DNA, 808 bp, Zea mays
  misc_feature: Ceres CLONE 1558474
  misc_feature: Encodes the peptide sequence at SEQ ID NO. 74124
ggagctccccgcggtggcggccgctctagaactagtggatcccccgggctgcaggaattcgtctcacccctagaaaaagcgctcgtgctccgcccaggcccctttcctccaccgcgggcgcaaaccctaaccctacagccgctcgccccgcggcgcctgccaatggcgccccccgtgtgagtgtgtgtgagaggcagagacctagaggccgctacccggggaggagagggtagggagagggagaggctgatagatgtataagcaggggggagcgggggtaggggctggtctggaccggaaacggatcagcgacgcgctagacaagcaccttgagaaggcggtcgcatcgccgtccacatcgagggggtcagcgggcagcggcggtgtgcgcgaccaccaccgcctcatcgtgccgtcctccgtgtcgtccatccccaagggccactgctccgtaagggagtctgattctgatagtgaagcatcagatgttagtggctctgatggaaaaaaacacctcgtggatttcatggtattgcaaccttaggaggaaatgagttcttctgtgaaaccaatgatgacctacatcaagaacgcgttcccccttttgtggccccagccaagcaaagtcccttattaagaatatgccccctggacccattttaaggaaattgaatccccccaaagggggatgggtgccccctgaggaaaaaaatttgcccctttataaaaccaccctccaaaaaaaccctttatttggcctttttccaaggccccataaacctttctggcccacgtaagagggtgggcg

SEQ ID NO: 74124 - protein, 96 aa, Zea mays
  misc_feature: Ceres CLONE 1558474
MYKQGGAGVGAGLDRKRISDALDKHLEKAVASPSTSRGSAGSGGVRDHHRLIVPSSVSSIPKGHCSVRESDSDSEASDVSGSDGKKHLVDFMVLQP

SEQ ID NO: 74125 - DNA, 841 bp, Zea mays
  misc_feature: Ceres CLONE 1558477
  misc_feature: Encodes the peptide sequence at SEQ ID NO. 74126
ctggagctccccgcggtggcggccgctctagaatagtggatcccccgggctgcaggaattcgtctcacccctagaaaaacccgcgcgcgcgctctctctttcctcgccttcgccgccggcgacgagcttgagctcgagctggttcctcgtatagaagacgacggccgcggtatggagcccatgaacgtagacaacggcggcagcggtggccttgacgcgcagatcgaacagctgatgcagtgccgcccgctcgccgagcaagaggttaaggcactgtgcgagaaggccaaggagatattgatggaggaaagcaacgttcagcctgtcaagagtccagtgacaatatgtggtgatatacatggacaattccacgatcttgtagagcttttccgaattggcgggaagtgtccagacaccaattacttatttatgggagattatgtagatcgtggctactattctgttgagactgtcactatgctagtagcactaaaagtgaggtatccacatcgaattacaatccttcgtggaaaccacgagagtcggcagatcacacaggtgtatggattctacgacgaatgcctacgaaagtatggcaatgcaaatgtatggaagacatttacggatctttttgattattttcctctgacagctctggtggaatctgagattgtctggccttcatggtggtctatctccatcaattgaaaatccttgatagtgtgcgcagctttagatcgagtcccaagaagttccccatgaaggaccctatgtgcgatctctttatggtcagatccagacgaccggatgtggtttggggcatcctccccctcgcggtgcc

SEQ ID NO: 74126 - protein, 178 aa, Zea mays
  misc_feature: Ceres CLONE 1558477
  misc_feature (54)..(178): Pfam Name: Metallophos Pfam Description: Calcineurin-like phosphoesterase
  misc_feature: SWISSPROT Homolog: EC 3.1.3.16 Phosphoprotein phosphatase
MEPMNVDNGGSGGLDAQIEQLMQCRPLAEQEVKALCEKAKEILMEESNVQPVKSPVTICGDIHGQFHDLVELFRIGGKCPDTNYLFMGDYVDRGYYSVETVTMLVALKVRYPHRITILRGNHESRQITQVYGFYDECLRKYGNANVWKTFTDLFDYFPLTALVESEIVWPSWWSISIN

SEQ ID NO: 74127 - DNA, 827 bp, Zea mays
  misc_feature: Ceres CLONE 1558481
  misc_feature: Encodes the peptide sequence at SEQ ID NO. 74128
  misc_feature (527)..(527): n is a, c, t, g, unknown, or other
ctggagctcaccgcggtggcggccgctctagaactagtggatcccccgggctgcaggaattcgtctcacccctagaaaaagccggggctctccgccgccgacagcatcagccaccaggggactctccagtgctccaccctgctcaagacgaagaggccggcggcgcgccggtggatgccctgctcgctccttggcctccacccgtgggaggctggccgtccctcccccgccgtctactccagcctcgccgtcaacccggcgggagaggccgtcgtctcgtccgagcagaaggtctacgacgtcgtgctcaagcaggccgcattgctcaaacgccagctgcgcacgccggtcctcgacgccaggccccaggacatggacatgccacgcaacgggctcaaggaagcctacgaccgctgcggcgagatctgtgaggagtatgccaagacgttttacctcggaactatgttgatgacagaggagcggcgccgcgccatatgggccatctatgtgtgggtgtaggaggacangatgagcttgtagatgggccaaacgccaactacattacaccaacagctttggaccggtgggagaagagactttgaggatctgttcacgggacgtccttacgacatgcttgatgccgctctctctgataccatctcaaggttccccatagacattcagccattcagggacatgattgaggggatggaaggatgattcttaggaagacaagtataacaacttcgacgagttctaatgtactggctacatgttgctgggactgtcgggttaaatgaccgtaccttgtgatggcatccccaacc

SEQ ID NO: 74128 - protein, 114 aa, Zea mays
  misc_feature: Ceres CLONE 1558481
MPCSLLGLHPWEAGRPSPAVYSSLAVNPAGEAVVSSEQKVYDVVLKQAALLKRQLRTPVLDARPQDMDMPRNGLKEAYDRCGEICEEYAKTFYLGTMLMTEERRRAIWAIYVWV

SEQ ID NO: 74129 - DNA, 795 bp, Zea mays
  misc_feature: Ceres CLONE 1558482
  misc_feature: Encodes the peptide sequence at SEQ ID NO. 74130
ctcaccgcggtggcggccgctctagaactagtggatcccccgggctgcaggaattcgtctcacccctagaaaaaaaacgcatcatcctttccctcggatccgccggcaacgcgacccttgctgccccaatccctattagcatctatggctggcgcgcatgagtccctctctctggtgggcacgatgcgcggccacaacggcaaggtgacggcgatgctgaccccgatcgacagctcgccgttcatcgtctactcctcccaagacaggtccctgctggtgtgggacctgaccaagccggtccactcctccccggaatccgtgaccaccgacaactacagctgtggcttacgacgcctgtccgagacctcccgcttcgtccattatcctagacgtcatgtccgagcgccagttcgccctttccagatcctgagacggagatgtgaggcattggggactcatcacagggactagcacctgaccacgtggtagctgcaagctgaatgtactctacgatgacttcatctttggactaactgcaatgcgaatcagctcacaaggtaagaaactgtagaaattggtaaaggccacagttaatgaaaatcaccctctcagaagataaactaggtgttagggaaggggccaaaaacagttgagatctacgggaaaccggttctccccaataaaaatttaagtcccacctttttctttcacgattctttgggcccgccaccaattaaggggttggggatccctaggaaaattccaaaataccgcggcttaaaatctcaaaaaggg

SEQ ID NO: 74130 - protein, 108 aa, Zea mays
  misc_feature: Ceres CLONE 1558482
MAGAHESLSLVGTMRGHNGKVTAMLTPIDSSPFIVYSSQDRSLLVWDLTKPVHSSPESVTTDNYSCGLRRLSETSRFVHYPRRHVRAPVRPFQILRRRCEALGTHHRD

SEQ ID NO: 74131 - DNA, 793 bp, Zea mays
  misc_feature: Ceres CLONE 1558483
  misc_feature: Encodes the peptide sequence at SEQ ID NO. 74132
ctggagctccccgcggtggcggccgctctagaactagtgggatccccgggctgcaggaattcgtctcacccctagaaaaaacccttcgcgtcgcccacgactcgtcgtacacccggtcttccctccgtcgccgatttcgttccccttcccctacccctgtcccgatcgcgcagctacggcgaaaccctagcgacgaattccccgccgaatcgaggattccaaggttccgaccgcgccgagcgcggggaccgcattccgggaacggctgatggtgacctgccgcaagatggcacgcgtcgacgtcgccgagctgaagcagcgcctggtgaagcggctgggccgggagcgggcggccaagtacttcgcacacctcaccaggctgctgaatctgaagctcaccaaggtagagttcgacaggctctgcttcgccaccatcggcaaggacaacatcgcgctgcacaacgcgctcattagggggatcataggcaatgctctgtcgggagtgcctccgcccagccggcaggcggtgacggggcagtcgggcaccaccaccgccccgagcgggcagtgcgtgggcgtcgcgctgcccgtggtggggaatgtggggggcagtggtcgattcgggtgatggtgagctggcgagggagcttggggcgccagttggggaaaggtgtgtccgtggaaatggggggagggaaggttaaacaagtcagggtctgtttccgtggtgtccaagagccggaaccccgattacacagacccttggggggatttcagccactgggggggcaag

SEQ ID NO: 74132 - protein, 119 aa, Zea mays
  misc_feature: Ceres CLONE 1558483
MVTCRKMARVDVAELKQRLVKRLGRERAAKYFAHLTRLLNLKLTKVEFDRLCFATIGKDNIALHNALIRGIIGNALSGVPPPSRQAVTGQSGTTTAPSGQCVGVALPVVGNVGGSGRFG

SEQ ID NO: 74133 - DNA, 735 bp, Zea mays
  misc_feature: Ceres CLONE 1558485
  misc_feature (623)..(623): n is a, c, t, g, unknown, or other
ctggagctccccgcggtggcggccgctctagaactagtggatcccccgggctgcaggaattcgtctcacccctagaaaaaaaaccaagagctccagttcctcttcctcacgcctctctgccaatccctcctccggccctctctccaggctccagcgccttctccggcgacgccggcaccgcccctagacgcggcccgaatctagggttcccctttcccgccgttggcggccggatcgctcccagaggagcctccgcgatgctgccgtgcgcgaggtcggtgcttcggaggagggggctggcgtcttctctcctgctgatgtgcggtgggggagggccaatgctccaccggcacggggggagctggtcgccaaatgccaggaagtgcaaacaaaggtgggggcgtgcctccgggggcgggggggcccgggtttcaagcgcggggcccgggggggggctttttgggaaaaccccccttttttttggccccggggggggaattgggtcccaaaaaaaaaaaacagggggtgttttttcccgggggggggggccccccccaggaaaaaagggggggggggaattttcccccccagggggtcccaaaaaaaaaaaaaaaccccccccnaaaagggggggggcccccccccaaaaaaaaaaaaaattttccccccgcgggggcccccacccggggggaacttcctcccaaaaaaaaaattttttggggggggggggggggg

SEQ ID NO: 74134 - DNA, 721 bp, Zea mays
  misc_feature: Ceres CLONE 1558486
  misc_feature (557)..(557): n is a, c, t, g, unknown, or other
  misc_feature (650)..(650): n is a, c, t, g, unknown, or other
  misc_feature (651)..(651): n is a, c, t, g, unknown, or other
  misc_feature (655)..(655): n is a, c, t, g, unknown, or other
tgagctcccgcggtggcggccgctctgaactagtggatcccccgggctgcagaattcgtctcacccctagaaaaaacgccacgctctccaacgccacagcttgcgcccgcaatggcactctgtctccgcctcctcgtcctccaccaccgccgtcacggcgctccccaggaatgggcagcgggcgtcgtcctccttcctcgcgcagacctgctaacaggcagctgcctgcgtcgtcgcgtgccgcgcggcgaacccacagtcgatctgttcccggaagcacccccccccttgggttgaagggagacctcccggggaaatttgggtttgaacccggggggccccgggatcttaacccagaaaaccccccggggggaaaaatcccaaggggggaaaattggggcccatccccccgggggggaaaatttctcccccccgggggggggatttttttttccccgcggggggtttctccaacaaaaaaaaaaagggggggggccccaaaaaaaaaaccccccttttttggtgggaaaccaccccccccggggggggaaaaaaantttttttttttttttttttgaaaaaaaaacaacccccacccccttttttttttttttttatgaaagagaagagcacccctccccccccccccnncggnggggggggggagaaaaaaggaacacccccccccccggggggggaaaaaaataataataaaaacaat

SEQ ID NO: 74135 - DNA, 787 bp, Zea mays
  misc_feature: Ceres CLONE 1558488
  misc_feature: Encodes the peptide sequence at SEQ ID NO. 74136
  misc_feature (663)..(663): n is a, c, t, g, unknown, or other
ctccccgcggtggcggccgctctagaactagtggatcccccgggctgcaggaattcgtctcacccctagaaaaagtccttaaccgaaatggcggaatcggcctcgcagagggatagccggaggcccagaagcgtccggaaagacagcgcacgaagcaatctttccctttccccaagatgggattcggcttcgttcgtctcgccgcccgcgccgcggtttctcgccggggcatgacgccagcaacctccgcccgccgcgcgctcgccccacccgccgtgccggcggagccccgctgcgggccccactggctcgtggccgcccgcggccacgtgggccactcgcaccaccgcggcggggaggacgagggcgagacatccgagaggatctttcgtctgggactcgccgctgacgtcgtactcaccgcggggaaggccgtcacaggctatctctccggcagcaccgccatcgccgccgatgccgcccactccctctcggacatagtgcttagcggggtggctctgctgtcttacagggcggccaaggctcccagagacaaggaacatccctatgggcatggaaagtttgaaagtttaggagctcttggaatttcaagtatgctgttggttacttcaggtgggattgcatggcatgcttttgaagttnctcaaggagttatgtcttctgctcctgatatattggcaatacattgcatgcacaccatgaccatggtagcagtgggcatcatcatggaatagatttggaaacatccagttcttgcattggagct

SEQ ID NO: 74136 - protein, 192 aa, Zea mays
  misc_feature: Ceres CLONE 1558488
  misc_feature (163)..(163): Xaa is any aa, unknown, or other
MGFGFVRLAARAAVSRRGMTPATSARRALAPPAVPAEPRCGPHWLVAARGHVGHSHHRGGEDEGETSERIFRLGLAADVVLTAGKAVTGYLSGSTAIAADAAHSLSDIVLSGVALLSYRAAKAPRDKEHPYGHGKFESLGALGISSMLLVTSGGIAWHAFEVXQGVMSSAPDILAIHCMHTMTMVAVGIIME

SEQ ID NO: 74137 - DNA, 748 bp, Zea mays
  misc_feature: Ceres CLONE 1558490
  misc_feature: Encodes the peptide sequence at SEQ ID NO. 74138
ctccccgcggtggcggccgctctagaactagtggatcccccgggctgcaggaattcgtctcacccctagaaaaaaaacccaatccatccaaacccatttccctcgctcccatcccgtcccgacccttgtctcttccgcttccccccgaccccgcgcgccgcggaccatcagccatgtcgggctcccacctctccaccgcctggtcctcctcggcgctcgccagcagggcctccaccacccgacggcgctcccccccgcgctcgggtctcctggtgcggtgttccctccgtgagctccgcacccgcatcgactccgtcaggaacacgcagaagatcacggaggccatgaagctggtggacgccgacaaggtccggcgcgcgcaggaggccgtcgtctcatctcgccctttctcggaggcgctggtggaggtgctctacaacatgaaccaggagatccagacggaggacatcgacctggccctcaactgcacccgccacataaagaatgtggccctcgtggtcctgaccggcgagcgcggcctctgcgggagcttcaacgacaacgtgctcaagaatgcggaaacccgcatcgatgaactcaagcagctgggcctccagtacacggtcatctgcgtgggggaagaaaggcaacgcctacttacagcgccgccccatacatcccgttggagcgcgatctagatggtgagcagcgtgcccagccgtcaaggactctcatgaccatctgcgaa

SEQ ID NO: 74138 - protein, 174 aa, Zea mays
  misc_feature: Ceres CLONE 1558490
  misc_feature (36)..(174): Pfam Name: ATP-synt Pfam Description: ATP synthase
  misc_feature: SWISSPROT Homolog: EC 3.6.3.14 H(+)-transporting two-sector ATPase
MSGSHLSTAWSSSALASRASTTRRRSPPRSGLLVRCSLRELRTRIDSVRNTQKITEAMKLVDADKVRRAQEAVVSSRPFSEALVEVLYNMNQEIQTEDIDLALNCTRHIKNVALVVLTGERGLCGSFNDNVLKNAETRIDELKQLGLQYTVICVGEERQRLLTAPPHTSRWSAI

SEQ ID NO: 74139 - DNA, 808 bp, Zea mays
  misc_feature: Ceres CLONE 1558491
  misc_feature: Encodes the peptide sequence at SEQ ID NO. 74140
  misc_feature (636)..(636): n is a, c, t, g, unknown, or other
  misc_feature (771)..(771): n is a, c, t, g, unknown, or other
ctccccgcggtggcggccgctctagaactagtggatcccccgggctgcaggaattcgtctcacccctagaaaaaaccgaaaccaagcaacccaatccaaaccagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgctccgcgcgcgccggcaccagctgctggacccgtcggcggagcacggcgtcactaagttctccgacctcacgccggcagagttccgccggacctacctcggcctccgcaagtcccggcgcgctctcctcagagaactcggggagtcggcgcacgaggcgcccgtgctccccaccgatggtctccccgacgatttcgactggagggaccacggcgccgtcggccccgtcaagaaccagggttcgtgcgggtcgtgctggtcgttcagcgcgtctggagcgctgganggtgcgcactacctcgcaactggcaagctggaggtgctttcggagcagcagttcgtcgactgtgaccacgagtgtgattcatcggagcctgattcatgtgattcggggttgccatgggtgggggctatgacgacngcattcagttatctccaggaaagccggtggggcctgg

SEQ ID NO: 74140 - protein, 228 aa, Zea mays
  misc_feature: Ceres CLONE 1558491
  misc_feature (48)..(104): Pfam Name: Inhibitor_I29 Pfam Description: Cathepsin propeptide inhibitor domain (I29)
  misc_feature (137)..(228): Pfam Name: Peptidase_C1 Pfam Description: Papain family cysteine protease
  misc_feature: SWISSPROT Homolog: EC 3.4.22.41 Cathepsin F
  misc_feature (171)..(171): Xaa is any aa, unknown, or other
MAHRVLLLLSLASAAAVAAAVDAEDPLIRQVVPGGDDNDLELNAESHFLSFVQRFGKSYKDADEHAYRLSVFKANLLRARRHQLLDPSAEHGVTKFSDLTPAEFRRTYLGLRKSRRALLRELGESAHEAPVLPTDGLPDDFDWRDHGAVGPVKNQGSCGSCWSFSASGALXGAHYLATGKLEVLSEQQFVDCDHECDSSEPDSCDSGLPWVGAMTTAFSYLQESRWGL

SEQ ID NO: 74141 - DNA, 775 bp, Zea mays
  misc_feature: Ceres CLONE 1558492
  misc_feature: Encodes the peptide sequence at SEQ ID NO. 74142
  misc_feature (608)..(608): n is a, c, t, g, unknown, or other
ggagctcaccgcggtggcggccgctctagaactagtggatcccccgggctgcaggaattcgtctcacccctagaaaaaatcggcatgcagtagcataccagacgatctgcaagctaagcgtagttccagtacagaagccagccatctctgttcattggttgaggaaatggccggacgtaaggcggcgatggtggtggagaagaacaagaaggtggtgctaaggaggcacgtcaccgggttccccacggaagaagacatggagatcacggtggacactatcgagctgggtgtgccagcggggctgacggccgtgctgatcaagaacctctacctgtcctgcgacccctggatgcgcggtcgcatgagcaagcatgaagacggcgccaccgtgccagcctcggactttgtcatcggagaggccatggtgaatttcggtgtgggcaaagtggtcggctcgacgcaccctgagttcaccgccggtgatcttgtctgggggctatgggtttggggaagaattacaccctcgtcacccagccggaatcgctgcacaagatcaaacacaccgagctgccgctctcctactacacgggagtttcttggcatgccangggctcactgcggaacgggggggttcacgcttgtcggcaggcccaagaaagggggacttcgtgtacgttctcggcgggcgttcgggcgccttcggccaagatcgtcgggcagcctagcaaaaaatcccgggtttgctaacgtgggtccggaaccgcccgctccccaa

SEQ ID NO: 74142 - protein, 203 aa, Zea mays
  misc_feature: Ceres CLONE 1558492
  misc_feature (148)..(148): Xaa is any aa, unknown, or other
MAGRKAAMVVEKNKKVVLRRHVTGFPTEEDMEITVDTIELGVPAGLTAVLIKNLYLSCDPWMRGRMSKHEDGATVPASDFVIGEAMVNFGVGKVVGSTHPEFTAGDLVWGLWVWGRITPSSPSRNRCTRSNTPSCRSPTTREFLGMPXAHCGTGGFTLVGRPKKGGLRVRSRRAFGRLRPRSSGSLAKNPGFANVGPEPPAPQ

SEQ ID NO: 74143 - DNA, 773 bp, Zea mays
  misc_feature: Ceres CLONE 1558493
ctggagctccccgcggtggcggccgctctagaactagtggatcccccgggctgcaggaattcgtctcacccctagaaaaaatcggcatgcagtagcataccaaacgatatttccgctgccgctgcccccgattgagccgccgccgcctcagattcgccgtcgccacctcagattcgccgccgccgccgccgatttggacgctgtcgccggcgattcagcctccgccgccctggatttggcctccgccgctcccgattcggcgctgccaccctgaaacagcgccgcccctttcccttcccctatgccctatgccctcttgctgcttctcacctaggcgacggggacgccttggatccttcgggcgcctggacgcctaggcgacgcctttaaaacaagggtcttctcggtattaaatatttcctgatgtacagtagctaccttgttaattcatgcctccagcatgattctccgttgtgctccatctgtttgttgcttgccttgcgcccttgttattctgccatttggttgaggatagattaatcctcaattgtctgacaattgttcacgtctaattcaggttttttcgggcatttgggtttgtcacgagatagctacttttgagaaagcagctggttttcaagggcactaatccagtatactgaatgccccaactggctctggaagctaaaaactccttgggatgggaagaagcatccccaaattattaccttccagaaacatatgggggggcctggcccatggccccaaaaacc

SEQ ID NO: 74144 - DNA, 826 bp, Zea mays
  misc_feature: Ceres CLONE 1558495
  misc_feature (725)..(725): n is a, c, t, g, unknown, or other
  misc_feature (810)..(810): n is a, c, t, g, unknown, or other
tccccgcggtggcggccgctctagaactagtggatcccccgggctgcaggaattcgtctcacccctagaaaaagtctcatcatctcatcgattcccatggtagaaccgcaaggaggggcagcagggcgccacggtcgggtggatgaccgtgccggcgttctgcgagtgggacgtttagaacggcgccgtgccagactactccatggacttctcctagatccaggagatgctgcacgctagaacaagcgcgagctctccgggaccagcctcggcggcgacgaggacctcctccagcagcagcagcagcagagtgcccagggtcagcctgtcaagtcacccgccgacgtccgttgcggaagaagacgaccaccaaccgctggcgggtacacgacgaatccccctacgggaaagaaaaaaatttcctgaaactaactccggaggctggtttccaaacccttgtaaaattgggcaacccttccggggggggttcccctggcccccttttcaaaaatattaaagcccccttttcccagggttttttttttttattttcccgcaggaaactcaaacctttttttaaagggggggggttttttcccaaaaattttttttttaccccgttgggaaattgaaaaaatacccccccggggaaaacccaaaaatctccttttccccccggggaaaaagaagttcctctgttttttttttgggggccccccccccgnggggtgggggtgtctttttggggggcccccctcccagaggagggtcttccccccttctccccgcgggggggcccccccctttctngaaaaaagtttccccc

SEQ ID NO: 74145 - DNA, 816 bp, Zea mays
  misc_feature: Ceres CLONE 1558496
  misc_feature: Translation starting site: 206
  misc_feature: SWISSPROT Homolog: EC 1.15.1.1 Superoxide dismutase
  misc_feature (777)..(777): n is a, c, t, g, unknown, or other
ctccccgcggtggcggccgctctagaactagtggatcccccgggctgcaggaattcgtctcacccctagaaaaaatcctcacttcaggtctgcagcccccaactacccccagcctcggaaggaaccttccagaagcgcaagactctaaaggccgtcgccttcccattcttcctcgccgcgggggtcgcctgagatcacataaacaatggtgaaggctgttgctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggtgtttatttttctttttctttggcttgcttatgtgatcagggtgtgtgctaagttaatatcagtcattgaactttctacttgttggtgaaatcaaggaccacactacaatcctgcgagcaaggagcatggggcaccagaagatgagaaccgccatgtctggtgatcttggaaacgtgacagctggagcagatggtgttgctaatatcaatgtcaccgacagccagatcccactgactgggccaaactcaatcattggcagagctgttgttgttcacgctgatcctgatgatcttgggaaagggtgggcacgagctcagcaagagcactggaaacgccgggtgggcgtgttgctttgtgggatcattggactccagggctggaaacgaatgccngacttgggggtgccctgaaaagtccgttctcctgccgtc

SEQ ID NO: 74146 - DNA, 831 bp, Zea mays
  misc_feature: Ceres CLONE 1558497
  misc_feature: Encodes the peptide sequence at SEQ ID NO. 74147
ggagctccccgcggtggcggccgctctagaactagtggatcccccgggctgcaggaattcgtctcacccctagagaaaatggcgaggcgacgaaaccctcgcgcggtccccaactcgaacctcagtcaggcggcgtgagggagggagagttcgaggaccgaggcggcgtctggcgagatgaaacttaacgtctagaccctcaagggcaccaacttctagatcgaggcgagccccgatgcgtcagttgctgacgtgtataggatcattgagaccactcagggtcagactacctaccgggcggaccaccaaatgcttatatagctagggaaaattctcaaggatgagaccactttggaaagcaacggagttgctgagaacagcttccttgttataatgttgtccaaggctaaggcatcgtccagtggagcttctaccactactgctgaaaaagctcctgcaactctggcccaacctgctgcccctgtgccccctgctgcatcagttgcaagaaacccaacccaggctcctgttgccccctgctgaaacgggacctccaagtggcccaacctcgggctgctcccacttgttacggttgcctgcacctgatgaatcctgatttgtaacagtcgggatgcttcaaaaccttgtatctggggaccagtctttaaacaaaactttcccaacaaattccttgaaatggggggggggggaactttgggaacccgtgtaccccttggtttcggggcccttcggggcttccatataaataacccctgaaaaaaaccttttgacactcccctgttttcctgggaaattcccggagaaaggggg

SEQ ID NO: 74147 - protein, 49 aa, Zea mays
  misc_feature: Ceres CLONE 1558497
MLSKAKASSSGASTTTAEKAPATLAQPAAPVPPAASVARNPTQAPVAPC

SEQ ID NO: 74148 - DNA, 783 bp, Zea mays
  misc_feature: Ceres CLONE 1558498
  misc_feature: Translation starting site: 141
  misc_feature (741)..(741): n is a, c, t, g, unknown, or other
ctggagctcaccgcggtggcggccgctctagaactagtggatcccccgggctgcaggaattcgtctcacccctagaaaaaactccacccacgcctccactacaccacacagagccgcagcagactcgcaagggaaaggagatggatcgtctgcccgagtcgacccggagcatgaggaagtacgcgtcggaggccggcgggcttcgcgcggcgcggcagggcccccacgggcggtcgctgacggcgcgcacggcgcacagcatgtccacgacggcgctgcgcaccaagtccaagtcggccgcgtcgctgctgcgcagggtgcccttcgcgccgctccgccccgtcctcgccaacctgcaggaggtgttcctcggcaccaagctcgccgtgctattccccgccgtgccgctcgccatcgccgcccagtgcgcgcacttcggccagggtgtgggtgtttacgctcagcctactcggcctcatccccctcgccgagcgtgtcagcttcctcaccgagcagatcgcgatatacaccggcccccaccgtgggcggcctcctctacgcgacgtgcggcaacgccacggagctcatcatcgcgctcttcgcgctcatggggggccagatcgaggtcgtcaagtgctcccctctcggcttcgtcctctcaatcctgctgctcgtgctcggcacgtccctcttctgcggcggcgtcgtcaacctcggctccgaccatgcgtacgacggacngcagcggacgtcagcacggcctcctcatcctcgggtgtgcgc

SEQ ID NO: 74149 - DNA, 770 bp, Zea mays
  misc_feature: Ceres CLONE 1558501
  misc_feature: Translation starting site: 141
  misc_feature: Pfam Name: SPC22 Pfam Description: Signal peptidase subunit
ctcaccgcggtggcggccgctctagaactagtggatcccccgggctgcaggaattcgtctcacccctagaaaaaaagcacttcccgaagaaaggaagacagagaacgaaacggcagtgaagtcgccggcgccgccgcgacatgaggaaggagggagtagcagcggcaggggaggtcctgcgatctcggctgctgtggcgcggtaagggaggaagcggagccgcgacaggatgcactcgtttgggcaccgcgccatacgcggtggcaacgtttgcggtcaccatactggccgctatgtgcttcgccgcctccttctccgacaattttaacaccatgacagccaccgcatccgtgaagatcttgaatataaactggttccagaaggaggccaacggccatgactaggtcagcatgacgctgaacatttcggctgacctttcatctctgttcacgtggaaccaaaacaggtatttgtttttgtggcagcagagtatgagactcgacaaaatgctttaaatcaagtttccctttgggatgggcattatacctgcaaaggagcatggccaagtttttgatccatacagcaaataagtaccgatttatttgaccagggaagcaatctaaaagggcaagggaattccacttggacaatgcactgggcaacattaagccgaaagactgggcaaaaagggttggagaattattataggtattgacaggggttattaagctttccctgaaccaagtaccagatggtctattttggaacct

SEQ ID NO: 74150 - DNA, 826 bp, Zea mays
  misc_feature: Ceres CLONE 1558502
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (309)..(309): n is a, c, t, g, unknown, or other
  misc_feature (319)..(319): n is a, c, t, g, unknown, or other
  misc_feature (405)..(405): n is a, c, t, g, unknown, or other
  misc_feature (427)..(427): n is a, c, t, g, unknown, or other
  misc_feature (428)..(428): n is a, c, t, g, unknown, or other
  misc_feature (436)..(436): n is a, c, t, g, unknown, or other
  misc_feature (478)..(478): n is a, c, t, g, unknown, or other
  misc_feature (480)..(480): n is a, c, t, g, unknown, or other
  misc_feature (498)..(498): n is a, c, t, g, unknown, or other
  misc_feature (529)..(529): n is a, c, t, g, unknown, or other
  misc_feature (683)..(683): n is a, c, t, g, unknown, or other
  misc_feature (696)..(696): n is a, c, t, g, unknown, or other
  misc_feature (707)..(707): n is a, c, t, g, unknown, or other
  misc_feature (798)..(798): n is a, c, t, g, unknown, or other
  misc_feature (815)..(815): n is a, c, t, g, unknown, or other
ggagctccccgcggtggcggccgctctagaactagtggatcccccgggctgcaggaattcgtctcacccctagaaaaaattctccgactgcctcgcactctcgcagacagcacgtggggggtgattctctctttcttctcttcctcagccgccaggaaggtggattcttttcgagctcttgcccagctgattataggtaggtacgtggctggatagagcctactgctggatagagcgtctcacggacgaggggnnnnnnntnnnnnnnnnnnnngggggggggggggggggggggagaaaaaaaaaaangggggggggngggggggggaaaaaaggaggagaaaaagaaaaagggggagggggggggaggaagggggaggggagggaggggggggggaggaaaanaaaaaagaaaaaaaaaaaaaannaaaaaaanaaaaaaaaaagaaggggagggaggggggggggggaggggggngnggggaggaagaaaaaaanaaaaaaaaaaagaaaaagaaaaagagagggngagggaggaaggaaaggaggagaggaggaagggagagaaaaaaaagagaaagaaggggagaagagggagagagagaaagaaagagaggaaaaagagggaagggggagaaggggagggagggaagggagagagaaggggagaaagagggggaggnagggagaggaggnggggagagagnaggaaggggggggggaggggagggggaggaagaggggggggggggaggggggggggggggaggggggagggaggaggggaggggggggggngggggggggggggaaanggggagaagag

SEQ ID NO: 74151 - DNA, 810 bp, Zea mays
  misc_feature: Ceres CLONE 1558504
  misc_feature: Encodes the peptide sequence at SEQ ID NO. 74152
  misc_feature (650)..(650): n is a, c, t, g, unknown, or other
ctccccgcggtggcggccgctctagaactagtggatcccccgggctgcaggaattcgtctcacccctagaaaaaaccaccgcagccgcagcacaatcgcctcgccttcccttccccaccagcccccgtctctctctctctctttctctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcccccggcggcgcgcccgccaacgtcgcctgcgccatcgccaagctcggcggctcctccgccttcgtcggcaagttcggcgacgacgagttcgggcacatgctggtgaacatcctgaagcagaacaacgtgaactcggaggggtgcctgttcgacaagcacgcgcggacggcgctggccttcgtgacgctcaagcacgacggggagcgcgagttcatgttctacaggaacccgagcgcggacatgctgctgacggaggcggagctggacctgggcctggtgcggcgcgccagggtgttccactacggctccatctcngctcatctccgagccgtgccgctcggcgcacatggccgccatgcgcgcagccaagggccgcggggcgtgctctggctctaacgacccaaacgtgcggctccccgctcttgggcgtcgccccgacgccgcacggcgagggcatcctccagcatcttggaaa

SEQ ID NO: 74152 - protein, 178 aa, Zea mays
  misc_feature: Ceres CLONE 1558504
  misc_feature: SWISSPROT Homolog: EC 2.7.1.4 Fructokinase
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISAHLRAVPLGAHGRHARSQGPRGVLWL

SEQ ID NO: 74153 - DNA, 813 bp, Zea mays
  misc_feature: Ceres CLONE 1558505
  misc_feature: Encodes the peptide sequence at SEQ ID NO. 74154
  misc_feature (561)..(561): n is a, c, t, g, unknown, or other
ggagctccccgcggtggcggccgctctagaactagtggatcccccgggctgcaggaattcgtctcacccctagaaaaaatggaagaagctgacagtctctgctttggcctgcctgtttgtttctatctctcagactagagtagctgttattttactttagtatgtctctctcacaatatcagagacttcttttacttgaatactggtgggtgcctcgcgtctttgccgcatcagagaccgcgcccgcctaccactcgtttccgtgctcgcgcgcccaaaccttagctcctatgatgacgccgggacgcgagatgaactcgagggcactgtccaccgccggcaactccgggctgtcggtgaggaacaccggagctgagaaggaccctgacaagccgaagagggctccgagcgcgttcttcgtcttcatggaggagttcaggaaggactacgtggagaagcaccccaatgtgaagtcagtctccctgattggcaaagctggtggtgaccagtggcagtcactgtctgatgccgagaaggctccctacgtgtctaaggcagagnagctcagagctgagtgaccagagggatttggcgcctgacaagcaccaggaggtctggagaccccacgggcggctgggtgattccggacaagtccaaagtccgaaggggaacgactatgaacgaggaaggggggcccaactgattgtatggaccggatgaaacctttttttccaaaggggtttggcccttcggggaaaaaaaattcccgttcggttggtcgggccccaaaacccgggggtttttttcaaaaaa

SEQ ID NO: 74154 - protein, 95 aa, Zea mays
  misc_feature: Ceres CLONE 1558505
  misc_feature (35)..(95): Pfam Name: HMG_box Pfam Description: HMG (high mobility group) box
  misc_feature (91)..(91): Xaa is any aa, unknown, or other
MMTPGREMNSRALSTAGNSGLSVRNTGAEKDPDKPKRAPSAFFVFMEEFRKDYVEKHPNVKSVSLIGKAGGDQWQSLSDAEKAPYVSKAEXLRAE

SEQ ID NO: 74155 - DNA, 808 bp, Zea mays
  misc_feature: Ceres CLONE 1558506
  misc_feature: Translation starting site: 206
  misc_feature (463)..(463): n is a, c, t, g, unknown, or other
ctccccgcggtggcggccgctctagaactagtggatcccccgggctgcaggaattcgtctcacccctagaaaaaatcagacaagagacacacacacaccacacgcacagcctcggcctccgcagctgcaggcgcctgctgctcttcgacaagaccccaagaactcgccaacctaacctagaccagccacccttccttctgccacaatgctggccgccgccgcctccgtcaagccctccaccaccgcggccgccgccgcggccacctgcaaggcgggcttcaagccccttcacctccctcccctccccgccgccggttccaggccgctgtccctctccgtctccgcgcgtccgctgtaccaccaagaccatgtcctcgcgacaaccgtggcgaatggcggcggcgggccgcagcgaccgcgccgcgtcccccgcgcctccgtccgccacagcggacggcgcccnggccggtggtggaggtcgccgcgccggcggagaccgcgcgccgcgccaagatcggggtgtacttcgccacgtggtgggcgctgaacgtgatcttcaacatctacaacaagaaggtgctgaacgcgttcccgtacccgtggctcacgtcgacgctgtccctcgccgccggctccgccatcatgctcgcgtcctgagccaccaggatcgccgaggcgccccagacggacctcgacttctggaaggcgctcactcccgttgcgatcgcgcacacgatcgggcacgtcgcggcgacggtgagcatgcccaaagttggcggtgtcgttcaccacatcatcaagagcgggg

SEQ ID NO: 74156 - DNA, 778 bp, Zea mays
  misc_feature: Ceres CLONE 1558507
  misc_feature: Encodes the peptide sequence at SEQ ID NO. 74157
  misc_feature (170)..(170): n is a, c, t, g, unknown, or other
  misc_feature (333)..(333): n is a, c, t, g, unknown, or other
ctggagctcaccgcggtggcggccgctctagaactagtggatcccccgggctgcaggaattcgtctcacccctagaaaaatcgcctccgtggccaccaccttgctccctctcgtcacaaggccatgcgcctactccctgccaagaaccatcctcgccgccagcggcctcngtaccctcgcctcatctcctgcgcggacgacggctccgccaaggcccagctgtcggatggcgatggaggccacaacaaggccggtagcggcggcaggcccatagtcaccgacctgttgtcgtgcggcgagccccgccctccatcacacgcgctgccagccttnccgctgctgccacgccgacgccggcgtcccgacgctgccggtcgcaacttcacgtgccccgacccaggcgagccgctcccgaacgcgcagccagcgcacgggggccgccggcgcggaacagcgtcgccaaggtacccgcgcgccggtggcgcctgattaaaggcgccttccggagtcgggaccccccgcaagcttcttacccaggaggggccaaaattccaattggggccttaatgggaacccggggggggtacccgggaaggggggggggggggcccggaaactgtcccacatggccaaaaatcccccacttctcccggggggggctgttttttttccccctttttacaccgggggggcaaaaaaccttaaaaatttttttttaaaaaaaccccttcccgggggggaaagggctcccccgggggggaaacccccgggggtgttc

SEQ ID NO: 74157 - protein, 121 aa, Zea mays
  misc_feature: Ceres CLONE 1558507
  misc_feature (16)..(16): Xaa is any aa, unknown, or other
  misc_feature (70)..(70): Xaa is any aa, unknown, or other
MRLLPAKNHPRRQRPXYPRLISCADDGSAKAQLSDGDGGHNKAGSGGRPIVTDLLSCGEPRPPSHALPAXPLLPRRRRRPDAAGRNFTCPDPGEPLPNAQPAHGGRRRGTASPRYPRAGGA

SEQ ID NO: 74158 - DNA, 734 bp, Zea mays
  misc_feature: Ceres CLONE 1558508
  misc_feature: Encodes the peptide sequence at SEQ ID NO. 74159
  misc_feature (358)..(358): n is a, c, t, g, unknown, or other
ctggagctccccgcggtggcggccgctctagaactagtggatcccccgggctgcaggaattcgtctccccctagaaaaaacttgtggtcctatcctagacaacgtgtgcagtcaagaaagctgcttcaccccagacaaaccaaaggataacgtggtgctgaatggagactttgaggagggtccatggatgttcccgaacacgagcttcggcgtgctgctcccaactaaccttgacgagcagacgtctgccatacctgggtggatgatcgagtcataccgcgccgtccgctacatagactctgatgagtacaaggttccccagggaaagcgtgccattgagcttctgtcagggcagganggtatcatctcccagatggttgagaccacccctcagaaggtttacaagcctgacgttcacactgggcacggcggggggactcgtggcaaacaacaattgggcgtcatgggcgttcccgggggattcaggccaaaaacttccattactcccccaatgagcaaatgccccccacccaaggctgcaaaaggggacggttacctgcccccccctaaaaaaaaacccggtggggggtttcttttagcgggggttcttcccacccccgggggagttgggcccccccaccctcctcctgtgttgggcccccctgaaattgacacaattttccccgggttttggggcctttttaaaacccccccccctgggtttttaaaagaaa

SEQ ID NO: 74159 - protein, 182 aa, Zea mays
  misc_feature: Ceres CLONE 1558508
  misc_feature (57)..(57): Xaa is any aa, unknown, or other
MFPNTSFGVLLPTNLDEQTSAIPGWMIESYRAVRYIDSDEYKVPQGKRAIELLSGQXGIISQMVETTPQKVYKPDVHTGHGGGTRGKQQLGVMGVPGGFRPKTSITPPMSKCPPPKAAKGDGYLPPPKKKPGGGFLLAGVLPTPGGVGPPHPPPVLGPPEIDTIFPGFWGLFKTPPPGFLKE

SEQ ID NO: 74160 - DNA, 782 bp, Zea mays
  misc_feature: Ceres CLONE 1558513
  misc_feature: Encodes the peptide sequence at SEQ ID NO. 74161
  misc_feature (445)..(445): n is a, c, t, g, unknown, or other
ctggagctccccgcggtggcggccgctctagaactagtggatcccccgggctgcaggaattcgtctcacccctagaaaaaatggatcagtcaccaatcttttcacgagatgcatgaccgatgaggtgtttcgtggacaaatgcaacacgacggcacgggaaggaggggagacactctgttcaaccaccagccgagttcgcagcggcactccagggtccaggcccagcagcctcttcggctcttcgttgggggtgcgtggacaccggaaattgcctcggggattgcgttcctgatctaagcccggcatgaagggctgctcagagcgtttgctgctcctgctgctgctggcatcgtcgttgttactgtccgtcgtggttgccgcgcagcagacttgccctgccgacctcgacagcaaatgcgacggtggcgcgcctgatgactgggnagggggaattcttccccggcgtcccgaaaatcaagtatgagggtccaacaagcaagaaccctcttgcttataagtggtataacaaggaggaagtcattctcggaaagaagatgaaggactggatgcgcttcagtgttgcgttctggcacacgttcccgtggtactggtgctgatccttttggtgcgcctacaaagggttggcctttgggaggacggcacaaattcgttggccatggctaagagaagaatgagagctcactttgagttcatgagaaagctgggggttgacaaatggtgcttcccatgatagggatactgccccctgatgggaaaactc

SEQ ID NO: 74161 - protein, 60 aa, Zea mays
  misc_feature: Ceres CLONE 1558513
  misc_feature: SWISSPROT Homolog: EC 5.3.1.5 Xylose isomerase
  misc_feature (4)..(4): Xaa is any aa, unknown, or other
MTGXGEFFPGVPKIKYEGPTSKNPLAYKWYNKEEVILGKKMKDWMRFSVAFWHTFPWYWC

SEQ ID NO: 74162 - DNA, 839 bp, Zea mays
  misc_feature: Ceres CLONE 1558515
  misc_feature: Encodes the peptide sequence at SEQ ID NO. 74163
  misc_feature (466)..(466): n is a, c, t, g, unknown, or other
  misc_feature (649)..(649): n is a, c, t, g, unknown, or other
tggagctccccgcggtggcggccgctctagaactagtggatcccccgggctgcaggaattcgtctcacccctagaaaaaaagggtgcacgttcaggaggagctctcgtggcgtcctagtctgtggaaggtccaaagaagaagatggacggcgagatggacgaggacgtgctcacggagatcctcgcgaggctgccgtgcaggtcgctggcgcggttccagtgcgtgtccacgtcgtggcggcgcatcatctccagcgactacctccgccgccggctgccgctcatcacgtcgggcgtgctctaccacgatggtggcaggaggcagcagtcgtacacgtacgcgtgcgcgtcaggcggcggcggcggcgccacggcggaggccgcggacatgcgcttcttcccgcgccacgagacgtccaccatcatcgacggctgcaacggcctgctgctctactacgcgtcccgnccggcggcgttccacgtcgtgagcccgaccacgcggcggtggggcggagctgccggcgccgcgcgccatgactgctgctctccgtgctggccttcgacccccgcgcctcgccgcgctaccccgggtggtgtgcttcaccggcgggccccccgggggggggccccccccccgtagaggtgttcnactccaaaacccccgggccccgtgggcggggccaccaaagctccgacttcgggcctcgggcaccgaacgcccatgtccgccctccatgcaactacgccgccgggggcggctccacgtgctggcctactccggggcaacgttcgtcccgcgtcgactcggaaacccatgggggtgggcgggtcaccccgcc

SEQ ID NO: 74163 - protein, 165 aa, Zea mays
  misc_feature: Ceres CLONE 1558515
  misc_feature (4)..(47): Pfam Name: F-box Pfam Description: F-box domain
MDGEMDEDVLTEILARLPCRSLARFQCVSTSWRRIISSDYLRRRLPLITSGVLYHDGGRRQQSYTYACASGGGGGATAEAADMRFFPRHETSTIIDGCNGLLLYYASRPAAFHVVSPTTRRWGGAAGAARHDCCSPCWPSTPAPRRATPGGVLHRRAPRGGAPPP

SEQ ID NO: 74164 - DNA, 801 bp, Zea mays
  misc_feature: Ceres CLONE 1558520
  misc_feature: Encodes the peptide sequence at SEQ ID NO. 74165
ctccccgcggtggcggccgctctagaactagtggatcccccgggctgcaggaattcgtctcacccctagaaaaagtggtccgcgacgccgccaagtccgcgcctccgggcagtggtgtcagtgccccgtatccacgcgcgggcgcgggcacgtcgctttccctgtccggcgcagcggcggcgcatgggcacggccagtacctccccctcaacgaggacgactccctggacatggtcctcttcgacgtgctccgcgaggcatccggctccgcacccgccgccacctaccagccgccctcgtcgtcgttgcctacgctgaaggcgctcgcttccggcgcctcgcgcaagggcggtggcaacagcggcaacggcagtagggccgcgcacgcacccaaggcggccacggggcggcactaccgcggggtgaggcggcggccgtggggcaagtatgccgcagagatccgtgacccggcgcggcacggggcgcggctctggctcggcaccttcgccacggccgaggaggccgccgcggcgtacgaccgcgccgcgttcggcatgcggggcgccaaggcgctgctcaacttcccgccgccggccgcgggctgcgggaacgccgcaaccgccacggcgaagcaggctgctggaagccaagtgaacaacggcgaatgcgatctcctcaagaaaatgggggcatccgcatgaatattgaatgttttctagcattgtccaagtccgttgattgaaccagagtggtatggtgggtagcgatcccctcttctccgtgtaaaggacatggccgtga

SEQ ID NO: 74165 - protein, 232 aa, Zea mays
  misc_feature: Ceres CLONE 1558520
  misc_feature (136)..(188): Pfam Name: AP2 Pfam Description: AP2 domain
PRGGGRSRTSGSPGLQEFVSPLEKVVRDAAKSAPPGSGVSAPYPRAGAGTSLSLSGAAAAHGHGQYLPLNEDDSLDMVLFDVLREASGSAPAATYQPPSSSLPTLKALASGASRKGGGNSGNGSRAAHAPKAATGRHYRGVRRRPWGKYAAEIRDPARHGARLWLGTFATAEEAAAAYDRAAFGMRGAKALLNFPPPAAGCGNAATATAKQAAGSQVNNGECDLLKKMGASA

SEQ ID NO: 74166 - DNA, 773 bp, Zea mays
  misc_feature: Ceres CLONE 1558525
  misc_feature: Encodes the peptide sequence at SEQ ID NO. 74167
  misc_feature (747)..(747): n is a, c, t, g, unknown, or other
  misc_feature (749)..(749): n is a, c, t, g, unknown, or other
  misc_feature (750)..(750): n is a, c, t, g, unknown, or other
tggagctccccgcggtggcggccgctctagaatagtggatcccccgggctgcaggaattcgtctcacccctagaaaaactcacctcctggtcagaccaagcggcacgcacaagcgcacagccacggtgagcagagaagaaacgcatccacagaagggacaaacgtccggagcggattccacattccagtctcggtctcggtccatgggcgcgggaaagggaggagacggcggcgaggcggcgcccgaggccgcgcagcccgtcgtgctgaagatgaaactgcattgcgccggctgcgcgcacaaggtcaagaaggccatcaagcgcgttcccggtgtggactccatcgtcacagacgtcgcggcgaacacggtcgtcgtggtggggacggccgacgcgggcgcgctcaaggcgcggctcgaggccaagaccaacaagcccgtggagatcgtctccgccggcggcgcccccaagaagcctcccgccgcggagcccaagcaggacgccggcgccggcgtcggtgagaagaagggggtcaaaagcgcgagccccaacgaggaggagaaagagaaggggaaaagcaacaggcggaggagaaagagagagagaaagagaaggggaagaagcagcagggtggagtcggtgctgctcaagatccgcctgcactgcgacggctgcgcctaccgcatcaggcaacgcatcggcaagatcaaaggcgtcaaagatgtggtgcctggaggcaatgccnanngacgaggtggaggtcacgggcac

SEQ ID NO: 74167 - protein, 190 aa, Zea mays
  misc_feature: Ceres CLONE 1558525
  misc_feature (20)..(82): Pfam Name: HMA Pfam Description: Heavy-metal-associated domain
  misc_feature (182)..(182): Xaa is any aa, unknown, or other
  misc_feature (183)..(183): Xaa is any aa, unknown, or other
MGAGKGGDGGEAAPEAAQPVVLKMKLHCAGCAHKVKKAIKRVPGVDSIVTDVAANTVVVVGTADAGALKARLEAKTNKPVEIVSAGGAPKKPPAAEPKQDAGAGVGEKKGVKSASPNEEEKEKGKSNRRRRKRERKRRGRSSRVESVLLKIRLHCDGCAYRIRQRIGKIKGVKDVVPGGNAXXRGGGHGH

SEQ ID NO: 74168 - DNA, 775 bp, Zea mays
  misc_feature: Ceres CLONE 1558526
  misc_feature (611)..(611): n is a, c, t, g, unknown, or other
ggagctcaccgcggtggcggccgctctagaactagtggatcccccgggctgcaggaattcgtctcacccctagaaaaatctccttctctccatctcccagcacgccgcgcctccagctcctccctcttcctctgccagtgctctctctctctgatacctagctcgatcgctgctcccatggcgcgactacttccatgccgcgccgtccctcgcgcccggcttcagctcgccggtcatccctgttccctgacttgccggatctcgcgcgcccatctcctcagctcctccctgcgcgcgccctggccctgctcggattcctccttctcggccgtctccagctcgccgttcccccttcccagccatggtggttggtcgccgctgctcagcttctctggtgcttgctccgaccgtgggcgctatcgcgccgttgaccctgccgggactcgccagccgcggcgctgctccgagctctctgctcgctagaccgcgccctgggtcgccgttgtggactcaacctcgcctggccgttgtctcggatgcgtaagagtagtgtaggtgcttgcagtcggtggatcctcgatatcgagctagggatagagaagacaatactngttccgtgcgtcgcttatccgatgcttgacggaatgcccaacagggaggtgatagcttcgtgtgtcggcgagtcgttagtttcatcgttcagtgtttgcgtggccttgcccgaaccacgctgccatactccgacagcttgcccttgcccccctgcacgtgcttg

SEQ ID NO: 74169 - DNA, 788 bp, Zea mays
  misc_feature: Ceres CLONE 1558527
  misc_feature: Translation starting site: 697
tggagctccccgcggtggcggccgctctagaatagtggatcccccgggctgcaggaattcgtctcacccctagaaaaaaaactgcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctggggcgcggtgggcgccatcgccccggagatcttcggcaagatgggcatcatccccccggagaccgcgctgccgtggttcaagacgggcgtcatcccgcccgcgggcacctacaactactgggccgactcctacacgctcttcgtcttcaacatggcgctcatgggcttcgcccagcaccgccgccttccagactggtacaacccggggctccatgggcaagcagtacctcctcggcctccaagaattcctcgccgctcccggggacccgtcctaccccgggggggcccctcttaacccggtggg

SEQ ID NO: 74170 - DNA, 737 bp, Zea mays
  misc_feature: Ceres CLONE 1558528
  misc_feature (236)..(236): n is a, c, t, g, unknown, or other
tggagctcccgcggtggcggccgctctaaactagtggatcccccgggctgcaggaattcgtctcacccctagaaaaactcgatttctcgcggagcggccctccacctttatcgccgccgccgccgttgctgtgtgtccgtctgcttcgcccgatggcttcggccaagttcggtgctgcccagcaggtggaagatctgatgcgcgctgtcaaaagtcacgtacgcgtgtctgtaggnagggggactgagtgtctcagtgtggtatgtcaactcagttttaaaatgtttgcaccgtggagcctgtgggcaccccgtcatccaccgatccagtccaagaatgatgccaggacttcctgcctctggattgaaccgtcaccccattttacggagggaaaggggggggggcccccacctccatttcccctttggaaatgggtagcctttgggggccccccattccccccccctgggaaaaaccaaatttgggttttgggcccccccaccaaaaaaacccccccgggtgttccatagggggttttttttccttcctaaatagggccccccccgggcccaaaaaaagggggttttttgggaataaacccccccccaaaccccctctggggggggcccaaaaaaaacttggggggggtataaaaagaattcccccacaacgcggtgttttttaaacccccggggtttggggggggggggtatttttttgtgaaaaaaaacaaaaat

SEQ ID NO: 74171 - DNA, 797 bp, Zea mays
  misc_feature: Ceres CLONE 1558530
  misc_feature: Translation starting site: 92
  misc_feature (694)..(694): n is a, c, t, g, unknown, or other
ctggagctccccgcggtggcggccgctctagaactagtggatcccccgggctgcaggaattcgtctccccctagaaaaaacctgggcggcgatggcgaccgccgcgagggagaggcgcctgccgccggcgctgcccctggcgactctcatcggccgggagctccgcgcggggggctccgagcgcccggccctgcgctacggccacgccggctttgccaagcgtggcgaggactacttcctcgtcaagcccgactgcctccgcgtccccggggaccccgcatccgcgttctccgtctttgccgtgttcgacggccacaacggcgtgtcggcggcggtctacagcaaggagcatctgctcgagcacgtcatgagcgcgctgtcgccggacatcggccgcgaagactggctgcaggcgctgccgcgcgcgctcgtcgccggcttcgtcaaggccgacatcgatttccagcgcaaggggggaggtgtccggaaccacggcgacactggtggtcatcgatgggttcacggtcacggtaggcgtcggtgggtgactcgcgctgcatcctggacacgcaggggcggcgagttgcagctgctaaccgtgggacacccgcctggaggagaatgcagatgatcgggagcgcgtcacggcagcgggtgggggaagtaggccgggctcatctccttggcggccagnaggtcggccctctcccggggctggcctggtggcttggtgcctctcagatccatcggggacatggatggttgggaaaattcatttgtgcccattccaattttct

SEQ ID NO: 74172 - DNA, 800 bp, Zea mays
  misc_feature: Ceres CLONE 1558532
  misc_feature: Encodes the peptide sequence at SEQ ID NO. 74173
ctccccgcggtggcggccgctctagaactagtggatcccccgggctgcaggaattcgtctcacccctagaaaaaaattccatatccaacacacacagcaacgctcgctcggcactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggacggcgggcgcgggctggacctgacgctggaccgcacgtccggctccgggttccagtccaagagcgagtacctgttcggcaagatcgacatgcagatcaagctggtgccaggcaactccgctggcacggtcaccaccttctacctgtcgtcccagagcgacgcgcacgacgagatcgacttcgagttcctgggcaacgtgagcggggagccctacacgctgcacaccaacgtgttcacgcgcggacagggccagcgggagcagcagttcccgcctctgggttcgacccttacattgcctttcccaaccttactcatcctggtggacccccccgcacctggatccttcccggtggaccgggcccccgggtgcgggacttccaggaacccctagccccccgggggtggccttttcccaagaatgccgccccatgggggttggtcacccacccggtggaaacgcccaacaaatggg

SEQ ID NO: 74173 - protein, 173 aa, Zea mays
  misc_feature: Ceres CLONE 1558532
  misc_feature (27)..(165): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
MRSFAPVFLSAVVAWLELAGTAQGGNFYQDTEMTWGDGRGKVVDGGRGLDLTLDRTSGSGFQSKSEYLFGKIDMQIKLVPGNSAGTVTTFYLSSQSDAHDEIDFEFLGNVSGEPYTLHTNVFTRGQGQREQQFPPLGSTLTLPFPTLLILVDPPAPGSFPVDRAPGCGTSRNP

SEQ ID NO: 74174 - DNA, 790 bp, Zea mays
  misc_feature: Ceres CLONE 1558533
  misc_feature: Encodes the peptide sequence at SEQ ID NO. 74175
  misc_feature (697)..(697): n is a, c, t, g, unknown, or other
  misc_feature (790)..(790): n is a, c, t, g, unknown, or other
ggagctcaccgcggtggcggccgctctagaatagtggatcccccgggctgcaggaattcgtctcacccctagaaaaactttgaaagccatgtgggatgtgattcatccaaagtctggttcaaatgtgggaactgttcggaaacctaggcctcctgtgttagcagctgctgtatctgcatggacttttctcctgactactattggttcatggaggataaataccaatatctggaaagagcccattgcatttctgtctactcttttggaagcagatgatcgtgctgttcggatggctgctggtgaaacattggttttgtgctttgagttaaatctgcttgatgtttcttctcgtgaggacgatggtgttaacacaggaggaacagctggttctaagaacaagcttttcttggatatgcaagcattaaaagcaaaaatatcaagtctggccactaatctctctgctgaggctggggggcaaggtgcagacaagaaaaaacttactgaccaaagagacttatttcaaaggatcttagattttgtcaagtatggtgactgccctgaagaatcaatcaagattgctggaaaacatgatgtcttaagggtgtcgtcatggtctgaattaatccagttgaatttcttaaacgggtttctggggaaaggctttctgaagcatgttcaggaagatggacttcttcangatatatttgacattgaggttgacaaaaccgaaaaccctgtcgtgcactaacaagaaaatctttaggtctgaacgaggaaaaaggacgagctn

SEQ ID NO: 74175 - protein, 219 aa, Zea mays
  misc_feature: Ceres CLONE 1558533
  misc_feature (203)..(203): Xaa is any aa, unknown, or other
MWDVIHPKSGSNVGTVRKPRPPVLAAAVSAWTFLLTTIGSWRINTNIWKEPIAFLSTLLEADDRAVRMAAGETLVLCFELNLLDVSSREDDGVNTGGTAGSKNKLFLDMQALKAKISSLATNLSAEAGGQGADKKKLTDQRDLFQRILDFVKYGDCPEESIKIAGKHDVLRVSSWSELIQLNFLNGFLGKGFLKHVQEDGLLXDIFDIEVDKTENPVVH

SEQ ID NO: 74176 - DNA, 779 bp, Zea mays
  misc_feature: Ceres CLONE 1558534
  misc_feature: Encodes the peptide sequence at SEQ ID NO. 74177
ctcaccgcggtggcggccgctctagactagtggatcccccgggctgcaggaattcgtctcacccctagaaaaaaaaccagcgcgaaataattaaccatagatcattgaaacaccctaacattattaggtttaaagaggttattttaacaccgacccatcttgctattgtcatggaatatgcctctggcggtgagctttttgagagaatatgtaagaacgtgcgattcagtgaagatgaggctcgctacttcttccaacaactcatttcaggagtaagctactgccattcaatgcaagtatgccaccgtgatttgaagctggagaacacacttctagatgggagtgatgctcctcgcttgaagatatgtgacttcggttattccaagtcatctgttcttcattcccaaccgaagtcaactgttggaacacctgcttatattgcacctgaagttctgttgaaaaaagaatatgatggcaagattgctgatgtttggtcatgtggtgtaaccctctatgtaatggctgttggtgcatatcctttttgagacccagaagagcctaagaacttccgcaagacaattcagcgcatcttgaacggtcagtacgccatttccagactacgttgaacatatcttccggagtgcaggccatctaattccgaaggattttggttgggggatccctgccatgccgaataacaaatcccggaaatcccggaatcaatagttggttcccgaaaaaaccttccgggcggaacctttgggatgaggaaaagccgc

SEQ ID NO: 74177 - protein, 124 aa, Zea mays
  misc_feature: Ceres CLONE 1558534
  misc_feature (1)..(125): Pfam Name: Pkinase Pfam Description: Protein kinase domain
  misc_feature: SWISSPROT Homolog: EC 2.7.11.1 Non-specific serine/threonine protein kinase
MEYASGGELFERICKNVRFSEDEARYFFQQLISGVSYCHSMQVCHRDLKLENTLLDGSDAPRLKICDFGYSKSSVLHSQPKSTVGTPAYIAPEVLLKKEYDGKIADVWSCGVTLYVMAVGAYPF

SEQ ID NO: 74178 - DNA, 764 bp, Zea mays
  misc_feature: Ceres CLONE 1558536
  misc_feature: Translation starting site: 164
ctggagctccccgcggtggcggccgctctagaatagtggatcccccgggctgcaggaattcgtctcacccctagaaaaaacgacactccacactccaagcgagctatgagctagagctatagagatcactctccttctccgcgtgaggtagtgacgcccagcaatggcaacaatggcactgcgcgccgcgtcaacagagctgctgctgctagcaccgtccgtgtccggcgcgtcggagacaccactagtgctgtacaaccggtgcggggagacggtgtggccgggcatccagccgagcgccgggaaggaggtgctggcgcgcggcgggctgcagctggcgccggggcggtcggcgtcggtgcggctccccgcggggtggtcggggcgcgtgtgggggcggcaggggtgctcgttcgacgcggcggggcgcgggcggtgcgccacgggcgactgcggcggcgcgctctactgcggcggcgccgggggcgcgccgccggccacgctggcggagacaccctgggcaccgcgtcgtcccaggacttctacgacgtgagccttgtggacgggtacaacatccccatcgcgatgacgccggtgcacgggtcgggcgcccggtgcgcggcgggccgggtgcgtgagcgacctggaaccgcgtgtgccccgcgggggctcgccgtccgcggccagagcgcccttggtggggtggccccaacgccctggcgccgccctaccgcgccgccgcagtactgcctgcacggggccaa

SEQ ID NO: 74179 - DNA, 814 bp, Zea mays
  misc_feature: Ceres CLONE 1558537
  misc_feature: Encodes the peptide sequence at SEQ ID NO. 74180
  misc_feature (643)..(643): n is a, c, t, g, unknown, or other
  misc_feature (672)..(672): n is a, c, t, g, unknown, or other
  misc_feature (741)..(741): n is a, c, t, g, unknown, or other
ggagctccccgcggtggcggccgctctagaatagtggatcccccgggctgcaggaattcgtctcacccctagaaaaaaaacccactgttgcagcgcgagtgtagcaggctgcacacacaaggaaggggacaaccacaagcgcctaagatcccgtcctccgcgtcgagatctttgccgaggcggtgaccgtcgagggatcgccatggcgttgagggcgtcccccgtgtcgcatggcaccgcggcagcgccgctgccgcctttcgcgcggaggaggatggccgtggggggtgggtggtggccatggcgtccaccatcaacagggtcaaaactgtcaaagaaccctatacccctccacgagaggtacatcgccaaattacccattcactaccacctcaaaagcgggagattttcgattcacttcaaccttgggccaaggataacctactgaacctactgaagccagttgaaaagtcatggcagccacaggacttcctaccagagccttcttctgatgggttttatgatgaagttaaagaactgagggagcgggcaaatgaaatacctgatgaatactttgtttgcttagttggtgatatggttactgaggaagccttacctacataccaaacaatgcttaacactncttgatggagtccggaatgaaactggtgncagtccaaccacggtgggcggtttgggacaaggcatggacagctgaagagacagacatggtgacctccntaacaagtacatgtacctaaccgggacgggttgacatgaaacaaatttgagagaccattcattttctgattgg

SEQ ID NO: 74180 - protein, 114 aa, Zea mays
  misc_feature: Ceres CLONE 1558537
  misc_feature: SWISSPROT Homolog: EC 1.14.19.2 Acyl-[acyl-carrier-protein] desaturase
MASTINRVKTVKEPYTPPREVHRQITHSLPPQKREIFDSLQPWAKDNLLNLLKPVEKSWQPQDFLPEPSSDGFYDEVKELRERANEIPDEYFVCLVGDMVTEEALPTYQTMLNT

SEQ ID NO: 74181 - DNA, 816 bp, Zea mays
  misc_feature: Ceres CLONE 1558542
  misc_feature: Translation starting site: 238
ggagctccccgcggtggcggccgctctagaactagtggatcccccgggctgcaggaattcgtctcacccctagaaaaaatctccgaggagtatatagaaatggaaaagataaggcgaacgatgtccacctagaaaccctagttcgaacgcgccgccgtcaccgtcgtcgctcgcgctctccgcccggatcggagcgagagtaggggcgtgtcggcggtgaaagcgactgcgtcagccatggcggacgaggagcattcggagaggagagaggaggcctccgagcttgcccccttcgacccgaccaagaagaagaaaaagaagaaggttgtcatccaagaaccttctgatgaagtggacaagcttgcagagaagacagaaacactggcagtcgcagaacccgctgaacttaacttcactggaatgaagaagaaaaagaagaagccggtggatcttgattcaactcttgatgagcttggagatggggaggacactcaagatgatcaagctgtagaggaacaaggggaaggcattgttgctgggaagtgtccctacatacccttgggagggaactgatcgggattataaatatgaagagctgctggacagggtgttcaacattctacgtgagaacaacccagatcttgctggggataggcgtaggaccgttatgaggccaccacaagttcttagggagggaacaaagaagacagtttttgttaactttatggatttgtgtaaaacgatgcataggcaacctgagcatggtgatgatgtttttacttgctgaaatgggaaccagcgggtcacttgatgggc

SEQ ID NO: 74182 - DNA, 785 bp, Zea mays
  misc_feature: Ceres CLONE 1558543
  misc_feature: Encodes the peptide sequence at SEQ ID NO. 74183
ggagctccccgcggtggcggccgctctagaactagtggatcccccgggctgcaggaattcgtctcacccctagaaaaaccggaagacgctccacatcaacgccgtcgcacgccagatcatcgtcggctcgggtgaccagaggaaggacggcagcgtcttccgtggcatagacgaggtcacctacttccccagcaagtacaacatggagatgtcctccaaggcgtacaaagcctggaacttcacggaccttgctcttcccaacgatctcatcaagagaggtctggcgaaaggagatccaaagaagccagagacgctggagctggcgataaaggactacccgtacgcggtggacgggctcgacatgtgggcggcgatcaacaagtgggtggctgactactgcggcatctactacgccgacgacggcgcggtggtgagggacagcgagctgcaggggtggtggagcgaggtcaggaacgtggggcacggcgacctggcggacgcgccgtggtggccggcgatggactgcgtcgccgacctcgtggagaccctgcgccaccgtcgtctggtggagctcggcgtaccacgcgtccatcagctttcgggcagtacgactaccctgggcttcgtcccgatacggccctccatcaccacgcgggcgggtgccgggcccggaccccggggcgaaggtcccggaattcggacttccggggcaagggtcacgcccgtcaccgaaggccccgggctttttgtcccatccccccccgggcccatgggggtcaaggggg

SEQ ID NO: 74183 - protein, 194 aa, Zea mays
  misc_feature: Ceres CLONE 1558543
  misc_feature: SWISSPROT Homolog: EC 1.13.11.12 Lipoxygenase
MEMSSKAYKAWNFTDLALPNDLIKRGLAKGDPKKPETLELAIKDYPYAVDGLDMWAAINKWVADYCGIYYADDGAVVRDSELQGWWSEVRNVGHGDLADAPWWPAMDCVADLVETLRHRRLVELGVPRVHQLSGSTTTLGFVPIRPSITTRAGAGPGPRGEGPGIRTSGARVTPVTEGPGLFVPSPPGPMGVKG

SEQ ID NO: 74184 - DNA, 771 bp, Zea mays
  misc_feature: Ceres CLONE 1558545
  misc_feature: Encodes the peptide sequence at SEQ ID NO. 74185
ctcaccgcggtggcggccgctctagaactagtggatcccccgggctgcaggaattcgtctcacccctagaaaaaagctcattaccacctccgcctccgcgatcgaagctcctcacaaaccgttatcgtcgccatggcagccgccgcgcctgcaagctccgtgaaggaagtgctgccatctcccctgacctccgcctccgagccccctcccctcttcgatggcaccaccaggctgtacgttgcctatcattgcccgtacgcgcagcgcgcttggattgccaggaactacaagggtttgcaggacaagattaagatagtcgccatcgatcttgctgacaggccaacatggtacaaggagaaggtttatccagaaaacaaggtgccttctctggagcacaacaaccaggtgaaaggtgagagtttggatctggtcaagtacattgacagcaactttgaaggcccatcgttgctcccagaggatccttcaaaaaagcagttcgctgaagagctgcttgcatatactgatgcatttacaaagcattatactttttgtatagtctccaaggaagatgtgtctgaaggagctgtccctgctttggataaaataagaagacgccctcgggaaattcaaccgagggtccattctcccctgggtcagttcagtccggtggacaattgcgtaatgtaccattcatccgggaggtttcaaataattcctttccaacttaagggactttggtattccccaggggcagaccccaaccttccgaat

SEQ ID NO: 74185 - protein, 213 aa, Zea mays
  misc_feature: Ceres CLONE 1558545
  misc_feature: SWISSPROT Homolog: EC 2.5.1.18 Glutathione transferase
MAAAAPASSVKEVLPSPLTSASEPPPLFDGTTRLYVAYHCPYAQRAWIARNYKGLQDKIKIVAIDLADRPTWYKEKVYPENKVPSLEHNNQVKGESLDLVKYIDSNFEGPSLLPEDPSKKQFAEELLAYTDAFTKHYTFCIVSKEDVSEGAVPALDKIRRRPREIQPRVHSPLGQFSPVDNCVMYHSSGRFQIIPFQLKGLWYSPGADPNLPN

SEQ ID NO: 74186 - DNA, 802 bp, Zea mays
  misc_feature: Ceres CLONE 1558549
  misc_feature: Encodes the peptide sequence at SEQ ID NO. 74187
ctccccgcggtggcggccgctctagaactagtggatcccccgggctgcaggaattcgtctcacccctagaaaaagtcggattcgccgccagctaggcgagatggctgcgccgttgcctctttccgcggaggacatgctgcgcgtcaacggcagccgccgcttcgccgccgcgatggcggccgcctcccccttcgcgtccctcgcagacgccctcctcgccgctcggcgcatctggctcgacgaggtggatgtcaacggatggctcgaggccttcgcggcgcacccggcaatcggaaccacctccccatctgtctccaagtggagcaaggaggagcaatcagcagcgctctccacagccacggactcgacggcccaggagctagcagagtggaatgccagatacagggagaagtttggcttcgtcttcatgatttgcgcttctgggaggactgcagctgaggtcttggctgagcttaagaggcgttacacgaacaggccaattgtcgaacttgaggctgcggcacaggaagaactcaagataactgaactacgtctcacgaagcttttctcattggagcctactggtccctccactacaattgaaaggccccaccgtccaatcagataaagcagcaggtagctcgaacccgaagtcgtccgcctattacaacgcatgtgcctggactttggcccggtggatcgcctgcatccgggaatccgaagttcacctgggagatgtgggaagggatttgttcagcctcccccatcattcaacaaacaaagattttcagcgggatgggga

SEQ ID NO: 74187 - protein, 175 aa, Zea mays
  misc_feature: Ceres CLONE 1558549
  misc_feature: SWISSPROT Homolog: EC 3.5.2.17 Hydroxyisourate hydrolase
MAAPLPLSAEDMLRVNGSRRFAAAMAAASPFASLADALLAARRIWLDEVDVNGWLEAFAAHPAIGTTSPSVSKWSKEEQSAALSTATDSTAQELAEWNARYREKFGFVFMICASGRTAAEVLAELKRRYTNRPIVELEAAAQEELKITELRLTKLFSLEPTGPSTTIERPHRPIR

SEQ ID NO: 74188 - DNA, 778 bp, Zea mays
  misc_feature: Ceres CLONE 1558550
  misc_feature: Encodes the peptide sequence at SEQ ID NO. 74189
ctggagctccccgcggtggcggccgctctagaactagtggatcccccgggctgcaggaattcgtctcacccctagaaaaagaggaagaaggtaggaggagaaccaaaagcatagagacatggcgccccaccagcaacaacgggcgctgctcctgttcccactcgtcttcctcctcctcctccttgccccgcccctcgccggcgcgtggggaaaagagggccacatcatggtctgcaagatcgccgaaaaatacctgtctgagaaggcggctgcagcggtgcacgcgctgctgccggattcgaagggcggggagctgtctacggtgtgccagtgggaggaccaagtgcgctggcactaccactgggccagcccgctccactacgcaaacaccccacaagtctgcaacatcaagtattatcgggactgccacaattctcatggccagcaagggatgtgactcatctgagctatcaacaactacacggaccagctctacagctacggccagaagacttcgtataacctgacggagagcctgatgttcctggcacaattcatctgcgacgtacaccagccgctgcaagtatgctgcgaagatgacgagggctgtaacaccatcaccgtccactgataccggaggagagcatacctccataacgctgtgggatgtcaacattattgatacggcaatcaagggactgctacaacaagagcatggataccatggtagaggctctcaagatgaatcttaaaaatggatggtctgacgaacaatcta

SEQ ID NO: 74189 - protein, 112 aa, Zea mays
  misc_feature: Ceres CLONE 1558550
  misc_feature: SWISSPROT Homolog: EC 3.1.30.1 Aspergillus nuclease S(1)
MAPHQQQRALLLFPLVFLLLLLAPPLAGAWGKEGHIMVCKIAEKYLSEKAAAAVHALLPDSKGGELSTVCQWEDQVRWHYHWASPLHYANTPQVCNIKYYRDCHNSHGQQGM

SEQ ID NO: 74190 - DNA, 712 bp, Zea mays
  misc_feature: Ceres CLONE 1558552
  misc_feature: Encodes the peptide sequence at SEQ ID NO. 74191
ctcaccgcggtggcggccgctctagaactagtggatcccccgggctgcaggaattcgtctcacccctagaaaaatcagtcatcacccacctcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgaaggtgaagaactcccttcagctgccgggcaccgacgccaagccctaagccgccaagcccattgcatcccatggccgcgcccaagcccaagcccctcgccgatagcgatagcccagaccgctgcgaagcccaaagcggcgtcgcccaaacccaaggtccaaggcaaaggccatgcctgtcgctcctggcgccgcgtcgccccaaagcc

SEQ ID NO: 74191 - protein, 129 aa, Zea mays
  misc_feature: Ceres CLONE 1558552
  misc_feature (54)..(124): Pfam Name: Linker_histone Pfam Description: linker histone H1 and H5 family
MSTEEAVVAEVPVTEVPAEVPAAQVAEAPKAKKAPKEKKAPKEKKLSAAKKPAAHPPYAEMIVEAIAALKERKGSSSVAISKYVEGKHGGKLPTNFRKQLTVQLKKLAAAGKLTKVKNSLQLPGTDAKP

SEQ ID NO: 74192 - DNA, 802 bp, Zea mays
  misc_feature: Ceres CLONE 1558553
  misc_feature: Encodes the peptide sequence at SEQ ID NO. 74193
ctccccgcggtggcggccgctctagaactagtggatcccccgggctgcaggaattcgtctcacccctagaaaaaaaggcactagcacgcaaaaaccccacgagagagacgaatcttccgaatctctcggtggcgatggcgctctccgaccgctcccgcgagtcgctcctcccgagcttcctctacgcctcctcggcgcgctctttcgctgccacaggagccgccgcgcgcctccctgtctcctccccagcgcctgccacggctggagcaggaggcggcgtgccgttctctatccaggcgcccaaggagaagatcgagatgtactcgccggccttctatgccgcctgcactgccggaggaatcgacagctgcgagctcacccacatggccgtcacgcctctcgacatcgtcaagtgcaatatgcagattgacccagcgaaatacaagaggttctcatcctggatttgtttccctgttaaaagacccaagggggcaggggtttctttcagggattggggccctacttggcttgggttccagggctcagggggcttgccaagttggccctcctaggagtcccttaaaaaagttttacccggaaattggaagggcccggaattcccccaaaaaaaaaaaaatctttattttcccccccagagaatccccccccggcccgggggaatttggggagggggggccccccgcgccctttttaaactttttaaaaagactctggggcaaaaaccaaacccggaatatttcccccccggaattataaaagaaaggggcccccccccaatttg

SEQ ID NO: 74193 - protein, 145 aa, Zea mays
  misc_feature: Ceres CLONE 1558553
MALSDRSRESLLPSFLYASSARSFAATGAAARLPVSSPAPATAGAGGGVPFSIQAPKEKIEMYSPAFYAACTAGGIDSCELTHMAVTPLDIVKCNMQIDPAKYKRFSSWICFPVKRPKGAGVSFRDWGPTWLGFQGSGGLPSWPS

SEQ ID NO: 74194 - DNA, 793 bp, Zea mays
  misc_feature: Ceres CLONE 1558554
  misc_feature: Encodes the peptide sequence at SEQ ID NO. 74195
ctggagctcaccgcggtggcggccgctctagaactagtggatcccccgggctgcaggaattcgtctcacccctagaaaaaatcagtcatcaccctcctcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgatgcgcccaatgcgaagaaggcgcccacggagaagaacgcgcctaaggagaagaagcttgccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctcccctccaacttccgcaagcagctcactgtgcagctgaagaagctcgctgccgccggctagctgacgagggtgaagaactccttcaagctgccggccaccgtcgccaagcccagggccgccaagcccaaggcaccctaggccgcgcccaaagcccaagccctcgcccgaaggccaagggcctagacccgctgcgaatgccaagggggggcgtccccccctaccccaaggtccaaaggcctaaggccctggccctgtgcgcttcctggcctgccgacttcgaccaaatggcccccggggggcgcccctcccctagggtggacccaaggaccttgcgcgcccaggggcctc

SEQ ID NO: 74195 - protein, 111 aa, Zea mays
  misc_feature: Ceres CLONE 1558554
  misc_feature (54)..(112): Pfam Name: Linker_histone Pfam Description: linker histone H1 and H5 family
MSTEEAVVAEVPVTEVPAEVPAAQVADAPNAKKAPTEKNAPKEKKLAAAKKPAAHPPYAEMIVEAIAALKERKGSSSVAISKYVEGKHGGKLPSNFRKQLTVQLKKLAAAG

SEQ ID NO: 74196 - DNA, 816 bp, Zea mays
  misc_feature: Ceres CLONE 1558555
  misc_feature: Encodes the peptide sequence at SEQ ID NO. 74197
  misc_feature (722)..(722): n is a, c, t, g, unknown, or other
  misc_feature (771)..(771): n is a, c, t, g, unknown, or other
  misc_feature (778)..(778): n is a, c, t, g, unknown, or other
agctccccgcggtggcggccgctctagaactagtggatcccccgggctgcaggaattcgtctcacccctagaaaaagcagagccgcaacggacccgttttgacaaattcctcggcgtgcggcgtgttccgctggtgcccgcccggcctcccaccctctccagcgccgccgcctcctcttcccggccgaaggagcaccgccccagccgatcttctctcccccacgctccatcaggccgtttctggctgctcttgggcctccctcgccctccctgacggccccgagctcgccctccatctccgccccagctcgcgccatctcggtgcctcgagctcgtcgtcctcgcttctgtggtcaccgccgggaagcatgaggaggaggcctgggatcgctggcttgcagaatgcggcggctactcgtgaccaattccggctggtcggggagaatgtggccaaggtgaggaccgatgtcatgaaggagcagcttgcgacgttccggtcacagctcgaggaattcgctcgcaagcataagagtgacatccgtaaaaacccagtattcagacagcagttccatgagatgtgcgcaaaagtcggagtagatccattggcatctaataaaggagtctgggcagaaacttctagggattggtgacttctactatggaacttgggggttcagatagttgacatatgcatttggtaccagatcacattatgggtgggncttgattgacttactagatctcccgcaaactggctcggtcagaagaggnaaaactnactcttggatcattattctgaaagatgacttgtttgcg

SEQ ID NO: 74197 - protein, 93 aa, Zea mays
  misc_feature: Ceres CLONE 1558555
MRRRPGIAGLQNAAATRDQFRLVGENVAKVRTDVMKEQLATFRSQLEEFARKHKSDIRKNPVFRQQFHEMCAKVGVDPLASNKGVWAETSRDW

SEQ ID NO: 74198 - DNA, 777 bp, Zea mays
  misc_feature: Ceres CLONE 1558556
  misc_feature: Encodes the peptide sequence at SEQ ID NO. 74199
  misc_feature (577)..(577): n is a, c, t, g, unknown, or other
  misc_feature (712)..(712): n is a, c, t, g, unknown, or other
tggagctcaccgcggtggcggccgctctagaactagtggatcccccgggctgcaggaattcgtctcacccctagaaaaagccattgcaagccttcccggttacttgttcactaacaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggcgccgagacccacatctcgatccgggacctggacgccaagcacgggcgcaacggcctgctgctcctccgcatcggcgccgtgcccaccctgttcgtgtcctcgcccagcgccgccgacgccgtcctgcgcacccaggaccacatcttcgcgtcgcggccgccgtccatggccgccgagatcatccgctacgggccctcagacgtcgcgttcgtgccctacngcgagtactggcggcagggcaggaaactcgctcacacgcacatgctcagcaccaaagaggtgcagtcctttccggcatggccgaaaagaagaaggtgccgctcgtcatggaacagaatcgcgcggctgccaccgncgcgacgccgggcggcggtggacctgagcgatctccctgtcggttaccccaacgaacgtggggtg

SEQ ID NO: 74199 - protein, 216 aa, Zea mays
  misc_feature: Ceres CLONE 1558556
  misc_feature: SWISSPROT Homolog: EC 1.14.13.68 4-hydroxyphenylacetaldehyde oxime monooxygenase
  misc_feature (150)..(150): Xaa is any aa, unknown, or other
  misc_feature (195)..(195): Xaa is any aa, unknown, or other
MALGAAYHHYLQLAGDHGTATHALLLGVLIFLVIRLVSARRTGTTSANKRKQQQRLPLPPSPPGKLPIIGHLHLIGAETHISIRDLDAKHGRNGLLLLRIGAVPTLFVSSPSAADAVLRTQDHIFASRPPSMAAEIIRYGPSDVAFVPYXEYWRQGRKLAHTHMLSTKEVQSFPAWPKRRRCRSSWNRIARLPPXRRRAAVDLSDLPVGYPNERGV

SEQ ID NO: 74200 - DNA, 800 bp, Zea mays
  misc_feature: Ceres CLONE 1558557
  misc_feature: Translation starting site: 120
  misc_feature: SWISSPROT Homolog: EC 6.3.2.19 Ubiquitin--protein ligase
  misc_feature (733)..(733): n is a, c, t, g, unknown, or other
ctcaccgcggtggcggccgctctagaactagtggatcccccgggctgcaggaattcgtctcacccctagaaaaattttccccaaatctgtgcctctgcgtgcgtgcttcgcgaggagcgatggagacgcggcagctgctcctcgtgttctgcctcctcggcgccggcatggccgtcgtcgtggacgcgcaggcgcagtcggcgccgccgccgccgcctcggcagacgccttctgcgccgccgcagcagacgcagttcggccgcaccatgtcgaccttcatcacggtggccatcagcgtcttcttcttcttgctcttcgtctgcgcgtacatcaaccagtgccgcctcgcggaccccggggcggcggccgcggcggccgcggcggcggcagccggcggcgggggcgggggccccgtccaggagggggaagcgagggctggaccccgcggtcgtcgccacgttcccgattgtgtcgtacagggaggtcgtggagcacaagatcggcaagggcgtgctggagtgcgcggtgtgcctgacggcgttcgaggacgacgacgacctccgcctgctgccgcactgctcccacgcgttccacccggagtgcatcgacccctggctgcagtcgcgggtcacgtgcccgctctgccgcgcgaacctcgagaagccggcgccggcgccggcggtggcgcccccgtcgccttcgccacggctagcgccgcgccagtcttcgccgncgcccggaggcgtgggcgataccggtgcggaaccaaacggggtcgaaggggggcgacagcactgtct

SEQ ID NO: 74201 - DNA, 838 bp, Zea mays
  misc_feature: Ceres CLONE 1558560
  misc_feature: Translation starting site: 213
  misc_feature (805)..(805): n is a, c, t, g, unknown, or other
ctggagctccccgcggtggcggccgctctagaactagtggatcccccgggctgcaggaattcgtctcacccctagaaaaactagcggccgagtttaacagttaaaccctagctcaccgtcgtgctcgcctccccgcgcctgctcccttcaggcactgacagttcgccgccgcggcggcgctttcgagcccacgcggaagcgcacctagtgccatggcgaagaagcggaagcacaccgaggcccaggcagagacggccggcgcagagaagccggacgactccgcaccggcgcgcccggagcgcacgctcttcggcttcaaggatccgccccccgacgccgtgcccgcctccgcggcctccagggccgcggtggcgccgttcaggaacagggagaaggtactcatcacctgctcccgccgcatcacgtacaggtatcgtcatctgatgcaggacgtgctgtcgatgctcccgcacgcgaagaaggacagcaaggtcgagtcgaagcagagcaaggggaacgctctcaacgagatgctcgagctcaggagctgctccagttgtctcttcttcgagtgccgaaaacagaaggatctttacctttgggatggtgaagtctcctggaggaccatcagtgaaatttctagttaatgctgttcaccccatggaggagttgaagcttacgggtaaccatctgaaagggtcacggccacttcttacattttctacaaattttgatgagcaacctcatttggaagcttgtgaaggggaatatgactcagatatttgctactgcctaaagatcaccntagagcacaccttttccatgaccatgtagttgt

SEQ ID NO: 74202 - DNA, 782 bp, Zea mays
  misc_feature: Ceres CLONE 1558562
  misc_feature: Encodes the peptide sequence at SEQ ID NO. 74203
  misc_feature (274)..(274): n is a, c, t, g, unknown, or other
ctggagctccccgcggtggcggccgctctagaactagtggatcccccgggctgcaggaattcgtctcacccctagaaaaagcgaaccctagccagcctccgcgagatggacgacgactgggagctcctcctcgcgtcccccaaggcggcctcggcggccgagccgttcgctggaggcggggaggacgacgccggcgccatcaagcacgactacttcgacctcggctccgacgccaagtatccccggagggcgtcgctgtcgacgggggacgagnaggagggcgtgggaggaggggcttctcagggcgtcggacaacgcgagctgggtggagccggaccctgacgaccttctcttccccggccgcgaccgcgcggcgctgtggtcggactcgtcctccgacggggagaggcccgaggtcgaggccaccgatcccgtggggcgggccagggaggagggcggggtgatggcggccgcggctgatggggtggatggggccgtggcgaagggaggagaacacgtccggtggtggaagctgccgctcgacgcgctgcgtgtttggggcgatgcgcgcagcgacgagcgcctggtctgtgccgttcgccgtcgcgctgctcggattcgctgtgctcgggcgcctgctgtacaagatgcgccgccagatcaaggacgccgcgctcgtccgcctcgtattcaacgaaaagaaggcctcccaattcaagggccaatcgtcacgtctggatgatccacgacgatgatgcggcgaactccttccataaaacctt

SEQ ID NO: 74203 - protein, 78 aa, Zea mays
  misc_feature: Ceres CLONE 1558562
  misc_feature (57)..(57): Xaa is any aa, unknown, or other
MDDDWELLLASPKAASAAEPFAGGGEDDAGAIKHDYFDLGSDAKYPRRASLSTGDEXEGVGGGASQGVGQRELGGAGP

SEQ ID NO: 74204 - DNA, 783 bp, Zea mays
  misc_feature: Ceres CLONE 1558567
  misc_feature: Encodes the peptide sequence at SEQ ID NO. 74205
ggagctccccgcggtggcggccgctctagaactagtggatcccccgggctgcaggaattcgtctcacccctagaaaaaatccgccacagccgaactggcccgatgtcgctggttgcctacgatgcctcctccgatgaggaagacgccggcgagcctgccgccgccgcggcgccacaccctgcccccatcggtccgcagccaagggctccgtctcctacggacagagaaggcctgctcctcggcctacgcgtacgcttacgccgccggcgccagcatgccagtcagagggtagcgccgattacttcgagtgatgtctgtctgcccacatcatcattgggtgtaccagatgttgcagatctctttgctccacctgcagacaatgcatcgaagaagagggaatcaaatgggtctgctcttcatgactcgcgcaataaatttccaaggatgcattcactatcccaagggatacgaagtgctgcatgcaacgccctaattccaccgcgacgtccgtgaaggagtcatgttgttgccgaagacatgagcaacctcttcgtggctgaacgaaaagagtagcgtcttgacccttttctgggactggaacctctggtttggactccatagactgataaaacgcatgtactgactggcactggatgtgacccgcctgatccaaggttggttgctgcattcctaatgaaccggacgatcggtgcttaaccggtgggaccaactggttttcttatgcctaccaaggggctagtgggcaaaatgtcaaaaaatggc

SEQ ID NO: 74205 - protein, 136 aa, Zea mays
  misc_feature: Ceres CLONE 1558567
MSLVAYDASSDEEDAGEPAAAAAPHPAPIGPQPRAPSPTDREGLLLGLRVRLRRRRQHASQRVAPITSSDVCLPTSSLGVPDVADLFAPPADNASKKRESNGSALHDSRNKFPRMHSLSQGIRSAACNALIPPRRP

SEQ ID NO: 74206 - DNA, 783 bp, Zea mays
  misc_feature: Ceres CLONE 1558568
  misc_feature: Encodes the peptide sequence at SEQ ID NO. 74207
tctccgcggtggcggccgctctagaactagtggatcccccgggctgcaggaattcgtctcacccctagaaaaagtctctgaacagaactcataccttgctagccatggacgcggccatcgccgggcagcaggcgaggcgccggatccagccgcaggaaccactcgtgatggccgggacgccgccaaagcccgcagcgttccggtgtccgatctcgcttgaggtgatgcggtcgccagtcagcctccccaccggcgccacgtacgaccgcgcgtccatacagcgttggctggactccggccaccgcacctacccggccacgcggctgccgctggcgtccaccgacctggttcccaacctgctgctgcgccgcctcatcaacctgcacgcggccacgctgccgccttccccgtcgcccgaggaggtgctgtcgcagctggccgccgcagacggggagcccgcggccgcggagaaggccgtgcggtcgctggcggccaagatcgcgccggagaaagggaagcgggcctcggtcgcgtccgcggtgtccgccgatctcgactccgcggtgccagcgctcctctcgttcgccaagggcggggcgggcgccgacgcgcgcgtggacgaggtgagggtccttgctaccgtggccccggagctggtcccttacctgacgggggatggcacggataatcgcgacagggtaagtatggcggtggaggccctggccgcccgtgctgtccgccgaaggggatcgcggaataggccagcgaaggggctccgccctg

SEQ ID NO: 74207 - protein, 226 aa, Zea mays
  misc_feature: Ceres CLONE 1558568
  misc_feature (29)..(101): Pfam Name: U-box Pfam Description: U-box domain
MDAAIAGQQARRRIQPQEPLVMAGTPPKPAAFRCPISLEVMRSPVSLPTGATYDRASIQRWLDSGHRTYPATRLPLASTDLVPNLLLRRLINLHAATLPPSPSPEEVLSQLAAADGEPAAAEKAVRSLAAKIAPEKGKRASVASAVSADLDSAVPALLSFAKGGAGADARVDEVRVLATVAPELVPYLTGDGTDNRDRVSMAVEALAARAVRRRGSRNRPAKGLRP

SEQ ID NO: 74208 - DNA, 757 bp, Zea mays
  misc_feature: Ceres CLONE 1558569
  misc_feature: Encodes the peptide sequence at SEQ ID NO. 74209
  misc_feature (363)..(363): n is a, c, t, g, unknown, or other
  misc_feature (573)..(573): n is a, c, t, g, unknown, or other
ctggagctccccgcggtggcggccgctctagaactagtggatcccccgggctgcaggaattcgtctcacccctagaaaaaacggcctcacactgcagaggcttggacggacgggatggacatggcgcggtacgagtcatgctaccggcactggatcgccgggcaggaggcaggcctcgccgagctcgaggcggcgtcggccaatgccgccgcgggccgggcaacggacgccgagctgcggaccgtggtggagcggtgcatgctcgggtaccaggactacgccacccgcaggcgcgcgctgtcgcgggaggacggcgtcgccttcttcgccccgccctggtgcaccgccttcgagaactccgtngctctggctcgggggctgccgcccttcgctcaccgtccgcctgctctacaacctctccggggagggcctggaggcgcaggtggaggagctgctcggcggcctcagcaacggcgtcatcccgaccggggcccctggggatcacgtccgctcagctggtgctcatcaacgacctccacagccggacggtgcacccaggagaacgccctgtcngaacggctcgccaccctgcaggaagacatcggcgaccgcccgctcctgcccatcgtgccggaagcgcgagctcgctgcccgcggcacgggtggggagctgcaactgctgcccacggaacctgccaacggcccggcccgggcggcggtctcagggcggccccggctaggaacgccggaaacccca

SEQ ID NO: 74209 - protein, 214 aa, Zea mays
  misc_feature: Ceres CLONE 1558569
MDMARYESCYRHWIAGQEAGLAELEAASANAAAGRATDAELRTVVERCMLGYQDYATRRRALSREDGVAFFAPPWCTAFENSVALARGLPPFAHRPPALQPLRGGPGGAGGGAARRPQQRRHPDRGPWGSRPLSWCSSTTSTAGRCTQENALSERLATLQEDIGDRPLLPIVPEARARCPRHGWGAATAAHGTCQRPGPGGGLRAAPARNAGNP

SEQ ID NO: 74210 - DNA, 778 bp, Zea mays
  misc_feature: Ceres CLONE 1558572
  misc_feature: Translation starting site: 165
  misc_feature: SWISSPROT Homolog: EC 3.2.1.14 Chitinase
ctggagctccccgcggtggcggccgctctagaactagtggatcccccgggctgcaggaattcgtctcacccctagaaaaaaaatcacctcacaacaagctgccccgcagcaacgaacacgaaccttggcagaacgaagctgaagtagttcgttgtgaacccagtatggcaaacgcgccgaggatcctggccctcggcctgctgctagcgctcctgtgcgctgccgccggcccggccgccgcgcagaactgcggctgccagcctaacttctgctgcagcaagttcggctactgcggcacgaccgacgactactgcggcgacgggtgccagtcgggcccgtgccgctcgggcggcggcggcggcggcggcggaggcggaggcagtggcggtgcgaacgtggctaacgtggtcagcgacgcgttcttcaacggcatcaagaaccaggccgggagcgggtgcgagggcaagaacttctacacccggagcgcgttcctgagcgccgtcaacaagtacccgggcttcgcccatggcgggacgggaggtggagggcaagcgcgagatcgccgccttcttcgcgcacgtcacgcacgagaccggacatttctgctacatcagcgagatcaacaagagccacgcctactgcgacgcatgcaacgggcagtggccgtgcgcggcggggcataagtactacgggcgcggcccgctgcagatctcgtggatctacaactacgggcccgcccggaggggactccggtttaaaggggctcgccgaacccaaa

SEQ ID NO: 74211 - DNA, 818 bp, Zea mays
  misc_feature: Ceres CLONE 1558575
  misc_feature: Encodes the peptide sequence at SEQ ID NO. 74212
  misc_feature (642)..(642): n is a, c, t, g, unknown, or other
  misc_feature (671)..(671): n is a, c, t, g, unknown, or other
  misc_feature (672)..(672): n is a, c, t, g, unknown, or other
  misc_feature (704)..(704): n is a, c, t, g, unknown, or other
  misc_feature (755)..(755): n is a, c, t, g, unknown, or other
ggagctcaccgcggtggcggccgctctagaactagtggatcccccgggctgcaggaattcgtctcacccctagaaaaactgcgtccacctccgccccccgccctccccgcgtcccccctctcctacgcagatcgtccaggtaagatgtcgtccgaggcggtgaaggtggcggtgccggagtcggtactccgcaagcggaagcgcgaggagcagtgggccgccgagaagaaggagaagtccctggccgagaggaagaagtccatcgagaaccggaagctcatcttcacccgcgccaagcagtacgccgaggagtacgatgcccaggagaaggaactggtacagcttaagcgtgaggcccgtttgaagggtggtttctatgtcagtcctgaggcaaagctgctatttgtgatccgcatccgtggtatcaatgccatgcatcctaagaccaggaagatattgcagcttctgcgtttgaggcagatattcaatggcgtgttcctgaaagtcaacaaggctaccattaacatgcttcgcagggttgagccttatgttgcatatgggtacccgaacttgaagagtgtcagggagttgatctacaagaggggctacggaaaactgaacaagcagaagatccctctgtcntacaaccaagtcatcaaggagggcttggnngcagcacacatcatttgcattgaggatcttgntcatgagatcatgactgtcggcccacacttcaaggaggcgaaccacttccntttggccctttaagctgaaagcaccgcttggggaagtctgaagaaagaggaggaccccttttg

SEQ ID NO: 74212 - protein, 207 aa, Zea mays
  misc_feature: Ceres CLONE 1558575
  misc_feature (13)..(83): Pfam Name: Ribosomal_L30_N Pfam Description: Ribosomal L30 N-terminal domain
  misc_feature (85)..(136): Pfam Name: Ribosomal_L30 Pfam Description: Ribosomal protein L30p/L7e
  misc_feature (176)..(176): Xaa is any aa, unknown, or other
  misc_feature (187)..(187): Xaa is any aa, unknown, or other
  misc_feature (204)..(204): Xaa is any aa, unknown, or other
MSSEAVKVAVPESVLRKRKREEQWAAEKKEKSLAERKKSIENRKLIFTRAKQYAEEYDAQEKELVQLKREARLKGGFYVSPEAKLLFVIRIRGINAMHPKTRKILQLLRLRQIFNGVFLKVNKATINMLRRVEPYVAYGYPNLKSVRELIYKRGYGKLNKQKIPLSYNQVIKEGLXAAHIICIEDLXHEIMTVGPHFKEANHFXLAL

SEQ ID NO: 74213 - DNA, 739 bp, Zea mays
  misc_feature: Ceres CLONE 1558576
ggagctcaccgcggtggcggccgctctagaactagtggatcccccgggctgcaggaattcgtctcacccctagaaaaatcgacaacaccgcgcgcgcaatacacgggacacacgcagatccgagctaaccaccgcagatccgagattatccagccggagcgaccttttcttttttcttttacacagcgggacagagaaaggagtcaggcagccaaagccacccaccgcttttaccgatcggcgttgccgccaccgctagcattgtcggcttcagctccatccaaatccaccgccagcaagcaagccggcgccatgggtccttgccgatgaaggagggagagggtacgcggaggcggagctgaacctgccgccgggagttccggttccaccccaccgacgacgagctggtggagcactacctgtgccgcaaggcggcggggcagcgcctccccgtgcccatcatcgccgaggtggacctgtacaggttcgacccctgggacctgccggagcgcgcgctcttcggggcccgcgagtggtacttcttcacgccccaggaccgcaagtaccccaacgggtcccgccccaaccgcgccgccggcaacgggtacggggaggccaccggcgccgaacagccccgtggggccgcgcggccgaacgctcgggatcaagaaagggctcggtcttctaccccgggcaaggcgccgcgcggggtcaagacggactggatcttggccgattc

SEQ ID NO: 74214 - DNA, 829 bp, Zea mays
  misc_feature: Ceres CLONE 1558577
  misc_feature: Encodes the peptide sequence at SEQ ID NO. 74215
ctccccgcggtggcggccgctctagaactagtggatcccccgggctgcaggaattcgtctcacccctagaaaaaaccccatcgcacgcactcctcatcttatcccccgcctcctccggtcctcccgccgctgttgctcacttctgagtcccgacgcacgagctcccaagagctagccatggcgtccaccaccctctcctccgccttcaccctcctatcccgcccctccacctccccgtgccccgccgcctcgctcccgaggtcctcccacgccgcgccccacatccgccggggccgccgcgccgtcgccgtcgcgtgcaccgccaccgagtcccccaagatcctggagctcggggacgccatcgccgggctcacgctcgaggaggcccgcagcctcgtcgaccacctccaggagcggctcggcgtcaccgccgcggccttcgcgccggccgccgtcgtcgcggcgcccggggcgggcggcggggccgcggccgaggaggaggcccccgtcgagaagacggagttcgacgtgatgatcgaagaggtgcccagcagcgcgcgtatcgccactatcaaggtggtgcgcgcgctcaccagcctcgcgctcaaggaggccaaggaccttatcgagggtctccccaagaaggtcaaggaggccgtcagcaaggacgaggccgaggacgccaagaagcagctcgaggaggtcggcgccaaggtgtctatcgcgtgacactaggtatacgaggactccttttttttttctttagtttcttttgtttgcatccccaatctcttgtatccccactatcgttcgtaaggaattgctgttc

SEQ ID NO: 74215 - protein, 183 aa, Zea mays
  misc_feature: Ceres CLONE 1558577
  misc_feature (115)..(183): Pfam Name: Ribosomal_L12 Pfam Description: Ribosomal protein L7/L12 C-terminal domain
MASTTLSSAFTLLSRPSTSPCPAASLPRSSHAAPHIRRGRRAVAVACTATESPKILELGDAIAGLTLEEARSLVDHLQERLGVTAAAFAPAAVVAAPGAGGGAAAEEEAPVEKTEFDVMIEEVPSSARIATIKVVRALTSLALKEAKDLIEGLPKKVKEAVSKDEAEDAKKQLEEVGAKVSIA

SEQ ID NO: 74216 - DNA, 756 bp, Zea mays
  misc_feature: Ceres CLONE 1558578
  misc_feature: SWISSPROT Homolog: EC 3.2.1.21 Beta-glucosidase
ggagctcaccgcggtggcggccgctctagaactagtggatcccccgggctgcaggaattcgtctcacccctagaaaaactaacccacgctgaggctgtctgatctttacaacaagtattacaagggcgagaacggccgcataggtcttgcatttgatgtaatgggtcgtgtgccatactgaacatcatttctagatgaacacgccaaagaaaggtccatggacattaacctatgatggttcttggagcctgtggttcgtggtgactaccacttctcaatgagatcgttagcgagggaacgactacacttcgtcagtgacaaacagcaagagaagcttgtgcgatcctataacatgttggggataaactactacacctcaatagtgctccaacatatcgacatctgcacaaaatactcacctgttctcaacactgacgacgcctaccctagacaaaaacgtatgggcctgacggaaacccattggcctcccttgggaaatccggggacatactatccgaaaaggcttaacgatatcttttggacaggaaaaaaaagagggaaacccccttcctacttatttaaaaaggaaatggggagtgggcgaacaaaaagaaaaaccctctcccccggggggcgccctttaaaagggtcaaaaagggggggatttatttcccggcgccacaatttcaaatttggaaggagggcaaaaaaaaacttgggggaggaaataagggggggggggctcattttctcttg

SEQ ID NO: 74217 - DNA, 794 bp, Zea mays
  misc_feature: Ceres CLONE 1558579
  misc_feature: Encodes the peptide sequence at SEQ ID NO. 74218
agctcaccgcggtggcggccgctctagaactagtggatcccccgggctgcaggaattcgtctcacccctagaaaaaaagccctagccaaatcccagacccatcccagccctagcgacaccaaccagctcgccagcgaccatggggaacccggagaagctgatgaatcagatcttcgacctcaagttcacctccaagtcgctgcagcggcaggcgcgcaagtgcgagaaggaggagaaggagcagaagctcaaggtcaagaaggcgatcgagaagggcaacatggacggcgcccgcatctacgccgagaacgccatccgcaagcgcaccgagcacatgaactacctccgcctcgcctctcgcctcgacgccgtcgtggcccgcctcgacacgcaggccaagatgcaggtcatcggcaagtccatgcagtccatcgtcaagtcgctcgactccgcgctcgccaccgggaacctccagaagatgtccgagaccatggacaatttcgagcgccagttcgtcaacatggaggtccaggccgagttcatggagggcgccatggccgggtccacctccctctccacgcccgagaccgaggtcaacagcctcatgcagcaggtcgcggacgactaccggctcgaggtctccgtcggtctgccgcaagcagccgcgcacgccatccctggcggcaagggaaaggaaaaagtcgacgaagatgaccttttctcgccccctcccccgagcttaaggcccccggctggacagggtggtttcaggcttttatcaatggcgattcctt

SEQ ID NO: 74218 - protein, 218 aa, Zea mays
  misc_feature: Ceres CLONE 1558579
  misc_feature (9)..(179): Pfam Name: Snf7 Pfam Description: Snf7
MGNPEKLMNQIFDLKFTSKSLQRQARKCEKEEKEQKLKVKKAIEKGNMDGARIYAENAIRKRTEHMNYLRLASRLDAVVARLDTQAKMQVIGKSMQSIVKSLDSALATGNLQKMSETMDNFERQFVNMEVQAEFMEGAMAGSTSLSTPETEVNSLMQQVADDYRLEVSVGLPQAAAHAIPGGKGKEKVDEDDLFSPPPPSLRPPAGQGGFRLLSMAIP

SEQ ID NO: 74219 - DNA, 754 bp, Zea mays
  misc_feature: Ceres CLONE 1558580
  misc_feature: Encodes the peptide sequence at SEQ ID NO. 74220
  misc_feature (680)..(680): n is a, c, t, g, unknown, or other
ggagctcaccgcggtggcggccgctctagaactagtggatcccccgggctgcaggaattcgtctcacccctagaaaaagccccagccagaacctaaaccgaaacctatgccacatccagagccgaagcctgaacctcaaccaaagcccaaccctgaacctcagccaatgcccaagcctcgaccaaaatccaaaccagagccattgcctacaccgaagccggaacctaagcccgaacctaagccagagcctgagcccgaagcgaaaatgaagccaaagccaaaacctgaatcaaaaccagagccaaagccagatcacgaacctgagccaaagccactagccgaaccaaaaccagagccgggaccagacccctaaccatagccaaagccagagccgcagccaataaccagagcctaatccagagcctatacctgagccgacaccatagcctaaaccagagacccaagctaatgacgagactccccctgatccgactccggaacctaagccgatctactactaaagccagagcctaagcgagacccttatgatcagccagaaccagtacgccaacccaactctgtacctaaatcagaaccggatccggaatgttgacccgaacgagaaccctagacgcatgcagagccgtctcccgtgactacgacaggatccgatgcatgcngcgccgctgatccactatccgagacgctcatccacattggaaacccatatcgcatggctgattactctcggtaa

SEQ ID NO: 74220 - protein, 36 aa, Zea mays
  misc_feature: Ceres CLONE 1558580
MISQNQYANPTLYLNQNRIRNVDPNENPRRMQSRLP

SEQ ID NO: 74221 - DNA, 824 bp, Zea mays
  misc_feature: Ceres CLONE 1558581
  misc_feature: Encodes the peptide sequence at SEQ ID NO. 74222
ctccccgcggtggcggccgctctagaactagtggatcccccgggctgcaggaattcgtctcacccctagaaaaaagctctccaccaagagcttgtaccccacaccactaggcactagtccactacctaacgctacctgccttttcaccgcgtcgtgcgctaccgccacgttgagctcgcgtccgtcccagatccgccgtgctcctccatcgctcgcgcaaggttggttgctggcctcgcctgctcgcctttccttcaactccttcccgccttgcaggatttgggctttctcgatcacgaggcgctccgatgaagatcatggtgcgggggtcggagatggtgtacccggcggcggagacgccgcgccgccgcctctggaactcgggccccgacctggtggtgccgcggttccacacgcccagcgtctacttcttccgccgcgaggacgcggacgggaacgacctggcgggcgcggacgggagcttcttcgacagggcgcggatgctgcgcgcgctggccgatgcgctggtgcccttctacccgatggccggccggctggcgcgcgacgaggacggccgcgtcgagatcgactgcaacgcggggccgggttgcttgttcccggaaggcggaacgcccccaaacgccccattcgactactttggggaactttccccccgactattggaagttcaagaagctttttccccaaccgtcgaattcccggaaggaaaatttgcctccttcccgaaggttccttggccccagggggaccccccttcaaatttggggggggcgggggctttcccgccctttgggaatcccacc

SEQ ID NO: 74222 - protein, 172 aa, Zea mays
  misc_feature: Ceres CLONE 1558581
  misc_feature: SWISSPROT Homolog: EC 2.3.1.144 Anthranilate N-benzoyltransferase
MKIMVRGSEMVYPAAETPRRRLWNSGPDLVVPRFHTPSVYFFRREDADGNDLAGADGSFFDRARMLRALADALVPFYPMAGRLARDEDGRVEIDCNAGPGCLFPEGGTPPNAPFDYFGELSPRLLEVQEAFSPTVEFPEGKFASFPKVPWPQGDPPSNLGGAGAFPPFGNPT

SEQ ID NO: 74223 - DNA, 799 bp, Zea mays
  misc_feature: Ceres CLONE 1558584
  misc_feature: Encodes the peptide sequence at SEQ ID NO. 74224
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (799)..(799): n is a, c, t, g, unknown, or other
ctcaccgcggtggcggccgctctagaactagtggatcccccgggctgcaggaattcgtctcacccctagaaaaaagggacatatataataataagctaatagcagcgccacgcaccgacaccaatacgccatgggttccatcatggagcaacgctgcaacaacgatccgcaggcgctgctcgacgctcagctcgagctctggcacagcacgttcgcgttcatcaagtccatggcgttcaagtcggcgctggagctcggcatcgccgacgccatccactgccacggcggcaccgccacgctcacccagatagccaccaaggccgcgctccacccgtccaagacaccgtgcctgcgcaggctcatgcgcgcgctcacagtcgccggcatcttcagcgtcgccaagaactcgtccgacgatgacagcgatcagcacgtctacggcctcactccggcctcccgacttcttgtcggctcgtcacagaacttggctccaacactgagcctcatccttaacaacgtcttcgtggccccgttccttgacctcggcacgtggttcgagagcgcgctgccagctacagacctgccgctcttcgagctgtcccaccggaaaaacgtgtggggacgtcgtcgggcacgaacccgtccgtgagccagctcttcaacgcccgggaatggtcgcggaatacccgcttcctcatggacatcgcccgtcagggagtgccggcgaacgtgttttcagggggatacgctcccctgggtcgaacgtttgggcggccggccattggcnnncggcggcgcn

SEQ ID NO: 74224 - protein, 172 aa, Zea mays
  misc_feature: Ceres CLONE 1558584
  misc_feature (34)..(82): Pfam Name: Dimerisation Pfam Description: Dimerisation domain
  misc_feature: SWISSPROT Homolog: EC 2.1.1.146 (Iso)eugenol O-methyltransferase
MGSIMEQRCNNDPQALLDAQLELWHSTFAFIKSMAFKSALELGIADAIHCHGGTATLTQIATKAALHPSKTPCLRRLMRALTVAGIFSVAKNSSDDDSDQHVYGLTPASRLLVGSSQNLAPTLSLILNNVFVAPFLDLGTWFESALPATDLPLFELSHRKNVWGRRRARTRP

SEQ ID NO: 74225 - DNA, 865 bp, Zea mays
  misc_feature: Ceres CLONE 1558585
  misc_feature (566)..(566): n is a, c, t, g, unknown, or other
ctggagctccccgcggtggcggccgctctagaactagtggatcccccgggctgcaggaattcgtctcacccctagaaaaaagagaagctgctcatcaccgacgatggtgccacggctaacacaagcaagcaagcaagtcactgaatagatagcagtatataccaccatataaacaaacacacacacacgtgcgctaataagctaagcttaaggcggtagccgtagctcctctcgatctccggctcagacggacgacgttgccatggctgctcaaatgcatcacgcactatacgagctgctgcacgaagaaacagcagagctacgagctctgctgctcgcgatccccttctccctgctgctcctgccgctcctgatccgctacctcgcagctgactgcgtcggcgtctgcacgaaaaaaacaggggaaccgggggccaggccacagaccacctagcaggctcttgtagcactgcatggccatcgacacgcgcagtgcaaggtccaccatgcatgcgacgcacctgtgaccgtgcatgggcgagacgatctgccgtacgctcgtaccnttcgtgcgagactctgccgacccaccgtacgtgctgcggtacagtgtactgctgtcatcaggccgttccgatcagctgtcgggaccagtgactgactctccttggggcctcgctgctccgaaaagggccgctgctatcgacaactacggaccgggtgtcttggtccctgcagccgggggctcgcatggcacggcaaacatgaactttcctaggggagccgtcacgacctcgtgattgaaagcgcctagggctgactgatttatcgcagggcgggcaagactggggctcatggcaaccgg

SEQ ID NO: 74226 - DNA, 726 bp, Zea mays
  misc_feature: Ceres CLONE 1558586
  misc_feature: Encodes the peptide sequence at SEQ ID NO. 74227
ggagctccccgcggtggcggccgctctagaactagtggatcccccgggctgcaggaattcgtctcacccctagaaaaaacggcgcacccctcgtgttcccttttcgtccttgttcctcaacgtcgccggtgcgcccgcctcctgcctctctccccctgcgagcgatcgtgaggggatcgggatggcctcccaccattccgagcccctcgaccccgccgacgctgacgacccctcagataacaacccagaattaccatgcccctcctatcatatcgttaccaaacctggtcaactcccagtcgagtttcttgaaccctcagctgcccagaagttggtaattggatttgactgtgaaggtgttgatctctgccgcaatggtgctctctgtattatgcagcttgcattccctgatgctgttttacctagttgatgctattgagggtggaaaagaacttattcaagcttgctttgtattttcagtttggcataaaactgcataatgtgatggatacacagattgcttattctctgatagatgagcaggagcaggaaggaaaaaagaagacatctgatgattacaattacatatcttttgtcagcccttcttgctgataaacgatactgtggcatactatatcctgataaagaaagaagtccgtacccttgctaaggcaaggaccctaacttttgggacaatataagccccttgtcggaaaaggaagggtc

SEQ ID NO: 74227 - protein, 82 aa, Zea mays
  misc_feature: Ceres CLONE 1558586
MASHHSEPLDPADADDPSDNNPELPCPSYHIVTKPGQLPVEFLEPSAAQKLVIGFDCEGVDLCRNGALCIMQLAFPDAVLPS

SEQ ID NO: 74228 - DNA, 755 bp, Zea mays
  misc_feature: Ceres CLONE 1558588
  misc_feature: Encodes the peptide sequence at SEQ ID NO. 74229
ctcaccgcggtggcggccgctctagaactagtggatcccccgggctgcaggaattcgtctcacccctagaaaaactcgtttcttcgccgtcgctttgcgagtgtggacgggacggatacatgagggagaacggcgccgccagggacgagggccccgccttgtgcaaggccgctgcggcggacgggggcggggatgtgggcgccgcctccgcccgccgccgccgccggctcgggcgtgccacggaggggcctgctccgacgaagagaatccggtcggggtcgcagaggtcgccgtacgactcgtctctggagacggcgacggacggctgctgctggccggcgcgcctatcgcatggcgccgtgtcggtgatcgggcggcggagggagatggaggacgcgttcgccgtcgcgctctcgttcctggcctcggaggccgtgggcggcgagcaggagcatgagctggacttcttcgccgtgtacgatggccacggcggtgcaagggtggcggaagcgtgccgggagcggatgcccttggtgctgggccgaggaagtcagcctgcgccgccgccgcagcggcagcgaccacctgcgcctggggaggaggccatggcggccagctttcgcccgagtggaacggcgaggtgaccggggggcttggtcttcccccgctcagtgacaacgccgggcagcagcttggccttaaccggaaccgtcggggtcccaccgcccttcatctgccccgtccgtggggccggt

SEQ ID NO: 74229 - protein, 174 aa, Zea mays
  misc_feature: Ceres CLONE 1558588
  misc_feature: SWISSPROT Homolog: EC 3.1.3.16 Phosphoprotein phosphatase
MRENGAARDEGPALCKAAAADGGGDVGAASARRRRRLGRATEGPAPTKRIRSGSQRSPYDSSLETATDGCCWPARLSHGAVSVIGRRREMEDAFAVALSFLASEAVGGEQEHELDFFAVYDGHGGARVAEACRERMPLVLGRGSQPAPPPQRQRPPAPGEEAMAASFRPSGTAR

SEQ ID NO: 74230 - DNA, 750 bp, Zea mays
  misc_feature: Ceres CLONE 1558590
  misc_feature: Encodes the peptide sequence at SEQ ID NO. 74231
tggagctccccgcggtggcggccgctctagaactagtggatcccccgggctgcaggaattcgtctcacccctagaaaactaatttcttcgccgtcgctttgtgagtgtgggagcccaacaacccgcgcggcccttctcctcctctccggtttccgttttgattcctcccaattccctcgcgcgtagtcgcgtaaatttcccagcccgaaaatggccatagccttgaggcactattaggcacagtaaaacccaaccggggcccgctccaacaaccccaccccattgacaccgtcggcgagggcacccaggtccgcgtagcaccacgtcagccagacactcaccaggccaccaccgccctcagctccggtgtgcaaagacgctggatggcctcacacaagaagaatccgtccggcactttttgccctagcccaccccactcgagcaatccggacacgagtggatttgacacatattcgcagggtaccaccggcatctgcctcaattgatccgccatgtctcaatccaacgtatggcggcggtgccggaggaatcgtcatctgctgccgccaaggaagtggagtacacgaccggcgtgcagaagcatgtggacctgctctctaatctcaacccggacggccaggtagatcggtcgcttcctcggcctccggccgatgactgcgtcgccccccaaaaaaaccctactcgagcggatgcgtccggtggtcgaattacggcctccaccgcaggggc

SEQ ID NO: 74231 - protein, 73 aa, Zea mays
  misc_feature: Ceres CLONE 1558590
MAAVPEESSSAAAKEVEYTTGVQKHVDLLSNLNPDGQVDRSLPRPPADDCVAPQKNPTRADASGGRITASTAG

SEQ ID NO: 74232 - DNA, 792 bp, Zea mays
  misc_feature: Ceres CLONE 1558592
  misc_feature: Encodes the peptide sequence at SEQ ID NO. 74233
  misc_feature (533)..(533): n is a, c, t, g, unknown, or other
ctccccgcggtggcggccgctctagaactagtggatcccccgggctgcaggaattcgtctcacccctagaaaaatgtttgccacgctgccactcgggcaagagactgctcgaccggaccgacgagcgacgaagcgcgcagaaagagaagaacctcggagctgagatggcacaagccatggcgtcgatgaccggcctctcgcagggcgtcctgcccagcaggcgcgccgacagcagaaccaggacggccgtcttcatcgtcagggcgtccgcggagggcgacgccgttgcgcaggcgggccgccgcgccgtgatcgggctggtggccactggcatcgtcggcggcgccttgtcgcaggcggcgcgcgccgagaccgtcaagaccatcaagattggagccccgccgccgccctccggtggactccccgggactctcaactctgaccaggcgagggacttcgacctccccttgaaggagcggttctacctgcagccgctgccaccggcggacgcggcggcgagggtgaagacgtcngcgcatgacatcatctacctcaagccgctcatcgacaataaggcgtggggcgtacgtccagaacgacctgcgccgtccgggcctcttacctgcgctacgaactcaagaccggcatccgcttcaggcccaagggaggaaaaataggaccctccaaggagctcaccggaaaagcttttcgcggcaatccgaggatctttggccattgccggcgaagatctagaagcacccccggaaggccgaaaaaataccttcgcaagcc

SEQ ID NO: 74233 - protein, 170 aa, Zea mays
  misc_feature: Ceres CLONE 1558592
  misc_feature (15)..(165): Pfam Name: PsbQ Pfam Description: Oxygen evolving enhancer protein 3 (PsbQ)
MAQAMASMTGLSQGVLPSRRADSRTRTAVFIVRASAEGDAVAQAGRRAVIGLVATGIVGGALSQAARAETVKTIKIGAPPPPSGGLPGTLNSDQARDFDLPLKERFYLQPLPPADAAARVKTSAHDIIYLKPLIDNKAWGVRPERPAPSGPLTCATNSRPASASGPREEK

SEQ ID NO: 74234 - DNA, 809 bp, Zea mays
  misc_feature: Ceres CLONE 1558593
  misc_feature: Encodes the peptide sequence at SEQ ID NO. 74235
  misc_feature (766)..(766): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (774)..(774): n is a, c, t, g, unknown, or other
  misc_feature (777)..(777): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
ctctcggcggtggcggccgctctagaactagtggatcccccgggctgcaggaattcgtctcacccctagaaaaaactcaaacaaactcaagcctgccctgccctgccttgttaagcaaagcaacccagctgcgagacacgagagctagctagagagagatggcggccacggtttcgtccttcccggtggtgaacatggagaagctggagaccgaggagagggccacggccatggaggtcatccgcgacggctgcgagaactggggcttcttcgagctgctgaaccacggcatctcgcacgagctgatggacgaggtggagcggctgaccaaggcgcactacgccaccttccgggaggccaagttccaggagttcgcggcccggacgctggaggccggcgagaagggcgccgacgtcaaggacgtggactgggagagcaccttcttcgtccgccacctcccggcctccaacctcgccgacctccccgacgtcgacgaccgctacaggcaggtgatggagcagttcgcatcggagatccggaagctgtcggagaggctgctggacctgctgtgcgagaacctgggcctggagcccgggtacctgaaggcggccttcgcggggtcggacggcccgacgttcggcaccagggtgagcgcgtaccccgcggtgccgcgcccggacctcgtcgacggccttcgcgcgcacaccgacgccggcggcatcgttgctgctgttccaggacgacaggtgagcggctcactccgggngnnngggnggnggggggnnnnnnnnnnnncgcccccccccccc

SEQ ID NO: 74235 - protein, 217 aa, Zea mays
  misc_feature: Ceres CLONE 1558593
  misc_feature: SWISSPROT Homolog: EC 1.14.17.4 Aminocyclopropanecarboxylate oxidase
  misc_feature (203)..(203): Xaa is any aa, unknown, or other
  misc_feature (204)..(204): Xaa is any aa, unknown, or other
  misc_feature (206)..(206): Xaa is any aa, unknown, or other
  misc_feature (207)..(207): Xaa is any aa, unknown, or other
  misc_feature (209)..(209): Xaa is any aa, unknown, or other
  misc_feature (210)..(210): Xaa is any aa, unknown, or other
  misc_feature (211)..(211): Xaa is any aa, unknown, or other
  misc_feature (212)..(212): Xaa is any aa, unknown, or other
  misc_feature (213)..(213): Xaa is any aa, unknown, or other
MAATVSSFPVVNMEKLETEERATAMEVIRDGCENWGFFELLNHGISHELMDEVERLTKAHYATFREAKFQEFAARTLEAGEKGADVKDVDWESTFFVRHLPASNLADLPDVDDRYRQVMEQFASEIRKLSERLLDLLCENLGLEPGYLKAAFAGSDGPTFGTRVSAYPAVPRPDLVDGLRAHTDAGGIVAAVPGRQVSGSLRXXGXXGXXXXXPPPP

SEQ ID NO: 74236 - DNA, 753 bp, Zea mays
  misc_feature: Ceres CLONE 1558594
  misc_feature: Encodes the peptide sequence at SEQ ID NO. 74237
  misc_feature (534)..(534): n is a, c, t, g, unknown, or other
ctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacngcggtggcggcggctactgtggcggcggcggctaccggtgggtggtggcggcgggctacagcggtggcaaccgtggcggcggctacggcaactccgacgggaactggaggaactgagcggtggggcccgcgcggccaagttatcctgttcgctaccgttgatgttaccctagtccagaggggttatccttcgttcctggccggggttggtgttgcccca

SEQ ID NO: 74237 - protein, 156 aa, Zea mays
  misc_feature: Ceres CLONE 1558594
  misc_feature (10)..(81): Pfam Name: RRM_1 Pfam Description: RNA recognition motif. (a.k.a. RRM, RBD, or RNP domain)
  misc_feature (48)..(151): Pfam Name: GRP Pfam Description: Glycine rich protein family
  misc_feature: SWISSPROT Homolog: EC 5.2.1.8 Peptidylprolyl isomerase
  misc_feature (119)..(119): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYXGGGGYCGGGGYRWVVAAGYSGGNRGGGYGNSDGNWRN

SEQ ID NO: 74238 - DNA, 785 bp, Zea mays
  misc_feature: Ceres CLONE 1558595
  misc_feature: Translation starting site: 173
  misc_feature (715)..(715): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
ctcaccgcggtggcggccgctctagaactagtggatcccccgggctgcaggaattcgtctcacccctagaaaaagttgtcttggcggctgcggcggagcacggaggcgaaggaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggaccgacaagacctaccctgctgggttcatggatgtcatttccatccctaagacaatggagaactacaggctgctttatgacaccaagggcacgcttccgtcttcacccaatcagggatgaggatgccaagttcaagctctgcaaggtgaggtccgttcagtttggccagaagggcatcccctacctgaacacctacgacggccgcaccatccgctaccccgacccgctcatcaaggccaatgacaccatcaagatcgatctggagaccaacaagatcatggacttcatcaagtttgacgtcggcaacgtggntcatggtgaccggcgggaggaacaccgggcggtgtcggagtgatcaagacaggagagccaggnnnggggt

SEQ ID NO: 74239 - DNA, 709 bp, Zea mays
  misc_feature: Ceres CLONE 1558596
  misc_feature: Encodes the peptide sequence at SEQ ID NO. 74240
  misc_feature (457)..(457): n is a, c, t, g, unknown, or other
  misc_feature (460)..(460): n is a, c, t, g, unknown, or other
ctggagctccccgcggtggcggccgctctagaactagtggatcccccgggctgcaggaattcgtctcacccctagaaaaaatcctactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcactagcagcacctcgagcgaggccgagcagcctatcgccgccggcgcccttcagcactctacgtagaagcacgagggcgaagaatggaccccgagcacgcgcacagggcacagatcacnganggaagtcgctgccgcggcggccgtcagcgccaggcagctacttattccacgagcaccccgagaagaagaagaacccaaggacccccaggaagctaccggcaaaaaaaagcccccccccctctttgggttgaacgttattaccgggccggcgcccgaacccaaaagatttttaggtcccggggccaaaaaacaacaacaccgggtttaaatttccctaaacccgcaagggcgggggggaaattttttttt

SEQ ID NO: 74240 - protein, 52 aa, Zea mays
  misc_feature: Ceres CLONE 1558596
MSEEKHHHFFNHHKKDEEQPAGEYGYSETEVVTATGEGEYERYKKEEKEHKH

SEQ ID NO: 74241 - DNA, 790 bp, Zea mays
  misc_feature: Ceres CLONE 1558600
  misc_feature: Encodes the peptide sequence at SEQ ID NO. 74242
gagctccccgcggtggcggccgctctagaactagtggatcccccgggctgcaggaattcgtctcacccctagaaaaaaaaaccctagccctcgcgccgccgccgccgtgcccagcgctcgagctcctcgcctgccgcgagctcgcgccgcaacgccaccatgaagttcaacatcgcgaacccgtctaccgggtgccagaagaagctggaaatcgatgacgaccagaaactacgtgccttttatgaccgaaggatctcccaggaggtcagtggtgatgctctgggtgaggagtttaagggttatgtcttcaagatcatgggtggatgtgacaaacaaggcttcccaatgaagcaaggagttctgacttctggtcgtgtccgccttctgctccacagaggcactccctgcttccgcggttatggcaggcgtaatggtgagcgcaggaggaagtctgtccgtggttgtattgtgagccaagacctatctgttatcaacttggtaattgttaagaagggtgagaacgatctgcctggttttactgacactgagaagccaaggatgaggggtcccaaaagggcctccaagatcaggaagctgttcaatcttgcaaaggatgacgacgtgcggcagtacgtgaacacgtaccgcaaggacatcactacaaagaatgggcagaaagtgagcaaggcacctaagatccagcggctttgtgacccccctgaccctccaaagggaagcggggctaaaattgctgacaaagaaaaaaaagatcgcttaaaaagaaagtcta

SEQ ID NO: 74242 - protein, 210 aa, Zea mays
  misc_feature: Ceres CLONE 1558600
  misc_feature (1)..(129): Pfam Name: Ribosomal_S6e Pfam Description: Ribosomal protein S6e
MKFNIANPSTGCQKKLEIDDDQKLRAFYDRRISQEVSGDALGEEFKGYVFKIMGGCDKQGFPMKQGVLTSGRVRLLLHRGTPCFRGYGRRNGERRRKSVRGCIVSQDLSVINLVIVKKGENDLPGFTDTEKPRMRGPKRASKIRKLFNLAKDDDVRQYVNTYRKDITTKNGQKVSKAPKIQRLCDPPDPPKGSGAKIADKEKKDRLKRKS

SEQ ID NO: 74243 - DNA, 805 bp, Zea mays
  misc_feature: Ceres CLONE 1558601
  misc_feature: Translation starting site: 137
  misc_feature: Pfam Name: RIP Pfam Description: Ribosome inactivating protein
  misc_feature: SWISSPROT Homolog: EC 3.2.2.22 rRNA N-glycosylase
  misc_feature (658)..(658): n is a, c, t, g, unknown, or other
tccccgcggtggcggccgctctagaactagtggatcccccgggctgcaggaattcgtctcacccctagaaaaaacaatgccaattgccagcaacccatccatactttcagctgttgatacaaaaagagaagagagaatggcggagccaaacccagagttgagtggtcttattactcaaacaaagaagaaaaatatagtgccaaagttcaccgaaatcttccccgtggaggacacggcctacccttacagcgccttcatcacctccgtccggaaagaagtgatcaaatactgcaccaaccatacaggcatcgtccagcccgtgctgccgctggagaagaatgtccccgagctctggttctacaccgagctcaaaacgaagaccaggtccatcacgctcgccatacgtatggacaacctctacctggtcggcttcaggacccccggcggggtgttggtgggagttcggcaaggacggcgacacccacctcctcgacgacaacgccaagtggctcggctttggcggccggtaccaggacctcatcggcagtaagggcctggagaccgtcaccatgggccgtgccgaaatgaccacggccgtcaactacctggcgaagaagacgacgacgacactagcagaaggcggcggaagaagaagaangagctgctgctgctgcaggcagcggctgacccccaagcccgagagaagagcaacctggcgaagctagtgatcatggtatgcgaagggctgcggttcttcaccgtgtcccgcaaggtagaccaaggggtcaagaagccgccagccgtg

SEQ ID NO: 74244 - DNA, 765 bp, Zea mays
  misc_feature: Ceres CLONE 1558602
  misc_feature: Encodes the peptide sequence at SEQ ID NO. 74245
ctggagctccccgcggtggcggccgctctagaactagtggaacccccgggctgcaggaattcgtctcacccctagaaaaagtgagagagaaacagaagaggaaaaggatccatggcggccaagctggcgaagagggcggggcgctccgcggcaaccacgctatggggcgcggcgaggggcttcgcatcggtggggtccgacatcgtctctgcggctcccggcgtgtcgctgcagaaggcgcggtcctgggacgagggcgtcgccaccaagttctccaccacgcctctcaaggacatcttctacgggaagaaggtggtcatcttcggcttgcccggtgcatatacaggggtttgttcacaagcgcacgttcctagttacaagaagaatattgacaagttgaaagcaaaaggaatcgactctgttatctgtgtagctgtgaatgatccgtatgtcctggatggatgggcaaaaaagctagacgctaaaatacaattgagttctatggtgactttgatgggagtttccacaaaagcttggatttggagatagacctttctgctgctttgcttggccgccgttctcacaggtggtccgcctttgttgacgatggtaagatcaagtctttccatgttgaagaagcaccgtccgactttaaagtttctggtgcccgaagtgatctttggaccagatctgagctcctcaatgaacttcgccatccttcagtttgtgccggcatacttccctctgcagcagccgaataaaatt

SEQ ID NO: 74245 - protein, 145 aa, Zea mays
  misc_feature: Ceres CLONE 1558602
  misc_feature (26)..(143): Pfam Name: Redoxin Pfam Description: Redoxin
  misc_feature: SWISSPROT Homolog: EC 1.11.1.15 Peroxiredoxin
MAAKLAKRAGRSAATTLWGAARGFASVGSDIVSAAPGVSLQKARSWDEGVATKFSTTPLKDIFYGKKVVIFGLPGAYTGVCSQAHVPSYKKNIDKLKAKGIDSVICVAVNDPYVLDGWAKKLDAKIQLSSMVTLMGVSTKAWIWR

SEQ ID NO: 74246 - DNA, 821 bp, Zea mays
  misc_feature: Ceres CLONE 1558603
  misc_feature: Encodes the peptide sequence at SEQ ID NO. 74247
  misc_feature (821)..(821): n is a, c, t, g, unknown, or other
ctccccgcggtggcggccgctctagaactagtggatcccccgggctgcaggaattcgtctcacccctagaaaaatttgccccggacatatcttgtgacgattcctgagccgcagcgaggccgatcttacgatcgagagctctctctggtcgcaggttgcgggagtggatgaagaactatccgactgtgagcgttgagtatagggaggctgtggacaaggccaggcgcatgctgcgagccctcatcgccgagaagagctgcgccccgttcatgctccgcctcgcgtggtactccgcggggacgttggacgtgtcgtcgaggaccggcggtccattcagaacgatgaagcatcagtcggaattggctcacggagctaacgcggggctggacatcacgttgcggctgctcgagcccatctaggaggagttggctatcatctcttacgccgatttctaacagctcgcgagagtggtggccgtgaaggtctccggtgggcctgagattcccttccaggccggtagggaggataagcctaaacccccagctgatgggagccttcctgatgccactaagggttctgaccacctgaggcaagtttttggcacgcggatgggcttgagcgatcaggactttgttgccctctctggtggccacaccttgggaaggtgctgcagacagcggtctggtttcgaggcggcctggactacaaaccctctgagctatgactactcttacttcaaggaacttctgagtgatgataatgcaggccttcttcaactccgagtgacaacgccctgctgagtgaccctgtctttcggcctn

SEQ ID NO: 74247 - protein, 83 aa, Zea mays
  misc_feature: Ceres CLONE 1558603
  misc_feature: SWISSPROT Homolog: EC 1.11.1.11 L-ascorbate peroxidase
MKNYPTVSVEYREAVDKARRMLRALIAEKSCAPFMLRLAWYSAGTLDVSSRTGGPFRTMKHQSELAHGANAGLDITLRLLEPI

SEQ ID NO: 74248 - DNA, 801 bp, Zea mays
  misc_feature: Ceres CLONE 1558609
ctggagctccccgcggtggcggccgctctagaactagtggatcccccgggctgcaggaattcgtctcacccctagaaaaaacctacgcgccgggcggaggcgcgggggcgctcgcgcagggaagatgcagggtccgcggtcccgcggggctgggcttcctcggaccctccaaggtcgcctgcctcccccgccccctcgccctcgccaggcggacgagcagccccgtcgcggtgggcgccaggctgcgatgcgcggcgtcgtcctcccccgcggcggcgcggcccgccacggcgccgcgcttcatccaggacaagaaggaggccttctggttctaccgcttcctctccatcgtgtacgaccacgtcatcaacccgggccactggacctaggacatgcgcgacgacgcgctggaacccgccgacctcttcaggcgccacctcacgggcatcgacgtcggcggcggcacggggttcaccacgctcggcatcgtatagcacgtcaacccagagaacatcacgctgctcgaccactccccgcaccagctcgacaatgcccagcagaaggaggccccgacggggtcaccatcgtggagggcgacgccgacgacctcccggttcccaccgactccttcgaccgataatctccgcccagcagcatcgagtactggccagtaccacagcgtgtgatcatagaagcctacacggtcctgagatttgatgggctaagctgtgtgatcgggcccgtctaccctaccttctggctgtcccgctgtcttcgcgaactgtggatgctcttccccca

SEQ ID NO: 74249 - DNA, 815 bp, Zea mays
  misc_feature: Ceres CLONE 1558610
  misc_feature: Encodes the peptide sequence at SEQ ID NO. 74250
  misc_feature (619)..(619): n is a, c, t, g, unknown, or other
  misc_feature (624)..(624): n is a, c, t, g, unknown, or other
  misc_feature (679)..(679): n is a, c, t, g, unknown, or other
  misc_feature (789)..(789): n is a, c, t, g, unknown, or other
ctcaccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggcntgccnaggtcgtgctcatgggcgccatcgagggggtacccgcgtcgccgggcgccgctcngggagaaggtcgtcgacccgctctacccccggcggcagctttcgacccggttcgggcttggccgacgaaccctgaaggccttccgggagctccaaggtgaaggagctcangaacgggccggctcgccattgttcca

SEQ ID NO: 74250 - protein, 206 aa, Zea mays
  misc_feature: Ceres CLONE 1558610
  misc_feature (64)..(205): Pfam Name: Chloroa_b-bind Pfam Description: Chlorophyll A-B binding protein
  misc_feature (164)..(164): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACXGRAHGRHRGGTRVAGRRSGRRSSTRSTPGGSFRPGSGLADEP

SEQ ID NO: 74251 - DNA, 749 bp, Zea mays
  misc_feature: Ceres CLONE 1558613
  misc_feature: Encodes the peptide sequence at SEQ ID NO. 74252
  misc_feature (742)..(742): n is a, c, t, g, unknown, or other
ctggagctccccgcggtggcggccgctctagactagtggatcccccgggctgcaggaattcgtctcacccctagaaaagtgatcgaccgggtcgctgcctccgatcctcttgctgcccagcaccctggctacttcagccagctagccaggtgagaccgactagctcgatctagctgctgaggcgtggccatggagggcgacgacgacggcccggagtggtatgatggaggtgggcggcgcgggcgccacagggaagggaaaaggcggcgcgctggacaagaacaagaagcgcttcagcgaggagcagatcaagtctctcgagtccatgttcgccacgcagaccaagctggagccgcgccagaagctgcagctggcgcgggagctcggcctgcagccgcgccaggtcgccatctggttccagaacaagcgcgcgcgctggaagtccaagcagctggagcgcgagtactccgcgctccgcgacgactacgacgcgctcctctgcagctatgagtccctcaagaaggagaagcacacgctcctcaagcaggtcagtcaggctcgtcatacccctccatctcccgttcgttcgttgatgatccgttccaccgctctcactcagatgatcatcacgcctatatatgtccagttcatcttttcccccctaacgatatgatcgaccgattcttgcagctggagaagctagccgagatgctgcacgagccgcgggggcagtacagcggcnatgcgga

SEQ ID NO: 74252 - protein, 150 aa, Zea mays
  misc_feature: Ceres CLONE 1558613
  misc_feature (21)..(75): Pfam Name: Homeobox Pfam Description: Homeobox domain
  misc_feature (76)..(120): Pfam Name: HALZ Pfam Description: Homeobox associated leucine zipper
MMEVGGAGATGKGKGGALDKNKKRFSEEQIKSLESMFATQTKLEPRQKLQLARELGLQPRQVAIWFQNKRARWKSKQLEREYSALRDDYDALLCSYESLKKEKHTLLKQVSQARHTPPSPVRSLMIRSTALTQMIITPIYVQFIFSPLTI

SEQ ID NO: 74253 - DNA, 775 bp, Zea mays
  misc_feature: Ceres CLONE 1558615
  misc_feature: Pfam Name: DUF309 Pfam Description: Domain of unknown function (DUF309)
  misc_feature (557)..(557): n is a, c, t, g, unknown, or other
ctccccgcggtggcggccgctctagaactagtggatcccccgggctgcaggaattcgtctcacccctagaaaaaaccacatcccccaaggcaaggcgtacgtggcacgcgcgcgtccatctccacaacgacgaccttcatggcggtgccggcctccgcctccgcgtgcgcgcgcgccggcccgccgcagccccgccaccgcgcgcgtagtgccgccgcgaccgcggcggcgttcttgctccgccgccaccagcgaccgccacggcagataataaacatcgtcgacgaccgccgtgccagctccgatctccgctgccggcgacggctcctcacggcgcgaggcgagcgcccgtcccacgacgacgacgaggacgaggagcagacgtcgtctgctggtggtggttacggctcgttcggcgcggcggtggcgctgttcaaccgcggcgagtaccacgcgtgccacgacgtggtgggaggagctgtggtacagcgccgaggaccccgcccggacgctcctccacggcctcctccagtgcgccgtcggcttccaccacctcntcaaccagaaacaccgcggcgcgatgatggagctcggcgagggcctcctgcagcctccgtaagctgcagctagaacggcaaaagggacggggaaggggaacggggggggcccttttcccccggttccgggaaaaagggccccccctttgtttgaaatttccttttccccgacccccaaaaaaggggcccccccccagggcccccaaaaaagtttggtt

SEQ ID NO: 74254 - DNA, 801 bp, Zea mays
  misc_feature: Ceres CLONE 1558618
  misc_feature: Encodes the peptide sequence at SEQ ID NO. 74255
ctggagctcaccgcggtggcggccgctctagaactagtggatcccccgggctgcaggaattcgtctcacccctagaaaaaatccatccatccatagatccctcacctcactcactcgtgaagaaccagagaacccacccaccctccttcatctcctacatccacatctatccaagaaggccatgggcgacgccgtggagcacctcaagagcgggttccagaagttcaagaccgaggtgtatgacaagaagccggagctgttcgagcctctcaaggccggtcaggcccccaagtacatggtgttcgcctgctccgactcccgcgtgtgcccgtcggtgaccctgggcctgcagcccggcgaggccttcaccgtgcgcaacatcgccgccatggtcccggcctacgacaagaccaagtacaccggcatcgggtccgccatcgagtacgccgtgtgcgccctcaaggtggaggtcctcgtggtcatcggccacagctgctgcggtggcatccgggcgctgctctccctccaggacggtgcacccgacaacttccacttcgtcgagaactgggtcaagatcggcttccctgccaaggtcaaggtgaagaaagagcacgcctccgtgcccttcgatgaccagtgctccatcctggagaaggaggccgtgaacgtgtccctggagaacctcaagacctaccccttcgtccaggaagggctggccaaggggaaccctcaagctggtcggcgcccactacgacttcgtgtccgggaacttcctcgtatgggaaacttagccacaccccc

SEQ ID NO: 74255 - protein, 206 aa, Zea mays
  misc_feature: Ceres CLONE 1558618
  misc_feature (31)..(192): Pfam Name: Pro_CA Pfam Description: Carbonic anhydrase
  misc_feature: SWISSPROT Homolog: EC 4.2.1.1 Carbonate dehydratase
MGDAVEHLKSGFQKFKTEVYDKKPELFEPLKAGQAPKYMVFACSDSRVCPSVTLGLQPGEAFTVRNIAAMVPAYDKTKYTGIGSAIEYAVCALKVEVLVVIGHSCCGGIRALLSLQDGAPDNFHFVENWVKIGFPAKVKVKKEHASVPFDDQCSILEKEAVNVSLENLKTYPFVQEGLAKGNPQAGRRPLRLRVRELPRMGNLATP

SEQ ID NO: 74256 - DNA, 761 bp, Zea mays
  misc_feature: Ceres CLONE 1558619
  misc_feature: Encodes the peptide sequence at SEQ ID NO. 74257
ctccccgcggtggcggccgctctagaactagtggatcccccgggctgcaggaattcgtctcacccctagaaaaaagctagcagtagccagtagctagtgctaccttcccctgctccgacctctatctgtcgttctgtctatctcgtccgtcgccgtcgagccggctatggagatgcagccacagctcggcgactcttctccggaggacaagctcgccagccgccctctgacacccggagggcgctggccggactcgcagtggcggcccgcagaggagaaggccatcgacgactggctccccatcaacgcgcggaggaacgccaagtggtggtactccgccttccacaatgtcaccgccatggtcggcgccggcgtgctcggcctcccctacgccatgtccgagctcggctggggccccggcatcgcggtgctgctgctgtcgtggatcatcacgctgtacacgctgtggcagatggtggagatgcacgagatggtcccgggcaagcgcttcgaccggtaccacgagctggggcagcacgcgttcggcgagcggctgggcctgtggatcgtggtgccgcagcagctggtgggtggatgtgggcctcaacatcgtctacatggtcaccggcggcacgtcgctgaagatttccacgacacggtctgcggcgacgacgaccaccggtgcaagggcagggacatcaagctcacctacttcatcatgatcttcgcctcctgccacttggtgctctcccagctcccca

SEQ ID NO: 74257 - protein, 198 aa, Zea mays
  misc_feature: Ceres CLONE 1558619
MEMQPQLGDSSPEDKLASRPLTPGGRWPDSQWRPAEEKAIDDWLPINARRNAKWWYSAFHNVTAMVGAGVLGLPYAMSELGWGPGIAVLLLSWIITLYTLWQMVEMHEMVPGKRFDRYHELGQHAFGERLGLWIVVPQQLVGGCGPQHRLHGHRRHVAEDFHDTVCGDDDHRCKGRDIKLTYFIMIFASCHLVLSQLP

SEQ ID NO: 74258 - DNA, 787 bp, Zea mays
  misc_feature: Ceres CLONE 1558620
  misc_feature: Encodes the peptide sequence at SEQ ID NO. 74259
  misc_feature (668)..(668): n is a, c, t, g, unknown, or other
ctccccgcggtggcggccgctctagaactagtggatcccccgggctgcaggaattcgtctcacccctagaaaaacgccgccccgcctcccatcgttacgttagtcgtccgcccgcgctagtgccatccacactcttctcttctccccggccggaccggagtcaggcagccgaagcaagaaaagcaagcggccttggaagttggaatccatggcgtccacctcgtgcttcctccaccagtccaccgcccgcgtggccgcgtcgtcgtcgccgcgcctcgccgccccgccgcgcagcgcgcaactgttcgtctgcaaggcccagaagcagcaggccgccgcggcggagagcgacgtgtcgcgccgcgccgcgctcgcgctcctcgccggcgtcgcggccgtcggcgccaaggcgagccccgccgccgccgcctacggggaagcagccaacgtgttcggcaagaccaagaagaacacggacttcatctcctacgtcggcgacggcttcaagctgctgatcccgtccaagtggaaccccagcaaggagcgggagttccccgggcaggtgctccgctacgaggacaacttctacgcctacagctacgtgtccgtcatcatccagcccacctccaagaagaccatcaccgagtactgctcccccgaggagtccntctcgcaggtcgactacctgctcggcaagcaagcctactgcggcaagaccgactccgatggcgggttcgagaccgacgccgtggccaccgtctacgtgctggagagctccaccccgtgg

SEQ ID NO: 74259 - protein, 193 aa, Zea mays
  misc_feature: Ceres CLONE 1558620
  misc_feature (57)..(191): Pfam Name: PsbP Pfam Description: PsbP
  misc_feature (154)..(154): Xaa is any aa, unknown, or other
MASTSCFLHQSTARVAASSSPRLAAPPRSAQLFVCKAQKQQAAAAESDVSRRAALALLAGVAAVGAKASPAAAAYGEAANVFGKTKKNTDFISYVGDGFKLLIPSKWNPSKEREFPGQVLRYEDNFYAYSYVSVIIQPTSKKTITEYCSPEESXSQVDYLLGKQAYCGKTDSDGGFETDAVATVYVLESSTPW

SEQ ID NO: 74260 - DNA, 781 bp, Zea mays
  misc_feature: Ceres CLONE 1558622
  misc_feature: Encodes the peptide sequence at SEQ ID NO. 74261
  misc_feature (599)..(599): n is a, c, t, g, unknown, or other
tccccgcggtggcggccgctctagaactagtggatcccccgggctgcaggaattcgtctcacccctagaaaaagcgtcagggcctctcgatcgctcatcagtcgccagaggagtagttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacaaggcgaccggggaggccatcaagcactcgctggggcagtcccacccgggtgcggcctggtgccctacaacccggacttttttggacgagtcngtgcttgtggaccggagaaccgcgacgtcggcaacggctttccgctgccgtccgcatggtcaacaacatcttacctcaaactcggacgcccctccacggcggacaagtgggaacgggcggcgtcccgtgaccggcaccggaagttcgtggcttctggaaaattggtggccaagggcgaacaa

SEQ ID NO: 74261 - protein, 203 aa, Zea mays
  misc_feature: Ceres CLONE 1558622
MDGGYYGGRDQRYSGGYYGGGGIATPGYAPAVPYGMSQVNIEGNGCGRALPPQPTVKVYCRANPNYAMSVRDGKVVLAPANPKDEYQHWIKDMRWSTSIKDEEGYPAFALVNKATGEAIKHSLGQSHPGAAWCPTTRTFLDESVLVDRRTATSATAFRCRPHGQQHLTSNSDAPPRRTSGNGRRPVTGTGSSWLLENWWPRAN

SEQ ID NO: 74262 - DNA, 746 bp, Zea mays
  misc_feature: Ceres CLONE 1558624
  misc_feature: Translation starting site: 216
  misc_feature: Pfam Name: HD Pfam Description: HD domain
gagctccccgcggtggcggccgctctagaatagtggatcccccgggctgcaggaattcgtctcacccctagaaaaaatcagcagcttccacgcgtgcctcgccatccccacctccgaaaggcacatcccccacaacgcaggagcgctgcgctccgggcgttcgggtactctgatactgcattgcggaatacgtagaaccgcaccgcatcgcagacatgggcgagttctgcccctccccgcagggggactccccgctggcggcgccccccttgacgctctcctccccgtccccgtcaacagcggttacgccgagctacgggagctgctaccgccgctacctaaagctggtcttcaatgacctccacaggagcatctccgtatgacccgttggccctgcaatttgttgataccgaacagtttcacacgttgcgagacttgaaactactatggtcttacttatctcgactatcctggagcgggtcacacacgcttccaacactcattaggtgtatattcattggatggaaaaggtcttaataatctcaatacatatcatcgcacaagaacttgcaattgatcatgttgacatgacttactgtgaaacttgcatgtctcttgcatgatatcggacatggacccttcagtcatttgtttgagcatgagttacttcctcgagttgatcctggatcatcctgatctcaacaagatatgtcactgctcctttttagacagcattgttgacgaac

SEQ ID NO: 74263 - DNA, 732 bp, Zea mays
  misc_feature: Ceres CLONE 1558628
  misc_feature: Encodes the peptide sequence at SEQ ID NO. 74264
  misc_feature (351)..(351): n is a, c, t, g, unknown, or other
tggagctccccgacggtggcggccgctctagaactagtggatcccccgggctgcaggaattcgtctcacccctagaaaaaattcgcaatccaaaaagcttgcgcgctactccactggtccattacttacgcagtcagttcagcgagtgagcactgagcagccatgtagcaatttcaattgcaagttgcaacgcgacgaatacggagccatgggacgacggcgccgcaaccacaatcgtccaaggcggcgacgcgcacgtcctgctcctgccgttccctgggatgcagggccacgcgaacccgatgctccagcttggccggcggctggccttccacggcctgcgccccaccnttggtgggtctcccgcacgtcctctacaccaaccatcaccttcaggtcgtgccccatcccccgtgggccgccatctcggaacgggctccgacgaacgggcggggatcttcctcgtgccccggaaacccgcggaaatacgtgccccccgaattggaagcccccggggggtccgaaaaaacctggggcgggaacctcccggaaaccccaagggccccggccgggggggggtcccgtcccccctgggctgggggtacaaaaactccaaatttgcccctggggggggccccacttgtgggccgggggcccccccggggttggcccccccccccccttttcttaaaaaccaaaatatgggcggggggggggccccctttcccaggg

SEQ ID NO: 74264 - protein, 150 aa, Zea mays
  misc_feature: Ceres CLONE 1558628
  misc_feature (24)..(24): Xaa is any aa, unknown, or other
MQGHANPMLQLGRRLAFHGLRPTXGGSPARPLHQPSPSGRAPSPVGRHLGTGSDERAGIFLVPRKPAEIRAPRIGSPRGVRKNLGREPPGNPKGPGRGGVPSPLGWGYKNSKFAPGGGPTCGPGAPPGLAPPPPFLKNQNMGGGGAPFPR

SEQ ID NO: 74265 - DNA, 795 bp, Zea mays
  misc_feature: Ceres CLONE 1558629
  misc_feature: Encodes the peptide sequence at SEQ ID NO. 74266
  misc_feature (473)..(473): n is a, c, t, g, unknown, or other
ggagctctccgcggtggcggccgctctagaactagtggatcccccgggctgcaggaattcgtctcacccctagaaaaaaagcacctgcagcgccgccagacactccgtagtctgtaccccaagcaccggcgcggcggcggcggctaccatggcagtcgggaagaacaagaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcagggtgacgaggatcaggcttacaggataatcaggctccgtgctgaagatgtgcaaggcagggatgtgctcacaaacttctggggcatgatttttaccaccgatnagctcagatctctaggtaagaagtgcagacattgatttgaagcccatgttgatgttcagaacacgaaaactacatgctggtttttgtccggcattgtttttcccaaaaggggccccaacccaggcaaaaagaacccggttaggccagggttccccaattccggcaaaattccccccaaaaaggttgaaatatttattaaacccgggtttccccatgtggacccttaaaaaacttggtttctaatatttttcccggaaattttttgggcaaaaaaatttggaaaaattttccccccccgtattcttccccattaaaaaaagtc

SEQ ID NO: 74266 - protein, 119 aa, Zea mays
  misc_feature: Ceres CLONE 1558629
  misc_feature (11)..(119): Pfam Name: Ribosomal_S3Ae Pfam Description: Ribosomal S3Ae family
  misc_feature (109)..(109): Xaa is any aa, unknown, or other
MAVGKNKRISKGKKGGKKKTVDPFSKKDWYDIKAPSVFSVRNIGKTLVSRTQGTRIASDGLKHRVFEVCLADLQGDEDQAYRIIRLRAEDVQGRDVLTNFWGMIFTTDXLRSLGKKCRH

SEQ ID NO: 74267 - DNA, 799 bp, Zea mays
  misc_feature: Ceres CLONE 1558632
  misc_feature: Encodes the peptide sequence at SEQ ID NO. 74268
  misc_feature (705)..(705): n is a, c, t, g, unknown, or other
  misc_feature (773)..(773): n is a, c, t, g, unknown, or other
ctggagctccccgcggtggcggccgctctagaactagtggatcccccgggctgcaggaattcgtctcacccctagaaaaatatataccactccctaggaggacccagcaacacaacagccgagctttgcttacgcaagatgaacaggaagccaggagactgggactgcagggcgtgccagcacctcaacttcagccgccgagacatatgccagcgctgtagcgagccacgtggagttgctgatcgtggcagtggcggcggcggaggaggaggaggaggcgactacgccagcttcggtggccgcggtggctcctccttctgcggcggctttggcgctgctggctctgacgtccgccctggtgactggtactgctcctgcggcgcgcactacttcgccagccgctccagctgcttcaagtgctccggctacaatgaggaggccgctgtgaacagtggcgctggcggctttgacggcgacatgtcacgctcacagggctacagattctgcagcggtgctgctggtgctggtgctggcgctgcccgtactacctaccgccgctgcttggtagtccgggacactggatctgcaccagatcctgatgacacgagcacaacctcgccagcacgatagagtgcttactgggcaacgcatcgctgagacttctgatagcgctgccatgaactacgaaaactacttgcactgganggcgtaggatccgtcccagatgatatagtctgcagcgactgaaagaagcgacgtacctagagagtccntcatccacgtcgtatccttacgagag

SEQ ID NO: 74268 - protein, 163 aa, Zea mays
  misc_feature: Ceres CLONE 1558632
MNRKPGDWDCRACQHLNFSRRDICQRCSEPRGVADRGSGGGGGGGGGDYASFGGRGGSSFCGGFGAAGSDVRPGDWYCSCGAHYFASRSSCFKCSGYNEEAAVNSGAGGFDGDMSRSQGYRFCSGAAGAGAGAARTTYRRCLVVRDTGSAPDPDDTSTTSPAR

SEQ ID NO: 74269 - DNA, 764 bp, Zea mays
  misc_feature: Ceres CLONE 1558635
  misc_feature: Encodes the peptide sequence at SEQ ID NO. 74270
  misc_feature (566)..(566): n is a, c, t, g, unknown, or other
  misc_feature (646)..(646): n is a, c, t, g, unknown, or other
aaactggagctccacgcggtggcggccgctctagaatagtggatcccccgggctgcaggaattcgtctcacccctagaaaaaacaccagggcacgacgagcgttgcgtcgtgagtgtttgtgtttcagagctgagactgagagagagagagagaggtggtgatggctctgcacgcgcaggggacgcgggtgccgctggtcctggcgctcttcctcctcctggccggttgtggcagcgaggcgcagccgctggtgccggcgctgtttacgttcggagactcgtcagtggacgtcgggaacaacgactacctccacaccatcatcaaggccaacttcccgccctacggcagggacttcgccaaccacgtcgccaccgggaggttctgcaacggcaagctggcgaccgacatcaccgccgacacgctggggttcactacctatcctgccgcgtacctcagcccacaggcgtcggggcagaacctcctcatcggcgccaacttcgcgtccgcggggtctgggtactacgaccacacggcacttatgtatcacgcgatcccgctgtcccancagctggaatacttcacgaagtaccagacgaatctttgcagcagtggcacggcagctgagcaggcgcgctccatcctcangcagcgcgactgtacgatcgtccagcgaccgacgcccggcgactttcgtgccagtagctactaccctaaaccccgcctgctgagtcaagaacgcaagaacggcccggaccaatttttc

SEQ ID NO: 74270 - protein, 201 aa, Zea mays
  misc_feature: Ceres CLONE 1558635
  misc_feature: SWISSPROT Homolog: EC 3.2.1.51 Alpha-L-fucosidase
  misc_feature (135)..(135): Xaa is any aa, unknown, or other
  misc_feature (162)..(162): Xaa is any aa, unknown, or other
MALHAQGTRVPLVLALFLLLAGCGSEAQPLVPALFTFGDSSVDVGNNDYLHTIIKANFPPYGRDFANHVATGRFCNGKLATDITADTLGFTTYPAAYLSPQASGQNLLIGANFASAGSGYYDHTALMYHAIPLSXQLEYFTKYQTNLCSSGTAAEQARSILXQRDCTIVQRPTPGDFRASSYYPKPRLLSQERKNGPDQFF

SEQ ID NO: 74271 - DNA, 714 bp, Zea mays
  misc_feature: Ceres CLONE 1558636
  misc_feature: Encodes the peptide sequence at SEQ ID NO. 74272
  misc_feature (387)..(387): n is a, c, t, g, unknown, or other
  misc_feature (512)..(512): n is a, c, t, g, unknown, or other
  misc_feature (513)..(513): n is a, c, t, g, unknown, or other
  misc_feature (520)..(520): n is a, c, t, g, unknown, or other
  misc_feature (521)..(521): n is a, c, t, g, unknown, or other
  misc_feature (533)..(533): n is a, c, t, g, unknown, or other
ggagctccccgcggtggcggccgctctagaatagtggatcccccgggctgcaggaattcgtctcacccctagaaaaaaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctngaatcagtactggagcaacatcaggtgccccagcaacaacgggcagagcagctggaagaacgcctggaagaaggcccggcgcctgctcccggcctcagcgagaaagactacttcgagactgcccnntctcttnncgtagcggatcnacccactcgtttcgcctcaaagccaaaggtatccgagcccggacttcgggcttcatacggccctaaagggggaatcacccaaggggtctctcagaagaagggggtttttaaacccgaaacccccgcggggtttttcccctttgttgcaaaaggggggccccccttcccaaaaaaaaaaaaa

SEQ ID NO: 74272 - protein, 207 aa, Zea mays
  misc_feature: Ceres CLONE 1558636
  misc_feature: SWISSPROT Homolog: EC 3.1.27.1 Ribonuclease T(2)
  misc_feature (140)..(140): Xaa is any aa, unknown, or other
  misc_feature (143)..(143): Xaa is any aa, unknown, or other
  misc_feature (147)..(147): Xaa is any aa, unknown, or other
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLESVLEQHQVPQQQRAEQLEERLEEGPAPAPGLSEKDYFETAXSLXVADXPTRFASKPKVSEPGLRASYGPKGGITQGVSQKKGVFKPETPAGFFPFVAKGGPPFPKKKK

SEQ ID NO: 74273 - DNA, 887 bp, Zea mays
  misc_feature: Ceres CLONE 1558637
  misc_feature: Encodes the peptide sequence at SEQ ID NO. 74274
cccgcggtggcggccgctctagaactagtggatcccccgggctgcaggaattcgtctcacccctagaaaaaacgaccgccagcagccatcgcatccgaatcccaagctttctcctctccgtgcaggtgcagcagccagcgcgcgcgtctctacaggaaacagagagcatccgagtcccaaagctcgcagctttgccagcaaagcaagaagacagttgcggcatggagctggagcttgggctggcgccgccgagcgcgcgccgtcccacccccatgacgatcgaccagcagcagcagcagcagcaacgccacctcgccgaggacgagctgagcagcacctcgtccgaccatcaggggtgcggtgggggctccgggaaaaaaggattcgcggaaacgttccaggaagcgggcgggcaacgacgactaacgctgccgctccttcaaagaaccgggtcgtcctggcagggaggaaaaaaccggcggggggcaacaaagccccactgggtccgggtgggcccgccccattaaaacctcccgccgcggaagtcaagggcccctgtctcgcgagggggccacccccccccaacctacccctgaaaaggggaaaagaaaacggaagggccgaagccccctgccgggaccagggaaagaggggggaccctgggcgcacctccctccccacgtaagtaaaagaaaagaaaggtgctctggagggcgggccattcggcgcccttgagaggagaccccacgaaaacccccacccggagcgtgaggcaaaaaaaagagatgaggggacaacagaccgcgcgcctaaaacccgcgccgcgaaagaatgttgcgccacccgcccccgccatacgaacagggggtagtaaaggactcgcaggt

SEQ ID NO: 74274 - protein, 101 aa, Zea mays
  misc_feature: Ceres CLONE 1558637
MELELGLAPPSARRPTPMTIDQQQQQQQRHLAEDELSSTSSDHQGCGGGSGKKGFAETFQEAGGQRRLTLPLLQRTGSSWQGGKNRRGATKPHWVRVGPPH

SEQ ID NO: 74275 - DNA, 816 bp, Zea mays
  misc_feature: Ceres CLONE 1558638
  misc_feature (592)..(592): n is a, c, t, g, unknown, or other
  misc_feature (654)..(654): n is a, c, t, g, unknown, or other
  misc_feature (671)..(671): n is a, c, t, g, unknown, or other
tccccgcggtggcggccgctctagaactagtggatcccccgggctgcaggaattcgtctcacccctagaaaaaaacatactgcactagttcagtggttagtttcctattcaaccatttcgtaatgaaggaggtattggtatttaggtaaatatttatttatgattgtgctggtattatctcaataggctggaaaattttaaataacctaatatgacataaacctcaactgcccatgcactcttagttgttgttttgaaccggtctttcgttgtttttcttttcaccaaaaaataaaatcttgatgatgtgtgacacacctgtttggttatatcatgttatctatgtagttcggccaattaaactatgttatcaggtataactagatgaggcaaattatatatatatatatatatatatatatatatatatatatatatatatatatatatatatatatatatatatatatatatatatatatatatatatatactatctatacacccctctctctcccttaaccggatcaaaccgctcgttctccctaaagacaaaggttccccccccgaactgccgggctttagtgtctcngggcgaaatccttaggtcgcccaaaaggcgcattaaacgcaaaccccgcgaagcgcgggcgngcaggggcccccctccnttcaaattctttttttttttctaaatcttacctccgccccccgctgggaaaaaaggccacttttaaataaaacatcccccctaccccccaattttttttattcctatttttccaaaaaaaaaacccttttgcccggcgcggtggt

SEQ ID NO: 74276 - DNA, 821 bp, Zea mays
  misc_feature: Ceres CLONE 1558639
  misc_feature: Translation starting site: 212
  misc_feature (484)..(484): n is a, c, t, g, unknown, or other
ctggagctccccgcggtggcggccgctctagaactagtggatcccccgggctgcaggaattcgtctcacccctagaaaaagaaaccgacctttccccctcccccgcattccacctcgcggagatccagtccagccctagggtttcgccagcggcgagccaaactccacgagcgggggaagaggggaaagcagggacgacgagggggcagccatggggcagcagtcgctgatctacgcgttcgtggcccgtggcacggtcatactggccgagtacacggagttcaccggcaacttcaccaccatcgcctcccagtgcctcatgaagctccccgcaagcaacaacaagttcacctacaactgcgacggtcacactttcaattacctcgtggaagacggattcacatactgtgttgttgctgttgaatcggtggggcaacaaattcctattgctttcatggatagggtttagggagattcacaaaanggtatgtgggtgggaaagctgctactgctgcagctaacagcctcaatcgagagtttggatcaaaacttaaagacacatgcagtattgtgtggatcacccctcaagaggttagcaagcttgccaaagtgaaggcccagggtccaaaagtcaaggttgttaggatggaaaacattgaaaaggtccgggatccgggaaaaaaaaattgacctgccttgccaaaaaaaacgcaaaattcttcccctcacaggccccaagatttctaaaagccgggaaaacaatgcccgggaaaaaagaagtggggttcccgaaactggaaaatccggccctttcgcccggg

SEQ ID NO: 74277 - DNA, 805 bp, Zea mays
  misc_feature: Ceres CLONE 1558644
  misc_feature: Encodes the peptide sequence at SEQ ID NO. 74278
ctggagctcaccgcggtggcggccgctctagaactagtggatcccccgggctgcaggaattcgtctcacccctagaaaaaacttcccttccccagatctacctccattcttccctcaaaatcaccagatctctctcggccccgtgcccagcgctccgaaaccctagcgccgccgcgggtgccaggccgcgagcgtcgccatgggcatcgtgtttacgcggctcttctcgtcggtcttcggcaaccgcgaggctcgcatcctcgtcctcggcctggacaatgctggcaagaccaccatactctatagactgcaaatgggagaggtcgtctccacgatcccgacaattggattcaacgtcgagacggtgcagtacaacaacatcaagttccaagtatgggatcttggtggtcaaacaagcatcatgccatactggcggtgctactttccaaacactcaggctatcatatatgttgttgattcaagcgatacagataggcttgtaacagcagaagaagaattccatgtcatccttgacgaggatgaacttaaaggcgcagctgtccttgtgtatgcaaataagcatgatctgtcaggtgcactcgatgatgctgccattacagagtcattagatctacacgaaattacgagccgtctatggggcgactttcaaaacagctgctattaaaagcagagggggctcttcgaaaggttgggactgggctcagtaacacgctgcaaatcttgttagcagctgaaggagccctacgacatccgtcatgaaatcattttgcctggaggcttaaga

SEQ ID NO: 74278 - protein, 161 aa, Zea mays
  misc_feature: Ceres CLONE 1558644
  misc_feature (5)..(160): Pfam Name: Arf Pfam Description: ADP-ribosylation factor family
MGIVFTRLFSSVFGNREARILVLGLDNAGKTTILYRLQMGEVVSTIPTIGFNVETVQYNNIKFQVWDLGGQTSIMPYWRCYFPNTQAIIYVVDSSDTDRLVTAEEEFHVILDEDELKGAAVLVYANKHDLSGALDDAAITESLDLHEITSRLWGDFQNSCY

SEQ ID NO: 74279 - DNA, 806 bp, Zea mays
  misc_feature: Ceres CLONE 1558645
  misc_feature: Encodes the peptide sequence at SEQ ID NO. 74280
ctccccgcggtggcggccgctctagaactagtggatcccccgggctgcaggaattcgtctcacccctagaaaaatccacctccatcacccgcctccactcccccctcccaggtgctgcccaggtaagtcggcggcggcgatgacaacgcgcttcaagaagaaccgcaagaagcgcggccacgtgtccgccgggcacggccgcatcggcaagcacaggaagcacccgggaggtcgcggtaacgccggtggcatgcaccaccaccgtatcctcttcgacaagtaccatccgggctacttcggcaaggttggcatgcgttacttccataagctccgcaacaagttctactgccccgcggtcaacatcgagcgcctctggtcgatggtgcccaccgacaaggcggcggaggccggcggcgacaaggccccgcagatcgacgtcacgcagttcggctacttcaaggtgctcgggaagggggtgctgccgccaaagcccattgtcgtcaaggccaagctcatctccaaggtcgccgagaagaagatcaaggcagcaggcggcgccgtcgtgctcaccgcctaggtttcagtccttgttcgcctcctggttttgaaatctatatctgaactgatagtgctttcctgtctcggcaatttgtgttaagaaaacctgtagttttaaaatatgtggctcctgcctgtttggcagtgcttatgcgggtttttgatgcccagtcatatcaaatatttcacatcatttaaatctatcctcgctatcaacacaaagggggggctcgataccatccacgtcg

SEQ ID NO: 74280 - protein, 145 aa, Zea mays; identical to SEQ ID NO: 60091
  misc_feature: Ceres CLONE 1558645
  misc_feature (107)..(139): Pfam Name: L15 Pfam Description: Ribosomal protein L15

SEQ ID NO: 74281 - DNA, 838 bp, Zea mays
  misc_feature: Ceres CLONE 1558650
  misc_feature: Encodes the peptide sequence at SEQ ID NO. 74282
atagctggagctccccgcggtggcggccgctctagaactagtggatcccccgggctgcaggaattcgtctcacccctagaaaaaaacaagcactcagcgtctcatccggtccttcgaaagccctgataccttggtgatgcctacacgcagtttgacgcaattatccaagctcctcgtgctatcatctgtggggacctccgttcgtggtttctatagcaccccctgcacggatgtgcccggtagctacagccttccgctggtgggcaccgtcctcgaccgcctccacttctactacttctagggccaggacaagtacttcgactcccagcgtggagcgctacggctccaccgtggtgcgcatgtacgtccccacgggccccttcatggcgcgcatacccccgggtggtggcggtcctggacgccaagtagcttccccctcctcttcgacatggacaacgtggagatcaacgacctgttctcgggcacctacttggcctccacctccctgcagggcggccaccgcgtctgcgcctacctcgacccctccgagcccaccctcgccaaggtgatgcagctgatcgtctacctcatgctctcccgcaaggtagacgacatccccgatctccgctcctacttcgcctcggtgctcgccatcgccgactcggacctcgtcgcacgcggcagtgccgacatgaacaaggtcaccgacgtcacctccttcgagctcatcggcgattgcctacttgggagtgcgccccctcggcgacttacctcgggaagggcgggcacatcaaaagcgacctaccggcctcatgctgatgctccatccgctcctgcc

SEQ ID NO: 74282 - protein, 130 aa, Zea mays
  misc_feature: Ceres CLONE 1558650
  misc_feature: SWISSPROT Homolog: EC 4.2.1.92 Hydroperoxide dehydratase
MDNVEINDLFSGTYLASTSLQGGHRVCAYLDPSEPTLAKVMQLIVYLMLSRKVDDIPDLRSYFASVLAIADSDLVARGSADMNKVTDVTSFELIGDCLLGSAPPRRLTSGRAGTSKATYRPHADAPSAPA

SEQ ID NO: 74283 - DNA, 786 bp, Zea mays
  misc_feature: Ceres CLONE 1558653
  misc_feature: Encodes the peptide sequence at SEQ ID NO. 74284
  misc_feature (763)..(763): n is a, c, t, g, unknown, or other
ctccccgcggtggcggccgctctagaactagtggatcccccgggctgcaggaattcgtctcacccctagaaaaaatccggtcccaaaagtagaaaagggcaagcgacgagcacagcacagcacgccttccgttttgggaaggcgaggagaggggaaccccggggagagttgggggatcggcggcggaggagatggaggagcgggagaagctcgtgtgcctggccaagcttgccgagcaggcggagcggtacgacgatatggtggaattcatgaagaatcttgctaggatggacgtggatatgagtgctgaagaaaggcatttgttctcagttggtttcaagaacactattggagcaaagagagcatcatggagaatcatttgttcacatgagcaaaaggtcgcagctgatcgtcagactggtgtgatgatagatgcctataagaagaaagtagaagaggaactaaggaaggtttgcaatgaagtattgtcagtcattgctattcactgccttcccttggccagtacgggtgaaaatatcgtattcttttataagatgaaaggtgactactaccgttacttggctgaatttagcactggaactgaaaagaaagctgcctctgatcagtcacttatggcctatcagcatgccatggttgtcgcctccagtgagctctcacctgctcaccaaatccggcttggccttgccctcaatttgtcggtcttcttttatgagataatgaactctcatgagagagcttgccnagtggcaaaacaagcatttgatg

SEQ ID NO: 74284 - protein, 198 aa, Zea mays
  misc_feature: Ceres CLONE 1558653
  misc_feature (4)..(198): Pfam Name: 14-3-3 Pfam Description: 14-3-3 protein
  misc_feature (191)..(191): Xaa is any aa, unknown, or other
MEEREKLVCLAKLAEQAERYDDMVEFMKNLARMDVDMSAEERHLFSVGFKNTIGAKRASWRIICSHEQKVAADRQTGVMIDAYKKKVEEELRKVCNEVLSVIAIHCLPLASTGENIVFFYKMKGDYYRYLAEFSTGTEKKAASDQSLMAYQHAMVVASSELSPAHQIRLGLALNLSVFFYEIMNSHERACXVAKQAFD

SEQ ID NO: 74285 - DNA, 788 bp, Zea mays
  misc_feature: Ceres CLONE 1558654
  misc_feature: Encodes the peptide sequence at SEQ ID NO. 74286
ctggagctccccgcggtggcggccgctctagaactagtggatcccccgggctgcaggaattcgtctcacccctagaaaaaaaggaaactcactcccactttactcctatccactgcggcctggacgcgtgcgagaggcttgaccaagcagcagcagcagcagcagcgatggcgcctctgaagctgtacgggatgccgctgtcccccaacgtggtgcgcgtggccaccgtgctcaacgagaagggcctcgacttcgagatcgtccccgtcgacctcaccaccggcgcccacaagcagcccgacttcctcgccctcaaccctttcggccagatcccggctctcgtcgacggagacgaagtcctcttcgagtcccgcgcgatcaaccggtacatcggcagcaagtacgcgtcggagggcacggacctgctccccgcgacggcgtcggcggcgaagctggacgtgtggctggaggtggagtcgcaccacttctacccgaacgcatcgacgctggtgttccagctgctcgtgaggccgctcctgggcggcgcccccgacgcggcggtggtggagaagcacgcggagcagctcgacaaggtgctcgacgtgtacgagaggcacctggcccgcaacaagtacctcgccagggacgagttcacgctcgccgacgccaaccacgagtcctacctgctctacctgagcaagacccccaaggccgggctcgtcgacgcccggccccacgtcaatggcctgatgggaagacatcgccgtcccgacaccgcagtccagata

SEQ ID NO: 74286 - protein, 207 aa, Zea mays
  misc_feature: Ceres CLONE 1558654
  misc_feature (2)..(77): Pfam Name: GST_N Pfam Description: Glutathione S-transferase, N-terminal domain
  misc_feature (107)..(202): Pfam Name: GST_C Pfam Description: Glutathione S-transferase, C-terminal domain
  misc_feature: SWISSPROT Homolog: EC 2.5.1.18 Glutathione transferase
MAPLKLYGMPLSPNVVRVATVLNEKGLDFEIVPVDLTTGAHKQPDFLALNPFGQIPALVDGDEVLFESRAINRYIGSKYASEGTDLLPATASAAKLDVWLEVESHHFYPNASTLVFQLLVRPLLGGAPDAAVVEKHAEQLDKVLDVYERHLARNKYLARDEFTLADANHESYLLYLSKTPKAGLVDARPHVNGLMGRHRRPDTAVQI

SEQ ID NO: 74287 - DNA, 820 bp, Zea mays
  misc_feature: Ceres CLONE 1558655
  misc_feature: Encodes the peptide sequence at SEQ ID NO. 74288
  misc_feature (513)..(513): n is a, c, t, g, unknown, or other
  misc_feature (820)..(820): n is a, c, t, g, unknown, or other
tccccgcggtggcggccgctctagaactagtggatcccccgggctgcaggaattcgtctcacccctagaaaaactgttccgttctttttctttttccctgcggaattccccttcttccctagtgcctcgattcgatatttcgattggattggattaccaagggacagagggagggaatcccacacacacctctggccctcgcgaggccaagggaagggaagcactcagcacccagcagcagaaggaccgccgtaaatggcgctgccggtggcgaagctggggaccctggcgctgcggacgctgtccaagcccatcgccagccgcctcaagagccaggccgctgtccaccccaagttccgcaacttcatcatcgccatcgcccaggcaaaccaccagatcaccacaaagatacagaggcgcatttatgggcatgccacagatgtggcgatcaggcctttggatgagcagaaagctgttcaagctgctacagatctcatcggggaagcctttatnctctcggtcgctgttgctgctctaatttttgaaggtcagaagaacgcaacgtcccaaggctaggaaggaggaagctcgtagaaaggaacctgggggaattgaaacctaagggagaagagttttacctcaagaattgggaaaaaccctcaaattggaagctctaaggaaaaattgacccagcctgcctaaaagggccaaggccctaaacacgggaacctttgaaccttttgaaaacggggtccacgggggcacaacaaaggggtcggcgcaagaggaacccacccaaccctttggaggggggggaaan

SEQ ID NO: 74288 - protein, 106 aa, Zea mays
  misc_feature: Ceres CLONE 1558655
  misc_feature (4)..(105): Pfam Name: OPA3 Pfam Description: Optic atrophy 3 protein (OPA3)
  misc_feature (86)..(86): Xaa is any aa, unknown, or other
MALPVAKLGTLALRTLSKPIASRLKSQAAVHPKFRNFIIAIAQANHQITTKIQRRIYGHATDVAIRPLDEQKAVQAATDLIGEAFXLSVAVAALIFEGQKNATSQG

SEQ ID NO: 74289 - DNA, 744 bp, Zea mays
  misc_feature: Ceres CLONE 1558660
  misc_feature: Translation starting site: 181
  misc_feature: SWISSPROT Homolog: EC 2.6.1.1 Aspartate transaminase
  misc_feature (307)..(307): n is a, c, t, g, unknown, or other
ctccccgcggtggcggccgctctagaactagtggatcccccgggctgcaggaattcgtctcacccctagaaaaaatatcccatcctgatctctcctcccttcttcagtgcagcagcaggccagcagcacgccacccgccccactcctgcctccgatccgctgcttactcgccacccggagatggccaccgccgccgccttctccgtctcctcgccggcggcctccgccgtcgccgcgcgatccaaggtgtttggaggaggagttaaccaggcgagaactagaactgggctgccgcgtcggcatcacngcggtaagaaactttggcccgtgtcatgatggcccttgcagtggatgtttctcgttttgaaggagtgccaatggctcctccagaccccattctgggggttctgaaggcttttaagcagataaaacgagctgaaccccatctttggggttggggccataggaaaaaaaactggagcccttcgggcccaatgagccaaaaggtgaaatcctttgtggggaaaagggaaaaaaaaaaatccttccctttaaggtttaccccggtttaaaaaaaaaccaaaaaactttggctggggacgtgtaaaccccgggttttaaataaaaggagggggggggaaaacttaagtcccctccggggaagggggaaaaggggtttcgggggggaaattttttaccaaaaaactttcccccaaacacaaaagggcggattatttccccccc

SEQ ID NO: 74290 - DNA, 751 bp, Zea mays
  misc_feature: Ceres CLONE 1558661
  misc_feature: Encodes the peptide sequence at SEQ ID NO. 74291
  misc_feature (520)..(520): n is a, c, t, g, unknown, or other
ctcaccgcggtggcggccgctctagaactagtggatcccccgggctgcaggaattcgtctcacccctagaaaaaaaaaaaactcatcccatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtcccatcgtagtccccgcgagatgaccccggccccctaccttgacccggaaaattaataaccccccccccccaaaaaaccccccaaggggggagaaaaaaattggggggccgagggtcccccaccncgccgccccccttctcggggcccaaaaaaaaacattttcaacaaaaaaacccccctcctccgggggagggggggcgccccccccccctttgaaagaaaaaaaaaaaaatattttttgtttcccccccccccccggggggggggggggggccccccccccccatttcttttttttgtgggggggagacccacaaaagaatattttttttatttttttttcccccgcggggcg

SEQ ID NO: 74291 - protein, 85 aa, Zea mays
  misc_feature: Ceres CLONE 1558661
MATTAASSLLKSSFAGSRLPSATRTTTPSSVAVATPRAGGGPIRASISSSPTPPYDLTSFRFSPIKESHRSPREMTPAPYLDPEN

SEQ ID NO: 74292 - DNA, 715 bp, Zea mays
  misc_feature: Ceres CLONE 1558662
cccgcggtggcggccgctctagaactagtggatcccccgggctgcaggaattcgtctcacccctagaaaaaaccccgcccgactgtcgttatccagattccggtccctccaagtcccaactgttcacctcccgccgccccctagcgccgtcaaggcctccggaaccggtcgcaagcggcgtaggacccccgccgctacagagccctcgtccgtcgcacttcgccgccgcgccggagtcatccagctcgtcgacgcctggcggggagatccccagtgcgaggggaacctccacgacgcgagtacttctctacttcctatcacaaaaaaaaagatttgcaatctagcatatttatggaaagcctttgctccgggataaaaatttgctgggtccggggaagatccagcgggtcaccaccccatggaaagatttgatgggaagccccaaaggtaagaacttggcttttttcaaaaaggttgggggggaccctaacccattgggtattgggggaatcgccccaaaaatttaccccccaaaccaaaaaaaaaaacttgccccttggggtttgggcccttaaaaccctgggccattggccgaaaaatgggttctcccccctttccccctttttgcaaattttgggggggaaccctaaaaccccttttggggagcacccgggtttccgggggaaaaaaaaaacaccccctcaccttccttttt

SEQ ID NO: 74293 - DNA, 802 bp, Zea mays
  misc_feature: Ceres CLONE 1558667
  misc_feature: Encodes the peptide sequence at SEQ ID NO. 74294
ctcaccgcggtggcggccgctctagaactagtggatcccccgggctgcaggaattcgtctcacccctagaaaaaacgccacgctctccaacgccacagcttgcgcccgcaatggcactcgtctccgcctcctcgtcctccaccaccgccgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggcatcttcatcccggagttcctgaccaagatcggcgtcctcaacacgcccttctggtacaccgccggcgagcagcagtaactcaccgacaccaccaccctcttcatcatcgagctcatcctcatcggctggggccgaagggccgccgctggggctgacatcatcaagcccgggaagcgtcaacaccggaccccatccttccccaggcaacaaggctaaccggggacccgaacttcgggggtaaccctggggggccctcttgggtttggaaccccgcttcggcttggggggcacccggctttcccccggaaaaaaaataccagggggaacttggcgccccccccaggggaaaataccaaggaacc

SEQ ID NO: 74294 - protein, 135 aa, Zea mays
  misc_feature: Ceres CLONE 1558667
  misc_feature (63)..(136): Pfam Name: Chloroa_b-bind Pfam Description: Chlorophyll A-B binding protein
MALVSASSSSTTAVTALPRNGQRASSSFLGGKTLLRQAEAARPSFAVRAAADPNRPIWFPGSTPPPWLDGSLPGDFGFDPWGLGSDPESLRWNVQAELVHCRWAMLGAAGIFIPEFLTKIGVLNTPFWYTAGEQQ

SEQ ID NO: 74295 - DNA, 752 bp, Zea mays
  misc_feature: Ceres CLONE 1558668
  misc_feature: Encodes the peptide sequence at SEQ ID NO. 74296
tggagctccccgcggtggcggccgctctagaactagtggatcccccgggctgcaggaattcgtctcacccctagaaaaagtcagggcctctcgatcgctcatcagtcgccagaggagtagttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtgggagcacgagcatcagggacgaaggaggttacccggcgttcgcgctggtgaacaagcgaccgggggagccatcaagcactcgctgggggcagtccccacccggggccccttgtggcccctaacaacccgggaatttttttggaccaaatccggtggctttggggaacgaaaaaaccccccaaacttttgggaaaaggggttttcccgctttgggttccccccaagggggtaaaaaaaaaaattttttaccccctaaaaattttttaaaaagcccccccctcccacagggggggg

SEQ ID NO: 74296 - protein, 171 aa, Zea mays
  misc_feature: Ceres CLONE 1558668
MDGGYYGGRDQRYSGGYYGGGGIATPGYAPAVPYGMSQVNIEGNGCGRALPPQPTVKVYCRANPNYAMSVRDGKVVLAPANPKDEYQHWIKDMRWEHEHQGRRRLPGVRAGEQATGGAIKHSLGAVPTRGPLWPLTTREFFWTKSGGFGERKNPPNFWEKGFSRFGFPPRG

SEQ ID NO: 74297 - DNA, 811 bp, Zea mays
  misc_feature: Ceres CLONE 1558671
  misc_feature: Translation starting site: 135
  misc_feature: Pfam Name: SIS Pfam Description: SIS domain
  misc_feature (619)..(619): n is a, c, t, g, unknown, or other
  misc_feature (628)..(628): n is a, c, t, g, unknown, or other
  misc_feature (644)..(644): n is a, c, t, g, unknown, or other
  misc_feature (650)..(650): n is a, c, t, g, unknown, or other
ggagctccccgcggtggcggccgctctagaactagtggatcccccgggctgcaggaattcgtctcacccctagaaaaaacgaggattcggccattcggataaaccacagcccacaggccacaggcgcgacaacaatgaccggcagcgacaccgccgcggcctcggcgcagcaggcggacgcggccgctatatgcggtcagatcgcgtccgtcttctccgcgccctcgccgcgcccgcccgcgcgctccgtcctggtctcggagctggaggccgcggcctcgcggggcggccgcgtgttcgtgcacggcgtcgggcgggagggcctcatgatgcgcgcgctctgcatgcggctggcgcacctgggcctccccgcccactgcgtcggcgacgtcacggcgccgccagcgggcggcggggacctcctcgtggcctcggcggggcccggcgcgttctccaccgtcgacgccatctgcggcgtggcacgcggcgccggcgcgcgcgtcctgctgctcacggcgcgcctcgaagggggacttcccgcggcgtcaggccgacgtggtggcacacctccccgcgcagaccatggcggatgacgaggagggggccgggggagacgganacggacacngaaggcggaggggtcncccgcnccgggcgaagctgccgatgggcagcctgtacgaaggagctatgttcgtgctggtccagaatgtgggccctggagctcgcgcgcgtcctggggtcagaagcccggccaaaatgagggcccgcacaccaaatttcggaataggggttgagggcccctcgcccg

SEQ ID NO: 74298 - DNA, 801 bp, Zea mays
  misc_feature: Ceres CLONE 1558672
ctccccgcggtggcggccgctctagaactagtggatcccccgggctgcaggaattcgtctcacccctagaaaaaccctgcgcctgccctcccctcctgcagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgcctagctggcggtgaagagcaagaggggcggagcaagcccgtccaaggtgcaggcaaaggggagggcccggcaaggaaccccaaacaagccctaaaaagggcctccccacccggcttttctttcgggggtttccctgggggagggaaatttcccccaaggggggtccaaggggaaaaaaaaccccctaaaaaaaaaacctttttcccttgggggggggggaaaaccccccggggggaaaaggggggaaaaaacccctggggcggggagggggaaaaaagggggccccccttttgtggggcgccaggggggggaaaaaaaaaggtttttaggccccccaataaaaaaaaaaaaaaaaggggatgtttttggtgggtttttaaaaaaaaaggggggggggaaaccccccccccccccaaaaaaaaaaacccccccccccccccccgggggggggaaaaaaaggggggcaaaaaatgatataaagggggcggctcccccca

SEQ ID NO: 74299 - DNA, 614 bp, Zea mays
  misc_feature: Ceres CLONE 1558674
  misc_feature: Encodes the peptide sequence at SEQ ID NO. 74300
tggagctccccgcggtggcggccgctctagaactagtggatcccccgggctgcaggaattcgtctcacccctagaaaaattcagtttttcacacaacggcggcgatgtcgtcggcctcctcctccgccgccgccaacgccggtgaaggaagcgggggtgcggaggagggcgtggagatcacttacgtgagctatggcggggagcagcatctgccgctggtgatgtcgctggtggacgaggagctcagcgagccctattccatcttcacctaccgctacttcgtctacctctggccgcagctcaccttcctggcgttcgatgccagggatggcaagtgcgtggggacagtcgtgtgcaagatgggggagcataggggtgcattcaggggctacatcgccatgctcgtcgtcctcaagccctaccgagggaggggaatagcaactgagctagttactagatcaattcgggcaatgatgggaatctggcctgtgaaggagggtgacacttggaaggcagaaagttacctaataaaggggtggcccctttgcctcctcctatgggcccgccccttggggggtttttatccccgaaacccaaaaagaagaattggtttc

SEQ ID NO: 74300 - protein, 170 aa, Zea mays
  misc_feature: Ceres CLONE 1558674
  misc_feature (70)..(146): Pfam Name: Acetyltransf_1 Pfam Description: Acetyltransferase (GNAT) family
  misc_feature: SWISSPROT Homolog: EC 2.3.1.88 Peptide alpha-N-acetyltransferase
MSSASSSAAANAGEGSGGAEEGVEITYVSYGGEQHLPLVMSLVDEELSEPYSIFTYRYFVYLWPQLTFLAFDARDGKCVGTVVCKMGEHRGAFRGYIAMLVVLKPYRGRGIATELVTRSIRAMMGIWPVKEGDTWKAESYLIKGWPLCLLLWARPLGGFYPRNPKRRIGF

SEQ ID NO: 74301 - DNA, 765 bp, Zea mays
  misc_feature: Ceres CLONE 1558675
  misc_feature: Encodes the peptide sequence at SEQ ID NO. 74302
  misc_feature (681)..(681): n is a, c, t, g, unknown, or other
ctggagctccccgcggtggcggccgctctagaactagtggatcccccgggctgcaggaattcgtctcacccctagaaaaaagacgcaccccttcctcgtttggccgcctccgccgacaccgactgcctacctcagctgccgtcgccatgggcagaaggcctgctagatgctatcgccagatcaagaacaagccataccctaagtccaaggactgccgtggtgtccctgaccccaagatcaagatctacgatgttgggatgaagaggaagggtgttgatgagttcccctcttgtgcgcaccttgtctcttgggagaaggagaatgtctgcagtgaggcgcttgacgctgaccgcattgcctgcgacaagtacatgaccaagtctgcaggaaaggatgctttccacctcagggtccgggttcacccgttccatgtcgtccatatcaacaagatgctttcgtgtgctggggctgataggctcctgactggaatgaggggtgcctgtggcaagcctcatggcacctgtgctagggtggacattggtcatgccctcctttccgtgcgatgcaaggacaacaatgcgtgccatgccagctaagctatgcatcgcgctaagttcaagttccctggacgccagaagatcattgagagcagaaagtggagtctgaccaagctgcagtcgncgctgacaaccctgaaagtacatgagcgaggggcagcaatgcttccctgatggggggtcaaacgcaaagctggcatcggcaccc

SEQ ID NO: 74302 - protein, 149 aa, Zea mays
  misc_feature: Ceres CLONE 1558675
  misc_feature (5)..(149): Pfam Name: Ribosomal_L16 Pfam Description: Ribosomal protein L16
MGRRPARCYRQIKNKPYPKSKDCRGVPDPKIKIYDVGMKRKGVDEFPSCAHLVSWEKENVCSEALDADRIACDKYMTKSAGKDAFHLRVRVHPFHVVHINKMLSCAGADRLLTGMRGACGKPHGTCARVDIGHALLSVRCKDNNACHAS

SEQ ID NO: 74303 - DNA, 764 bp, Zea mays
  misc_feature: Ceres CLONE 1558676
  misc_feature: Translation starting site: 102
ggagctccccgcggtggcggccgctctagaactagtggatcccccgggctgcaggaattcgtctcacccctagaaaaagtccccgcctcattcgcgcgaccatggacacggacacgacgacgtccaccgcctcccgcctccatcccgcggccggacatgtacgctcattggccgcccggggcgccgagagcctcgtcacctgcgtcttcgcgacggtgggcacggtcctcggcgcgatcaccggtggcctcatcggcctggccacggagacgggcgtgctgcgcggcacgggtgtcggcggcatcacgggcgcgctggtgtccatggaggtcgtcgagtcgctgtggagctccgacgagccggctatctggagcgtcgtctacgtgctcgatgtcatctggagcttgctcaccggccgccttgtgcgcgagaaggtggaccccgccgtgctcagcgccgtcgagagccagatgagcgcagcggacacaccggccttgcatgcagaccacgccgacatcttcgacacgggcggcaccaacggcatgggcgagggtcgccatggacgcgctccccgtcgtcaggttcaccgagcgcagcaacgtcgacgccagcggcgagctcatgcgcctgttcggtttgcctacaggagttccaagccggcgacagcgcgagtatgctgccggtgtgcccgcacacgtttcacctgccgtgcatcgacggctggctgctccggcacgcctccctgcccctgttgccgcgcgctt

SEQ ID NO: 74304 - DNA, 764 bp, Zea mays
  misc_feature: Ceres CLONE 1558678
  misc_feature: Encodes the peptide sequence at SEQ ID NO. 74305
ctccccgcggtggcggccgctctagaactagtggatcccccgggctgcaggaattcgtctcacccctagaaaaaagcacaccggtccagtgcccagcctccgtgcctctccttcccttacctcgcctcgtctcctctccttgagatctccagggtacgagcgcattcgcgattttggccgcctccgccgccgtccgggaagatggcgggtctgggaaaggcgatgtacgcggtggggttctggatccgggagactggccaggccctcgaccgcctgggctgccgcctgcagggcaagtacttcttccacgagcagatttcaaggcatcgcaccatcatgaatatctttgacaaaacccctcatgtgcataaagacgcatttgttgctccaagtgcatcccttattggtgatgttcaagtcgggtcaggagcttccatttggtatgggtgcgtctgaagaggggatgcaaacatcatacatattggatctgggacctatatacgagacaattctcttatacatgtggctaaatctaatctaagggggaacggtctttccaacaaccagtgggaatcacgtcacagcaggtcattactgctgtgttacgacgatgcacgggttgaggatgaagccttttgttgggcattgggggcaaccctattagatgggggttcttggtagaaaagccacgaattgctgggctgcatggaagcccttcgtacaggagaaatactaggatcccttgttgtaaaaatttggggggt

SEQ ID NO: 74305 - protein, 84 aa, Zea mays
  misc_feature: Ceres CLONE 1558678
MAGLGKAMYAVGFWIRETGQALDRLGCRLQGKYFFHEQISRHRTIMNIFDKTPHVHKDAFVAPSASLIGDVQVGSGASIWYGCV

SEQ ID NO: 74306 - DNA, 792 bp, Zea mays
  misc_feature: Ceres CLONE 1558680
  misc_feature: Encodes the peptide sequence at SEQ ID NO. 74307
  misc_feature (548)..(548): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
ctccccgcggtggcggccgctctagaactagtggatcccccgggctgcaggaattcgtctcacccctagaaaaaaaaaagccgcaagcaccacagccggagaaatcctctcgtgtcgtctcttcagctatcagacggcaagacgatgctgccgctgaggtccgccgccgccgcgccgtgctcggttgcaggacttctgcttcaccgattctcatcctactcgtcctcttctgtctattctgtccgccaccacgcctcgtctgctctctcctcccagccctccacctgccccaccaccacctggtcctcttcccccaattccagcagccgcaggatcagggggtttgcggcctgggcttcggcgccggggccggcggggtctgcggattccctcgctacaaaggcgctagaggctaagatcaaggagcaactggaggcggacacagtcacggttgtggatacctctggagatggccgccatgtttgcatagacgtgatttccaaggcatttgagggaaaatctgctgtaacaggcagagaatggtctancaggctatatggggagaaactcagagcactgtgcatgctgtggaccagatgactaccaaaacgcctgatgaagctgctgccaacaagtaatcgatagatgcaaaatacctgtgaaagcacagattatctgtgcttcgaagatcaggtcatttgctccgacaaaaattttcctcctgggtgctaatactttgcctgtccactgatggataaggggnnnnnnnnnnnnnnnnnnnnnnnnnnnnnn

SEQ ID NO: 74307 - protein, 151 aa, Zea mays
  misc_feature: Ceres CLONE 1558680
  misc_feature (135)..(135): Xaa is any aa, unknown, or other
MLPLRSAAAAPCSVAGLLLHRFSSYSSSSVYSVRHHASSALSSQPSTCPTTTWSSSPNSSSRRIRGFAAWASAPGPAGSADSLATKALEAKIKEQLEADTVTVVDTSGDGRHVCIDVISKAFEGKSAVTGREWSXRLYGEKLRALCMLWTR

SEQ ID NO: 74308 - DNA, 755 bp, Zea mays
  misc_feature: Ceres CLONE 1558681
  misc_feature: Encodes the peptide sequence at SEQ ID NO. 74309
ctggagctccccgcggtggcggccgctctagactagtggatcccccgggctgcaggaattcgtctcacccctagaaaaaaaagcattgcgacggtcctcgaggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagctagccgcaccgcgctcacttccgcacccgtcttccctgccgcgccgccgccgccgccgcttcctccccgccgccgggcaagatgggtcgcgtgatccgcgcgcagcgtaagggtgcgggatccgtgttcaagtcccacacccaccaccgtcaggggcccggcccgggatccgctccctcgaccttcggcgagcggcaacgggtacctcaaggggccgtagtcaaccgaacgtggatccacgacccccggaaggcggccccccgctcggccaaggtaacctttccgccaccccctgcaggttacaagcaccaaaaagggacttcttccttccccccccaagggcatgttacaccgggccattttgttttaactggggggcaccggccccaggtttttcaattgggaaaagttcttggccgctcccgggggtaccccccaaaggggggccccctttctttgaaaaatttaaaaacacccccttttggggaaaaccccgg

SEQ ID NO: 74309 - protein, 138 aa, Zea mays
  misc_feature: Ceres CLONE 1558681
MGRVIRAQRKGAGSVFKSHTHHRQGPGPGSAPSTFGERQRVPQGAVVNRTWIHDPRKAAPRSAKVTFPPPPAGYKHQKGTSSFPPQGHVTPGHFVLTGGHRPQVFQLGKVLGRSRGYPPKGGPLSLKNLKTPPFGENP

SEQ ID NO: 74310 - DNA, 798 bp, Zea mays
  misc_feature: Ceres CLONE 1558683
  misc_feature: Encodes the peptide sequence at SEQ ID NO. 74311
  misc_feature (651)..(651): n is a, c, t, g, unknown, or other
  misc_feature (732)..(732): n is a, c, t, g, unknown, or other
aaagctggagctccccgcggtggcggccgctctagaactagtggatcccccgggctgcaggaattcgtctcacccctagaaaaaacggaccatagcccagaaaggaccaaggtggaagaaacaaaacgaaaggcggcgtcagctgctcctccacttcccgtgtttctaactccggtggctccaccactagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccagagaattgctataccaacaccagcataacaaaaggatgagctgccctgccatggcacagctcctctccaataccctgtactacaagcgcttcttcccatattacgccttcaatgtgctcggtgggcttgacagcgaggggataagggtgtgttttcacctatgatgcagtacgttcctatgagagaactggttatagtgctcangggaacgggatctacttttgattatgccagtcctggacaatcaactaaaatcaccaagtcctctattgctccctgccaggnatgctgtcacaccattgtcggagtcagaagccatcgatctaaattaaggatgtgtttgcatctgcc

SEQ ID NO: 74311 - protein, 128 aa, Zea mays
  misc_feature: Ceres CLONE 1558683
  misc_feature (10)..(128): Pfam Name: Proteasome Pfam Description: Proteasome A-type and B-type
  misc_feature: SWISSPROT Homolog: EC 3.4.25.1 Proteasome endopeptidase complex
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLDSEGIRVCFHL

SEQ ID NO: 74312 - DNA, 792 bp, Zea mays
  misc_feature: Ceres CLONE 1558684
  misc_feature: Encodes the peptide sequence at SEQ ID NO. 74313
  misc_feature (704)..(704): n is a, c, t, g, unknown, or other
ggagctcaccgcggtggcggccgctctagaactagtggatcccccgggctgcaggaattcgtctcacccctagaaaaaacgctcgcagcctcgcttagacagacacacacacacactcaacagcaacagctaagcctctcccaccagacagcaacatggctgaggaggaggccaagaaggtggaggtggaggtcaccaaggagcccgaggcggcacccgcggccgccgcggaggcggcggcgaaggaggacgtcgccgacgacaaggccgtcatccccgcgaccgacccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaagaaagtatccgctattctttcatgggaaaacacaaagaaagcaaacatagaagctgaactgaagaagattgaggaacaactggaaaagaagaaggctgaatatgcagagaagatgaagaacaaggttgcaatgatacacaaggaagccgaagagaagcgagcgatggtggaggcaaaacgcggtgaggaggtcctgaatgccgangagatggctgccaagtaccgggccaccggccacgctcctaagaagctcatcggttgcttcggagccctaagagcccttcaagtcagac

SEQ ID NO: 74313 - protein, 212 aa, Zea mays
  misc_feature: Ceres CLONE 1558684
  misc_feature (91)..(200): Pfam Name: Remorin_C Pfam Description: Remorin, C-terminal region
  misc_feature (31)..(89): Pfam Name: Remorin_N Pfam Description: Remorin, N-terminal region
  misc_feature (183)..(183): Xaa is any aa, unknown, or other
MAEEEAKKVEVEVTKEPEAAPAAAAEAAAKEDVADDKAVIPATDPPPPPADDSKALAIVEKVADEPAPEKPAPAKQGGSNDRDLALARVETEKRNSLIKAWEENEKTKAENKAAKKVSAILSWENTKKANIEAELKKIEEQLEKKKAEYAEKMKNKVAMIHKEAEEKRAMVEAKRGEEVLNAXEMAAKYRATGHAPKKLIGCFGALRALQVR

SEQ ID NO: 74314 - DNA, 720 bp, Zea mays
  misc_feature: Ceres CLONE 1558685
  misc_feature: Encodes the peptide sequence at SEQ ID NO. 74315
ctccccgcggtggcggccgctctagaactagtggatcccccgggctgcaggaattcgtctcacccctagaaaaagccgcctcctccccactgcctcgtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggccctaggtcgtgcgtatccagcggcagcgccgcatcctcaagcagcgcctcaatgtaccaccggagctcaaccagttcacccgcaccctcgactagtacctcgctacgaacctgtttaagatgcttctcaagtaccggcctgaagacaatgctgcctagaatgaagagcttctgaagagggcccaagctgagtatgaaggaaaaaactgtcgagtcaaagaaaaccatttgttgtggatgtatggccctaaaccttgtgacctacccccattgagcaggaacaaggccccagcctgtttggcctccctctcccaaatggggatccctatcggaactttgtttgggggggctttcccaacccctttgcaaggaaaaaatggaagggcccttttccggcccttggttaaaaggaaaaaggctccccc

SEQ ID NO: 74315 - protein, 51 aa, Zea mays
  misc_feature: Ceres CLONE 1558685
MAPKRGGRAPVPAKKKTDKVTNPLFEKRPKQFGIGGALPPKKDLHRFVKWP

SEQ ID NO: 74316 - DNA, 836 bp, Zea mays
  misc_feature: Ceres CLONE 1558689
  misc_feature: Encodes the peptide sequence at SEQ ID NO. 74317
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (773)..(773): n is a, c, t, g, unknown, or other
  misc_feature (784)..(784): n is a, c, t, g, unknown, or other
  misc_feature (796)..(796): n is a, c, t, g, unknown, or other
  misc_feature (810)..(810): n is a, c, t, g, unknown, or other
nnnnnnttttnnnnnnnnnnnnnnnnnnnnnnnnnnnnnnnnnnnnnnnnnnnnnnnnnnnnnnnnnnnnnnnnnttttaaatgctgggactcaccccggtggcggccgctctagaactagtggatcccccgggctgcaggattcgtctcacccctagaaaaagactagggagacagggggagggaacaagccgggcgcagtcacggcatcaaacacgagccgcggcatgggcaacagcctgcggtgctgcctggcgtgcgtgctgcccgtgcgcgcgctggacctggtgcggatcgtgcacctcagcggccgcgtcgacaagtacggccgcgccgtgtcggcccggggaaggtgctggcgggcccaccccaacaagttgctcaagaaagcccctgttctttccccccaaaggggggccttggcccaagaatcccccttttctgttccccccggaaaccccaagaacccctgaggcccggggggaaaaaaaataaaattttcccaaaatacccggggggcggggtttttctttggggccccccaaaacccccaaaaaaaaaaggggggggcgcgccccccccgggggtgttttttttttaaaacccccccgggggggggcgcccccaccccaggtgttggggccgcaaaaaaatttttccctccaaaaaaaagaaggggggggttttttttttttcttcccccccccccccccctttgttgtgtgttataaccaccacacacacccgnnntgttgaaggtggggggggtgggntttgctccccncccccgcccccnaaaataaatacttnccccccccagagaagaaaggaagggg

SEQ ID NO: 74317 - protein, 81 aa, Zea mays
  misc_feature: Ceres CLONE 1558689
MGNSLRCCLACVLPVRALDLVRIVHLSGRVDKYGRAVSARGRCWRAHPNKLLKKAPVLSPQRGALAQESPFSVPPGNPKNP

SEQ ID NO: 74318 - DNA, 789 bp, Zea mays
  misc_feature: Ceres CLONE 1558691
  misc_feature: Encodes the peptide sequence at SEQ ID NO. 74319
ctggagctcaccgcggtggcggccgctctagaactagtggatcccccgggctgcaggaattcgtctcacccctagaaaaaacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctatagctcctgcgtgagctagtagctagctagtgccatgcgtcgtctctgtcgttcggttttgcttcggggtcaccgtacccctttgcttgctaggtttcctcttt

SEQ ID NO: 74319 - protein, 170 aa, Zea mays; identical to SEQ ID NO: 73340
  misc_feature: Ceres CLONE 1558691
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase

SEQ ID NO: 74320 - DNA, 845 bp, Zea mays
  misc_feature: Ceres CLONE 1558696
  misc_feature: Encodes the peptide sequence at SEQ ID NO. 74321
  misc_feature (650)..(650): n is a, c, t, g, unknown, or other
  misc_feature (651)..(651): n is a, c, t, g, unknown, or other
tccccgcggtggcggccgctctagaactagtggatcccccgggctgcaggaattcgtctcacccctagaaaaagtgctatccccgcccattggtcaccagccaggtcccggaaccttatcacaaaatcataccgtcatggcgggcgcgctcttctccaactagatctcgcaccgcttcctcgacctatcctccccgaagccagccgcgcccgcgggctcggacttcctccccttcacgctgccgctgcgctctgtgtcggcaccggcgccagcgaggcgggtcttcgagcccgtatgaccgtcgcagtgtcctcggagtacgggaccgagggcgcggagcatcatgacggggagttctccgaggacctcaagctgtgcatcggtaacctggcgttcaacatccacagtgcgcagctggacaggctcttcgagcacgccggctccgtccagatggtcgaggttgtataccatagaatgactgggcggacccgtggatttggattcgggacaatgtctccagctgaataagcccgggctgctggccagcaactgaacggtgatacatttcaaggaagacctctgaaggtgaactgagggccaccgccacctagagacggatccgcaccaagagcaccagggggtgggggtannaaaagttggtgttccttaaaaaccataggaattctccgccaaagggtgtgcaatgttgatgcttggtacaccaagggtcgtgaagtttgacactgctgcaggagacgagtcccgtccggccctggatatcatccaggatgcctgattcttgacggatgctgatggaaatgcttttctcctgggtttcaagggat

SEQ ID NO: 74321 - protein, 77 aa, Zea mays
  misc_feature: Ceres CLONE 1558696
MTVAVSSEYGTEGAEHHDGEFSEDLKLCIGNLAFNIHSAQLDRLFEHAGSVQMVEVVYHRMTGRTRGFGFGTMSPAE

SEQ ID NO: 74322 - DNA, 791 bp, Zea mays
  misc_feature: Ceres CLONE 1558704
  misc_feature: Encodes the peptide sequence at SEQ ID NO. 74323
  misc_feature (626)..(626): n is a, c, t, g, unknown, or other
ctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaagtgggctccttcggcgagggccacatcaacatgcgcaagaccgtgggcaagcccaaggtggcggcgtccggcagcccctggtacggcccctaccgcgtcaagtacctcggccccttctccggcaagcccccgagctacctcaccggcgagttccccagcgactacggctgggacaccaccgggctgtccgccgaccccgagaccttcgccaagaaccgcgagctggaggtgatccactcccgctgggccatgctcggcgcactcggctgcgtcttcccctagctgctatcccgcaacggagtcaagttcagcgaggccgtctggttcaaggccggctcccagatcttcagcgaaggcgtgctagactacctcgggaacacggcctgatcacgcgcagagcatccgtcgcatctgagcctgccatgtcatgctcataggtgccngactaggctaccgcttgacgactggccgctcggcgatgtcgtcaacccgctgtaccctgagagctagttctaaccccccaggctggcaaagaccccaaagccttcgcctagctcaaggtgaagaagctcaacacgggcaccttcgcatgctttccttggtcgggt

SEQ ID NO: 74323 - protein, 112 aa, Zea mays
  misc_feature: Ceres CLONE 1558704
MAASTMAISSTAMAGTPIKVGSFGEGHINMRKTVGKPKVAASGSPWYGPYRVKYLGPFSGKPPSYLTGEFPSDYGWDTTGLSADPETFAKNRELEVIHSRWAMLGALGCVFP

SEQ ID NO: 74324 - DNA, 687 bp, Zea mays
  misc_feature: Ceres CLONE 1558707
  misc_feature: Encodes the peptide sequence at SEQ ID NO. 74325
  misc_feature (342)..(342): n is a, c, t, g, unknown, or other
  misc_feature (388)..(388): n is a, c, t, g, unknown, or other
  misc_feature (409)..(409): n is a, c, t, g, unknown, or other
  misc_feature (426)..(426): n is a, c, t, g, unknown, or other
  misc_feature (439)..(439): n is a, c, t, g, unknown, or other
ctccccgcggtggcggccgctctagaactagtggatcccccgggctgcaggaattcgtctcacccctagaaaaacccaacgcaggagcaacacagcgtcgccggcggcgatggatcccctctccgtgctccgcgactacgctggccgcaacgagctggacaagatcatcttctccggcgacgagatccacttcggctctgactacaccttcccggcttccacccccaccgccttcgcctccaagcagtcaggtcgcccctacccgctctccgctgccgtcttcctcgcgcagcaccacgacctcaagcacaccgacttcatccaggccgcgcgcctccgccngcatcccgcccgtatcgctccccgacccgcagaccttcctcgactnctccgcttcggcacaactccntcccctcgccgacccgntcctcccctccgnctttcaggcgcaagagccccacctccatccggcctgggcttcggcggaagacccgcagctaccgaaaaggcaccccgggaagcaatccggggcgttgaggggcccttaagggccggaacttaatcctcgaagcccggggggccgaaatttttttgccggtttttcatggccccccgggggccccccccggaaaaaaacaactttaaggggggggggggcaaaaaaaaagcgggggccccccccttttt

SEQ ID NO: 74325 - protein, 150 aa, Zea mays
  misc_feature: Ceres CLONE 1558707
  misc_feature (78)..(78): Xaa is any aa, unknown, or other
  misc_feature (106)..(106): Xaa is any aa, unknown, or other
MDPLSVLRDYAGRNELDKIIFSGDEIHFGSDYTFPASTPTAFASKQSGRPYPLSAAVFLAQHHDLKHTDFIQAARLRXHPARIAPRPADLPRLLRFGTTPSPRRPXPPLRLSGARAPPPSGLGFGGRPAATEKAPREAIRGVEGPLRAGT

SEQ ID NO: 74326 - DNA, 837 bp, Zea mays
  misc_feature: Ceres CLONE 1558709
  misc_feature: Encodes the peptide sequence at SEQ ID NO. 74327
  misc_feature (688)..(688): n is a, c, t, g, unknown, or other
  misc_feature (705)..(705): n is a, c, t, g, unknown, or other
  misc_feature (745)..(745): n is a, c, t, g, unknown, or other
ggagctccccgcggtggcggccgctctagaatagtggatcccccgggctgcaggaattcgtctcacccctagaaaaacccattatcacggcggcggtggcggagcggaaggcgaaggagtagcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaagttcaagctttgcaaggttaggtctgttcagtttgggcagaagggcatcccgtacctgaacacgtatgacggccgcaccatccgctaccctgacccgctcatcaaggccaacgacaccatgcaagatcgatctggagaccaacaaaattgtggacttncatcaagtttgatgttnggcaacgttgttcatggtgactggcggaaggaacactggncccgttgtgggtgttatcaagaacagggagaagcacaagggcagcttttgagacattcacgggggaggactcccctgggccaccagtttcgc

SEQ ID NO: 74327 - protein, 222 aa, Zea mays
  misc_feature: Ceres CLONE 1558709
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
  misc_feature (42)..(90): Pfam Name: S4 Pfam Description: S4 domain
  misc_feature (173)..(173): Xaa is any aa, unknown, or other
  misc_feature (178)..(178): Xaa is any aa, unknown, or other
  misc_feature (192)..(192): Xaa is any aa, unknown, or other
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTMQDRSGDQQNCGLXSSLMXGNVVHGDWRKEHWXRCGCYQEQGEAQGQLLRHSRGRTPLGHQFR

SEQ ID NO: 74328 - DNA, 737 bp, Zea mays
  misc_feature: Ceres CLONE 1558710
  misc_feature: Encodes the peptide sequence at SEQ ID NO. 74329
  misc_feature (476)..(476): n is a, c, t, g, unknown, or other
tccccgcggtggcggccgctctagaactagtggatcccccgggctgcaggaattcgtctcacccctagaaaaacctcagccgctgcgcggacctccgaatcccggcgccggtgcgcgcagggcaccgcagggcgcggcgcggccatggacatggacagcgtggagtgcctctccctcccggacgctgccatggacgtggacgacatcgaaggccgcccgcaccacggccatctcggcctcccgctccaccccgcccacctcccatcctcaggtgccggccgcgcgttccccaaggtgaatgccgggggcgccgtggcgggcccggcgggagcggcgggcacagcaggagcaggcgtggggccgccggcgaccagcgtgcacgagctgctcgagtgccccgtctgcaccaactccatgttcccgccaatccatcagtgtcaaaatggacatactttgtgttcgacatgcaaggccanggtgcacaacaggtgccctacatgcagacaagagcttggtgatatcaggtgcttagcattggaaaaagtagcagagtcacttgagcttccctgtaagtactgctctttagggtgcccagagatcttcccctactatagcaagataaagcacgaagcacagtgcagcctcaggccatatacctgcccctatgctggggtctgaaatgtgctgtgggctgggtgatattccaattccctggttgcacattttgaggggatggc

SEQ ID NO: 74329 - protein, 177 aa, Zea mays
  misc_feature: Ceres CLONE 1558710
  misc_feature (111)..(111): Xaa is any aa, unknown, or other
MDMDSVECLSLPDAAMDVDDIEGRPHHGHLGLPLHPAHLPSSGAGRAFPKVNAGGAVAGPAGAAGTAGAGVGPPATSVHELLECPVCTNSMFPPIHQCQNGHTLCSTCKAXVHNRCPTCRQELGDIRCLALEKVAESLELPCKYCSLGCPEIFPYYSKIKHEAQCSLRPYTCPYAGV

SEQ ID NO: 74330 - DNA, 757 bp, Zea mays
  misc_feature: Ceres CLONE 1558712
  misc_feature: Encodes the peptide sequence at SEQ ID NO. 74331
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (479)..(479): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (525)..(525): n is a, c, t, g, unknown, or other
  misc_feature (556)..(556): n is a, c, t, g, unknown, or other
  misc_feature (557)..(557): n is a, c, t, g, unknown, or other
  misc_feature (560)..(560): n is a, c, t, g, unknown, or other
  misc_feature (561)..(561): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (633)..(633): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (675)..(675): n is a, c, t, g, unknown, or other
  misc_feature (679)..(679): n is a, c, t, g, unknown, or other
  misc_feature (681)..(681): n is a, c, t, g, unknown, or other
  misc_feature (682)..(682): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (721)..(721): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (732)..(732): n is a, c, t, g, unknown, or other
  misc_feature (734)..(734): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (753)..(753): n is a, c, t, g, unknown, or other
ctcaccgcggtggcggccgctctagaactagtggatcccccgggctgcaggaattcgtctcacccctagaaaaagtcttttgtcagttggacaatccgcagctcctccatctcattcttccccccatcccatccccaaggttgaccggcgaaatcagcagtccgagaaccgcgagcttctgcctgatccagcctcatcccgccatggacgaatctgaggagcacagcaacggcggcgggcacccccacccgcaccacgggtacgagtggaagttcccggcggcgctgagcgcgaacacgacgagcgtgcacgtcgacggcgctggacgggcgtggtgaaacgtgaaaactcgcctgttcaacggttggccctgtttcgtgggggtttgtccctgggggaacccccgggggaaccctgggggaaaccccggggggggggggagaacccccccccnnnnnnggcgggtggtggaaaaaacncccggggggggcccggggnnnaggggannnnnnagggggggaaggnaccggggggatctcctctctccttttggccnnccnnagggggagtggtgggggaannnnnnnnnnnnnnnttttnnnncctcccccactataaaaagaagagggaggnggnnnnnnnnnnnnnnnnnnnnnnnnnnnnnnncgggggggncggngnngnnnnnnnnnnnnnnnnnncgggggggnnnnncgggggnggnnnntgggngngggtggggggnnnntgggncggg

SEQ ID NO: 74331 - protein, 44 aa, Zea mays
  misc_feature: Ceres CLONE 1558712
MDESEEHSNGGGHPHPHHGYEWKFPAALSANTTSVHVDGAGRAW

SEQ ID NO: 74332 - DNA, 835 bp, Zea mays
  misc_feature: Ceres CLONE 1558713
  misc_feature: Translation starting site: 200
  misc_feature: Pfam Name: CytB6-F_Fe-S Pfam Description: Cytochrome B6-F complex Fe-S subunit
  misc_feature: SWISSPROT Homolog: EC 1.10.99.1 Plastoquinol--plastocyanin reductase
agctccccgcggtggcggccgctctagaactagtggatcccccgggctgcaggaattcgtctcacccctagaaaaaattctatcaaaaaagaggcttgaaggagatatataaaacaagattgaggcaagcctgtggacacgagtgagtgaacaccagccgtattgtcccgaccccgaccgatcctcgcctgctgcagccatggcgacctccgcggcgctctctaccgccgccaatcccacccagctctgccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcatccctgccggctccgggaacgccggcggcgggacctacgcaaaggacaagctgggcaacgacatcacggctggaggcgtggctcaacacgcacggtcccaacgaccgcacgctcgcgcaggggctcaagggtgaccccacgtacctggtggtggagcaggacaagacgctggccacctacgggatcaacgccgtgtgcactcacctcaggctgcgatcgtgccatgagaacggcgccgaaaaacaatgttcatctgcccatgacaacgtgatccccagtaaacaacccaaggggcaaggtgggtccgtggaaccgggcagcctctgggtccctaggcccctgttttcaccccaaacgtcgaacgaggggga

SEQ ID NO: 74333 - DNA, 771 bp, Zea mays
  misc_feature: Ceres CLONE 1558714
  misc_feature: Translation starting site: 179
  misc_feature: SWISSPROT Homolog: EC 1.3.3.9 Secologanin synthase
  misc_feature (389)..(389): n is a, c, t, g, unknown, or other
  misc_feature (688)..(688): n is a, c, t, g, unknown, or other
ctccccgcggtggcggccgctctagaactagtggatcccccgggctgcaggaattcgtctcacccctagaaaaaaaaagcgcacacacacacaagacacaacaacgctgtgggcttgtacgtggctgtcgatcgcagcacacgtacgtaaactcgaaagcagctaggccggaagcaaaatggacgacgacgtcgtcgtagcagctgcagctgcagctgcagccgcggcggcttcgtcttcgccatcgccgccgtggagcctgctccaggggctccttgcgctgctcgtcgcgtggggggcctaccgggcggcgcagacgttctggctgcggccgcggcggctcggccgggcgctccgcgcgcaggggctcaccggcacggcgtaccgcnttcccggcgggcgacctcaaggagaacgcccgcctcaacgacgaggcgcggtccaggcccatgcagccgccgtgtagccatgacgtcgttccccgcgtcatgccgcatctcttcaacaccgtcaaggaccacggcaacatctgtattacctggttcggaccgattcccaggggtggtgatcacggaggcagagttagtcagagacatcctatcgaacaagtttggccacttcgagaagtcacgaacaagagtctcggggaagatgatcgcccctcgggggtggcggagctacgacggcngagaaatgggccataacacaggagggatcctgggaacccccgcgttcccatctcgagaagctcaagcgcattgcagccggggg

SEQ ID NO: 74334 - DNA, 716 bp, Zea mays
  misc_feature: Ceres CLONE 1558715
  misc_feature: Encodes the peptide sequence at SEQ ID NO. 74335
tggagctcccgcggtggcggccgctctagaatagtggatcccccgggctgcaggaattcgtctcacccctagaaaaaacgcccgtttctctctcgtcgcgcaacatcagagcacaagcgaggaacccagtccagtcccgggaatggagtgcgtattgggcgtggttggccgcgacttcgcgctggtggcggccgacacctccgccgtgcagagtattctcgtccacaagaccgacgaggacaaggtgatggtgctcgactcgcagaagctgatgggcgcttcacgggagcctggtgatcgggtgcaatttacggagttcatacagaagaacctccacctgtaccagttccggaacaccatcccgctctgaaccgccgccgccgccaacttcactcgcggcgaactcgccacagcccttcgcaagaatccatatatggtcaatattattcttggtggttatgataagggatgcttgatgcttcccctctactacatcgactacattgctacccttgcacaaaagtgacaaaagtgcttgttgggtacggatccatacatctgtttcgtcgctgatggacaagtttgaccaacccggacatgaactgttcgaggaagccattatatcttggttgacaaagtgcttcagggacattccgcctgcgaaatggttttccccccccccggaactttgttttccaggattgggttgaaagggg

SEQ ID NO: 74335 - protein, 75 aa, Zea mays
  misc_feature: Ceres CLONE 1558715
  misc_feature: SWISSPROT Homolog: EC 3.4.25.1 Proteasome endopeptidase complex
MECVLGVVGRDFALVAADTSAVQSILVHKTDEDKVMVLDSQKLMGASREPGDRVQFTEFIQKNLHLYQFRNTIPL

SEQ ID NO: 74336 - DNA, 772 bp, Zea mays
  misc_feature: Ceres CLONE 1558720
  misc_feature: Encodes the peptide sequence at SEQ ID NO. 74337
ggagctccccgcggtggcggccgctctagaactagtggatcccccgggctgcaggaattcgtctcacccctagaaaaagccctcttccgttccgtctcattctcatccccgacccccgcaccgcagcgtataccctagtccccggcggcgaccttgcggcctccgctgcgctctgactggtgcgcgtttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcagcgcattgatgagaggttatctgcccttggcaattgcatagcctgcaatgaccatgttgcacttacgcaccctgaccttgacaaggagactgaggagttcattgcagatgtgcttgggcgtcgtagtgtttaggcagactattgctggaaatatccgttgctggggagttactgcgcactctctaaacaggggtgggttttggttcatgccccatacatcccgttggaagatcttagacgagctctgcacggctcactccaaat

SEQ ID NO: 74337 - protein, 138 aa, Zea mays
  misc_feature: Ceres CLONE 1558720
  misc_feature (3)..(138): Pfam Name: eIF-6 Pfam Description: eIF-6 family
MATRIQFENNCEIGVFSKLTNAYCLVAIGGSENFYSAFEAELADAIPVVKTSIGGTRIIGRLCVGNKNGLLLPHTTTDQELQHLRNCLPDQVVVQRIDERLSALGNCIACNDHVALTHPDLDKETEEFIADVLGRRSV

SEQ ID NO: 74338 - DNA, 820 bp, Zea mays
  misc_feature: Ceres CLONE 1558721
  misc_feature: Encodes the peptide sequence at SEQ ID NO. 74339
ggagctccccgcggtggcggccgctctagaactagtggatcccccgggctgcaggaattcgtctcacccctagaaaaagccggtcgtccaccatggccacccaatatgtgcggctctccctgccgtgccgcctgccctcgccgcttcctccgccggtgccgacgacgccctgtcggctgccgcgcgccgccgcggcggctgcagcggcgtccacctcccctcggtgccgcgcgcacgtcgcgtcggctgccaatcgcgcccgaggcccctgcccgcctcaccctcccgtggcaggcgggcagcagcatgcccgccaaccgcatcccctacatgaagaagccgaggctgatgaacctcctcctcctgggcgccatatcaactgcccaccgtcagatgtgagtcggcccctaccgcgccttcttcggccccgcccgctccgggaacggcgagcgcgggacctacgcctaggacaagctgggcgacgacctcacgggggaagagtggatcaacacgcacggtcccaacgaccgaacgctcgcgcaggggctcaagggtgaccccgcctacctggtggtggacctggacaatactctggccacctaccggatcatcaccgtgtgcacacacctcagctgcttcgtgccgtggatcggcgacgagaactagctgatctgcccgtgcactgtgatccgactcacgaccactgcaagggggtgctctgaccggcgcctctgtcgctggctctggttcacgcctactcctactacaggattgtcctcttcgtcccatggatggagtactacttctgcgacagctttta

SEQ ID NO: 74339 - protein, 97 aa, Zea mays
  misc_feature: Ceres CLONE 1558721
  misc_feature: SWISSPROT Homolog: EC 1.10.99.1 Plastoquinol--plastocyanin reductase
MCGSPCRAACPRRFLRRCRRRPVGCRAPPRRLQRRPPPLGAARTSRRLPIAPEAPARLTLPWQAGSSMPANRIPYMKKPRLMNLLLLGAISTAHRQM

SEQ ID NO: 74340 - DNA, 743 bp, Zea mays
  misc_feature: Ceres CLONE 1558722
  misc_feature: Encodes the peptide sequence at SEQ ID NO. 74341
  misc_feature (558)..(558): n is a, c, t, g, unknown, or other
ctcaccgcggtggcggccgctctagaactagtggatcccccgggctgcaggaattcgtctcacccctagaaaaaagtcgccgtcagcccaatacccaccatccccaccaacggccggccgccgcggcggagcggagcagagagcaaccatggcgtcgaagcagatggaggagatccagcggaagctatccctgctggagtacccgcgggcgaacgcccccgcgcaatccctcctcttcgccggcgtcgagcgctaccgcctcctcgagtggctcttcttccggctcctaggcgacagatcgcccttcacgcagcagaactggcaaggggatagcctggaccgcgacgaggagaacaacaggatccaacacctggcggagatagccaacttcttgggcatcacaccttcggcggacaccgaggcgattcagggtcgaggtagctatgaggagcgggtggaactgctccatcttattgttgacctagtggaagctagttgctacgctgacaatccagaatggagtgttgataagcaattgggagaaggatgtgcaactangtagattcaattgctgagaaacaagcccaaatttttttcagaggagtgcaaagcttttcccctgcgggatgttcaaatacaatcaattttaccccttggcctgatattggcctgaactaggagttaaagcctcttcggagtatacccaaaaaaagatgtctaaatctggcagcaaatggggttca

SEQ ID NO: 74341 - protein, 136 aa, Zea mays
  misc_feature: Ceres CLONE 1558722
  misc_feature (1)..(138): Pfam Name: Plant_NMP1 Pfam Description: Plant nuclear matrix protein 1 (NMP1)
MASKQMEEIQRKLSLLEYPRANAPAQSLLFAGVERYRLLEWLFFRLLGDRSPFTQQNWQGDSLDRDEENNRIQHLAEIANFLGITPSADTEAIQGRGSYEERVELLHLIVDLVEASCYADNPEWSVDKQLGEGCAT

SEQ ID NO: 74342 - DNA, 794 bp, Zea mays
  misc_feature: Ceres CLONE 1558723
  misc_feature: Translation starting site: 171
ctggagctcaccgcggtggcggccgctctagaactagtggatcccccgggctgcaggaattcgtctcacccctagaaaaaacaatacttgttgttcccgccgctagccaagcattgtcgtccgccccaccgcatctccagattagaggccgcctccgcgaccaatactcgatggatccgaagatgacagacgtgacccagatgttcgcccgcttcaaggcggtctacacccgcaacgacctcgacgcctgcgtcaccctcctctcacagctcaaggtccatctcaccaaattccccatgcttccgccctcatttgagcagactcctaacgccgtccaggagctcacacttgcaagggacatttatgagcatgctgttgttctgagtgtgaaacttgaggaccaacatgcatttgaacgtcgatttctgccaactcaaaacttattacatgtatacatgtggcataattcccccctcaccagaggagtacccaattttgggactctatcttctgacgctgttggttcaaaatagaactgctgatttccatactgagctggagcttttacctgtctaggcacttgatcctccttgcatcaagcatgctgtagagcttgagcaatcctgtctggagggtgcgtacaaccgagtgttaagcgctccgcaggctgtgacacatgagaccgatgtttacttcatggaccttctctccgagaccttcatagatgagatcgctgggctgcgcgtaaatagggtatgaatcccctatctgtcagtgatgcagaagcaatactt

SEQ ID NO: 74343 - DNA, 777 bp, Zea mays
  misc_feature: Ceres CLONE 1558724
  misc_feature: Encodes the peptide sequence at SEQ ID NO. 74344
ctggagctcaccgcggtggcggccgctctagaactagtggatcccccgggctgcaggaattcgtctcacccctagaaaaaatcgccaccagtggccgcgtcctcttcatttccgccatccgtatcgtctccctagagtttagcacattggccgccgccatggcaatcagattcacgagatctcctccactctattgctctccaagtaggcgcgtctcaacgcgtccccgccctcctgcgtccggtcgctgctgcagcgagactcctcccaccagtggctgggcctgcaggtgccaccctacagactagggtgcggtgcttcgaaatgcaaacgggatagtcctcactgcgagaatcataaccaaactataccaatcctgcgccagatgagacaattctcgtcgatggctgctacttcgaacactgactcgacatcaggtagacgccgccttgagaagcctgcgaaactgattcatcttactagagatctatcgatagctatatcaagactctcaccatactcaatggagagtgaataagaaactgggacaaagatgtgctactggatcgactcatcgttacataaacattcgcagactcttgtatcatgaagaactgtctttaccccggagatgtactcactaagtccatctagcttcttgcctgatacttgctgaacatgacttaaacctggactatggatgcgaacccatgtctaatgctgcagctagtggcttatgatcctacatctcagtgaagattggatgacaaacgatgc

SEQ ID NO: 74344 - protein, 44 aa, Zea mays
  misc_feature: Ceres CLONE 1558724
MAATSNTDSTSGRRRLEKPAKLIHLTRDLSIAISRLSPYSMESE

SEQ ID NO: 74345 - DNA, 747 bp, Zea mays
  misc_feature: Ceres CLONE 1558725
  misc_feature: Translation starting site: 168
ctccccgcggtggcggccgctctagaactagtggatcccccgggctgcaggaattcgtctcacccctagaaaaaaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggcccatggtggtgcgcaagccggcgcacctgttcctggacgagctggggcgtggcgtacgacgaggccgaggactacgtggtcatcaagcacgccgcgctcttcacgtccacggtcatgagcctgctcctggcgcgccccaacgtcaagctggttcacgccgtggccgg

SEQ ID NO: 74346 - DNA, 777 bp, Zea mays
  misc_feature: Ceres CLONE 1558727
  misc_feature: Encodes the peptide sequence at SEQ ID NO. 74347
ctggagctccccgcggtggcggccgctctagaactagtggatcccccgggctgcaggaattcgtctcacccctagaaaaatagaaaaacccgtctggccacccatccgatcccacccggcagcggcgctgcgcaatggccacccacgcagctctcgccgcctcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgcagaggcgaagctgaaggtggcgatcaacggcttcggccgcatcggccggaacttcctccggtgctggcacggccgcgaggactcgccgatcgacgtcgtcgtcgtgaacgacagcggaggcgtcaggaacgcgtcccacctcctcaagtacgactcgatgctcggcaccttcaaggccgacgtcaagatcgtggacgacactaccatcagcgtcgacggctagcccatcacagtcgtctccagcagggacccgctcaagctccccatggggtgagctcggcattgacatcgtcatcgaggggcaccggagtcttcgtcgaccggccccggcgccgggcaagcacatccaggccgggcgccaaagaaaggtgatcatcaacggctcccgccaaaggggcgccgaactc

SEQ ID NO: 74347 - protein, 152 aa, Zea mays
  misc_feature: Ceres CLONE 1558727
  misc_feature (83)..(153): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MATHAALAASRIPAGARLHSRAPASSRHGVQRLDFADFSGLRPGSCSVSAAAREASFSDVLGAQLVAKATGENAVRAPAEAKLKVAINGFGRIGRNFLRCWHGREDSPIDVVVVNDSGGVRNASHLLKYDSMLGTFKADVKIVDDTTISVDG

SEQ ID NO: 74348 - DNA, 810 bp, Zea mays
  misc_feature: Ceres CLONE 1558730
  misc_feature: Encodes the peptide sequence at SEQ ID NO. 74349
ctccccgcggtggcggccgctctagaactagtggatcccccgggctgcaggaattcgtctcacccctaaaaaaaaaggcacgcatactcttctcccccccagtccggaccccggaggagccaagccatggcgtccacctcctgctgcctcctccaccactcaaccgaccgcctcggcgcgtcgccgcgcctggatcgccggcccgccgcgcagcgccgagtctgctcgtctgcaaggcccggaagcaggaagccgccgcggaccatagcgacgtctcgcgccacgacgcgctcgcgctcctcgccggcgtcactgccgccgccggcgccaaggtgggtcccgccgccgcggcatacggagaagcagccaacgtgttcggcaagcccaaagggagcacggagtacatcgcgtacagcggcgacggcttcaagctgctgatcccgtccaagtggaaccccagcaaggagcgggagttccccgggcaggtgctacgctacgaggacaacttcgacggcaacagcaacgtgtccgtcatcatccagcccacgtccaagaagaccatcgccgactacagctctaccgaggagttcctctcccaggtcgactacctgctcggcaggaaggcctacggaggcaagaccgactccgagggcgagttcgagaccggcaccgtgaccaccgccaacgtcctggagagctccacccccgtgatctacggcaagcagtactacgccgtgtccgtgctcaccaggacggcggacagcgacgagggcggcaagcacgagctcatcgcggccaccgtcgtcaacg

SEQ ID NO: 74349 - protein, 269 aa, Zea mays
  misc_feature: Ceres CLONE 1558730
  misc_feature (99)..(269): Pfam Name: PsbP Pfam Description: PsbP
PRGGGRSRTSGSPGLQEFVSPLKKKARILFSPPVRTPEEPSHGVHLLLPPPPLNRPPRRVAAPGSPARRAAPSLLVCKARKQEAAADHSDVSRHDALALLAGVTAAAGAKVGPAAAAYGEAANVFGKPKGSTEYIAYSGDGFKLLIPSKWNPSKEREFPGQVLRYEDNFDGNSNVSVIIQPTSKKTIADYSSTEEFLSQVDYLLGRKAYGGKTDSEGEFETGTVTTANVLESSTPVIYGKQYYAVSVLTRTADSDEGGKHELIAATVVN

SEQ ID NO: 74350 - DNA, 839 bp, Zea mays
  misc_feature: Ceres CLONE 1558733
  misc_feature: Encodes the peptide sequence at SEQ ID NO. 74351
  misc_feature (488)..(488): n is a, c, t, g, unknown, or other
  misc_feature (510)..(510): n is a, c, t, g, unknown, or other
  misc_feature (601)..(601): n is a, c, t, g, unknown, or other
aagctggagctcaccgcggtggcggccgctctagaactagtggatcccccgggctgcaggaattcgtctcacccctagaaaaagtgccattgagatgtcatagaacctgccgagccggtcgcaggcgcgaggagaatggggacggaggccgacgccgcagccgtggattcgcttcggtcgcagatcccgttccagaccgacggggagctcatcctcccgccgcgcgatgtggggctcgtcctcgtcgacctctgcaacggcttctgcaccgtcggcgccgggaacctcgctcctgttgcgccaaataagcagataagtaaaatggtggaagaggccgctaggctctctaagctgttctgtgatagaaacctgccgatctttgcattcctggatacccattatccagataagccggagccaccgtatcctcctcactgtatcattggtactggggaggagaactttcgtccagacctggagtggttggnaaaaggagccaaatgtgactantaagaggaaaagttgtattgacggttacatcagctgcataaaagaaggaagggtcctagtgtttttgttgaccggggtgggaaaaatttcnaaatcaaaactgccttgggtcctccgggatattgcccgggacacctgggtttttggaattttggaaaggccaaacttggggtgggcccaaaattttgacccagagggcctccctttaaaaaaatttgggggggttttttttccaggggggggggggccaacaataaaaacccctcccgggtgggaaaacccccctgaaaaatcctaagggggggtctttggcccccacccccagaggg

SEQ ID NO: 74351 - protein, 124 aa, Zea mays
  misc_feature: Ceres CLONE 1558733
  misc_feature (118)..(118): Xaa is any aa, unknown, or other
MGTEADAAAVDSLRSQIPFQTDGELILPPRDVGLVLVDLCNGFCTVGAGNLAPVAPNKQISKMVEEAARLSKLFCDRNLPIFAFLDTHYPDKPEPPYPPHCIIGTGEENFRPDLEWLXKGAKCD

SEQ ID NO: 74352 - DNA, 858 bp, Zea mays
  misc_feature: Ceres CLONE 1558734
  misc_feature: Encodes the peptide sequence at SEQ ID NO. 74353
  misc_feature (689)..(689): n is a, c, t, g, unknown, or other
  misc_feature (801)..(801): n is a, c, t, g, unknown, or other
  misc_feature (802)..(802): n is a, c, t, g, unknown, or other
  misc_feature (825)..(825): n is a, c, t, g, unknown, or other
ctggagctccccgcggtggcggccgctctagaactagtggatcccccgggctgcaggaattcgtctcacccctagaaaaagtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacagtttggaggatctacgaattccccctgcttattcaaaaactttccaaggtccgcctcacggtatccaagttgaaagggataagttgaacaagtacggtcgtcctcttattgggatgtactattaaaccaaaattgggattatccgcaaaaaattacggtagagcgtggttatgagtgtctaccgcggtggacttgattttaccaaagatgatgaaaacgtaaactcacaaccatttatgcgctgggagagaccngtttttgtcttttgtgccgaagcaatttataaagcacaaggccgaaactggtgaaatcaaaggtgcattactttgaatgcgacctgcaggtacatgcgaaagaatgatttannagagctgtatttgcaaggggaantaagggggttccctattggtaatgcatgactac

SEQ ID NO: 74353 - protein, 42 aa, Zea mays
  misc_feature: Ceres CLONE 1558734
  misc_feature: SWISSPROT Homolog: EC 4.1.1.39 Ribulose-bisphosphate carboxylase
MFTSIVGNVFGFKALRALQFGGSTNSPCLFKNFPRSASRYPS

SEQ ID NO: 74354 - DNA, 831 bp, Zea mays
  misc_feature: Ceres CLONE 1558737
  misc_feature: Encodes the peptide sequence at SEQ ID NO. 74355
  misc_feature (687)..(687): n is a, c, t, g, unknown, or other
aagctggagctccccgcggtggcggccgctctagaactagtggatcccccgggctgcaggaattcgtctcacccctagaaaaaaacgccccaacacgacacgagcactacaacatttattgccttcaagagcttcgcggcgcgaacgtcgaggagcttccggggggagtagcagggcaggggaggcggattctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttncgcaatgtgggcaagactatcgggtacaaaagtggaacaatgattgagatccccagggcagctctggtggctgatgagatagcggaacaggctgaattcttctccttcggaacgaacgacctgacgcagatgacctttgggtat

SEQ ID NO: 74355 - protein, 201 aa, Zea mays
  misc_feature: Ceres CLONE 1558737
  misc_feature (1)..(201): Pfam Name: PEP-utilizers_C Pfam Description: PEP-utilising enzyme, TIM barrel domain
  misc_feature: SWISSPROT Homolog: EC 2.7.9.1 Pyruvate, phosphate dikinase
  misc_feature (153)..(153): Xaa is any aa, unknown, or other
MIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVXRNVGKTIGYKSGTMIEIPRAALVADEIAEQAEFFSFGTNDLTQMTFGY

SEQ ID NO: 74356 - DNA, 791 bp, Zea mays
  misc_feature: Ceres CLONE 1558740
  misc_feature: Encodes the peptide sequence at SEQ ID NO. 74357
ctccccgcggtggcggccgctctagaactagtggatcccccgggctgcaggaattcgtctcacccctagaaaaaaaaaactagaaaaagtaagtaacgcctttctccaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggaggtgctggagaagtgggtgcgcgtggacttcaaggagcccgtgtggttcaaggccggcgcgcagatcttctcggagggcgggctggactacctgggcaaccccaacctggtgcacgcgcagagcatcctggccgtgctcggcttccaggtcatcctcatggggcctcgtcgaggggctccgcatcaacggcctcgacgggcgtcggggagggcaaacaacctctaccccgggcggccagtat

SEQ ID NO: 74357 - protein, 201 aa, Zea mays
  misc_feature: Ceres CLONE 1558740
  misc_feature (69)..(201): Pfam Name: Chloroa_b-bind Pfam Description: Chlorophyll A-B binding protein
MASTIMAATSRIVAAKTPFLGQGRAAAAAANASPLRDVAAAAAGGRITMGNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVILMGPRRGAPHQRPRRASGRANNLYPGRPV

SEQ ID NO: 74358 - DNA, 815 bp, Zea mays
  misc_feature: Ceres CLONE 1558741
  misc_feature: Encodes the peptide sequence at SEQ ID NO. 74359
  misc_feature (775)..(775): n is a, c, t, g, unknown, or other
ctggagctccccgcggtggcggccgctctagaactagtggatcccccgggctgcaggaattcgtctcacccctagaaaaagcacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatgttcgaagacgaatgcatttgggtggacgagcaggacaatgttggtggccatgagtcaaagtacaactgccatttgatggaaaagattgattctgagaatctgctacatagggcattcagtgtgttccttttcaactcaaaatatgagctgctacttcagcaaaggtccgcgacaaaggttacctttcctttagtttggaccaatacctgctgcagccaccctctgtaccgtgagtctgagcttatccaggagaactaccttggtgtgagaaatgcagcacagaggaagctactggatgagctgggcatccctgcagaagatgccccagttgaccaattcacccctctgggccgaatgctttacaaggcaccatctgacgggaaatggggggagcatgagcttgactacctgctgttcatcgtccgggacgtgaaggtgctgccaaacccagatgaggtcgctgacgtgaagtacgtgaaccgcgacgagctcaaagagctcatcccgaaagctgacactggccaggacagggntgaagatctcccccgggttcaggctagtagtagactactt

SEQ ID NO: 74359 - protein, 210 aa, Zea mays
  misc_feature: Ceres CLONE 1558741
  misc_feature (54)..(202): Pfam Name: NUDIX Pfam Description: NUDIX domain
  misc_feature: SWISSPROT Homolog: EC 5.3.3.2 Isopentenyl-diphosphate Delta-isomerase
  misc_feature (197)..(197): Xaa is any aa, unknown, or other
MAAAVVDDAGMDAVQKRLMFEDECIWVDEQDNVGGHESKYNCHLMEKIDSENLLHRAFSVFLFNSKYELLLQQRSATKVTFPLVWTNTCCSHPLYRESELIQENYLGVRNAAQRKLLDELGIPAEDAPVDQFTPLGRMLYKAPSDGKWGEHELDYLLFIVRDVKVLPNPDEVADVKYVNRDELKELIPKADTGQDRXEDLPRVQASSRLL

SEQ ID NO: 74360 - DNA, 818 bp, Zea mays
  misc_feature: Ceres CLONE 1558742
  misc_feature: Pfam Name: ELM2 Pfam Description: ELM2 domain
ctccccgcggtggcggccgctctagaactagtggatcccccgggctgcaggaattcgtctcacacagcttagaaacctcctcccccatagaatcaaattgccacattgtaaaaactcgaccaagttcagagcgtagctgatctcttgcttcatttgtgtggagctgtctgcagaggaaggatcctgggtaggggcaattacatgatccaggccttccctgcccaacagctacaatgtcagttttataaacttcaccctcaggaggccacattctagtccctaacatctttgatgtctctgggtcattcctgtaacatgaaagctctttccctgaaggttgcccagtccaaccaggtacctctgcctgaaagtgctcacctactccaatctttttccgttgcgtgaggagcaatgatgccatgagtttcattctcttagcaagcctctcagatttccttgttggcatgttcaagcagcctttcttttttttctagggggggaagaggtttctaagctgtggagtcgtgatgagcaactaaagttcgacgcacttgagcaattggttcccgttatggatcaaaagacatattggggctgttgtgtcgaaaaattttgcttcaaagcccaggatagatttgataaagctactatctgaatgtgtttcctgatgagaagagtgttgtaccagtgcagaactcggtcttctggaaattgatagtgacgaaaaaatgacgtgggaggaagaaagaggaccgagatcaaccttgaagggatccagctctccttcagaaggaactcaggatgccccagactttgaa

SEQ ID NO: 74361 - DNA, 772 bp, Zea mays
  misc_feature: Ceres CLONE 1558743
  misc_feature: Translation starting site: 183
  misc_feature: SWISSPROT Homolog: EC 2.5.1.18 Glutathione transferase
ctggagctccccgcggtggcggccgctctagaactagtggatcccccgggctgcaggaattcgtctcacccctagaaaaaaacttgcgtagagagttgggcgcagagaatccccaagctaacaacagggtagagggagaggagaggagaggacacgacacgtgtggttgggtctgggacaccatggttcctatgaatctgttcggggcggcgatgtcgtgcaacgtgacgaagtgcgctacgtcgctagacgaagctggctccgactacgagatcgtgcccgtctgcttcgccaccgccgagcacaactgccccttgcacctcgtcatcgacccggttgatcagcttcctgctctgctcgatgtgttcctgtacatcttcaaatcacaaccgctctgtcagcacactgctcgcacaaacgtgccagtgctgttgattgaaagaaacctctactacgcacccctgctggatgtttagctcgagcttgtggctaaccactacactgctgcactgaatgccatcctcttccagctcctggtcaatccgatgctcgctgcttcctccgcaccagatgttctagtctgacatccttgccaactgatttacgtgctacatgtgtcgaggcatgcctgagcattgcctttaccttgtggtgtacttcctcaggctcgccgaggtgaagcctgtgcctgtcgctctctccgtgtttgcgtcgccctacccatatgtgctctgagcactcacgcatatggatgcctcgtgggtatgactgt

SEQ ID NO: 74362 - DNA, 715 bp, Zea mays
  misc_feature: Ceres CLONE 1558744
  misc_feature: Encodes the peptide sequence at SEQ ID NO. 74363
  misc_feature (180)..(180): n is a, c, t, g, unknown, or other
  misc_feature (182)..(182): n is a, c, t, g, unknown, or other
  misc_feature (183)..(183): n is a, c, t, g, unknown, or other
  misc_feature (185)..(185): n is a, c, t, g, unknown, or other
  misc_feature (188)..(188): n is a, c, t, g, unknown, or other
  misc_feature (191)..(191): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (649)..(649): n is a, c, t, g, unknown, or other
  misc_feature (679)..(679): n is a, c, t, g, unknown, or other
  misc_feature (681)..(681): n is a, c, t, g, unknown, or other
ctggagctcaccgcggtggcggccgctctagaactagtggatcccccgggctgcaggaattcgtctcacccctagaaaactcgcctcaaaatccagctgccacgccgagcccaagctcccaatcgccatgaagccggcggcgcggcggccgctgctgctggggcgcttggcggcggcgcncnnanctnaanacagcgggggcggaggtgattcccggcggcgtgcgagtgaaggggtgggtcatccagtcccacaaaggccctatcctcaacgccgcctctctgcaacgctttgaagatgaacttcaaacaacacatttacctgagatggtttttggagagagtttcttgtcacttcaacatacacaaactggcatcaaatttcattttaatgcgcttgatgcactcaaggcatggaagaaagaggcactgccacctgttgaagtttcctgctgcagcaaaatggaaagttcagaaataagccttctaaccaaggtaaacttgaataccaactttacttttacaaaaaccaatttgttgggaaaaaaacccctggggttttaaaaacctctgggaaccccccccaaaaaaaaagtttaaaaaggggagagccgcgcccaactttttttttnnnnttggggggggagggnccctaaaaaaaaaaccccgaaaaaaaaaantnttttgccccccccccctccccaaaaaaaaaaaaa

SEQ ID NO: 74363 - protein, 78 aa, Zea mays
  misc_feature: Ceres CLONE 1558744
MVFGESFLSLQHTQTGIKFHFNALDALKAWKKEALPPVEVSCCSKMESSEISLLTKVNLNTNFTFTKTNLLGKKPLGF

SEQ ID NO: 74364 - DNA, 835 bp, Zea mays
  misc_feature: Ceres CLONE 1558745
  misc_feature: Encodes the peptide sequence at SEQ ID NO. 74365
  misc_feature (729)..(729): n is a, c, t, g, unknown, or other
  misc_feature (753)..(753): n is a, c, t, g, unknown, or other
  misc_feature (760)..(760): n is a, c, t, g, unknown, or other
ctcaccgcggtggcggccgctctagaactagtggatcccccgggctgcaggaattcgtctcacccctagaaaaaatcctactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggctagcggcgagaagaagcaccaccacctcttcggctgaccgtagtaccggccggcgcgcgaccgagagctagctagctccggcgcacacaaccacacacctgtttaattctgacttgcaatggcgtgtgtaaatttgatggttcacaataatgaagtccctctccgggaccttggtagctgcttgctttgtgntgaagtgaaaagtgtgagactganggagaanaagttgggtgtttggggccccttggggcctaacctccaaaaaagaggcgtggttccctgaaacccccccttccgt

SEQ ID NO: 74365 - protein, 131 aa, Zea mays; identical to SEQ ID NO: 73894
  misc_feature: Ceres CLONE 1558745
  misc_feature (41)..(120): Pfam Name: ABA_WDS Pfam Description: ABA/WDS induced protein

SEQ ID NO: 74366 - DNA, 825 bp, Zea mays
  misc_feature: Ceres CLONE 1558746
  misc_feature: Encodes the peptide sequence at SEQ ID NO. 74367
  misc_feature (734)..(734): n is a, c, t, g, unknown, or other
  misc_feature (735)..(735): n is a, c, t, g, unknown, or other
  misc_feature (737)..(737): n is a, c, t, g, unknown, or other
ctccccgcggtggcggccgctctagaactagtggatcccccgggctgcaggaattcgtctcacccctagaaaaagccttcttctcaccagcccctctcgcctcacgaaaaggcgcaggccaaggccaaggccaagccgccccctccctcctctcgtctccactctctctctctctctggcagccaaaggcgaggccgagatccggcgcgcggaggatgccttccaggtccatgagccggctgtccgtcgagtccgcctcgggcagcgggggcggctgccgggaggccgagccggtgctctgcgcgcctcggccgcgcagggcccagcagcagctggtccacgtccacccccgcggcgccgacctcatcctcggcccgccgcccttcctgctcaacgagagcggcgaggagggtcggtgcagctggcggacttcatgcgcggcgggtcgccgccggcgcgcgcgggcaacccgctggtgcacgaccccagcttcctgctgagccagcgccaccccgacgacggacccgccgctggagctcggcttcttcgaccacctgatccgcaccagcagctacgtgcgccggccgacgccgacgacgtcgtataccatctccagcaccagcagcagcggcggcagtagcagcaagagcagttttggcccgtcgtcgttcgcgccagccgtgaggatccaggggttcgacgtcgccgcgtgccggatctccaagcggagctgnngnaccggggccgcccaattggctgtcggccgtccgcgcatgatcagagaagtcatgctgttgttaaagggggtaattattccaagaaggg

SEQ ID NO: 74367 - protein, 94 aa, Zea mays
  misc_feature: Ceres CLONE 1558746
MPSRSMSRLSVESASGSGGGCREAEPVLCAPRPRRAQQQLVHVHPRGADLILGPPPFLLNESGEEGRCSWRTSCAAGRRRRARATRWCTTPASC

SEQ ID NO: 74368 - DNA, 839 bp, Zea mays
  misc_feature: Ceres CLONE 1558748
  misc_feature: Encodes the peptide sequence at SEQ ID NO. 74369
  misc_feature (807)..(807): n is a, c, t, g, unknown, or other
  misc_feature (814)..(814): n is a, c, t, g, unknown, or other
aaagctggagctccccgcggtggcggccgctctagaactagtggatcccccgggctgcaggaattcgtctcacccctagaaaaaaccttccctgcctcacaaacaacgccatcagggtcttcaaccagggcaggttctcttctttcattcagctatgggcaacctgtgctgctgtgttcaagttgaccagtcgactgtggccatcagggagcagtttggcaagtttgacagcgtgcttgagccaggatgccactgcatgccttggttcgccggcaagcgtgtagctgggcatctcacactcaggctgcagcaactggatgtgcgctgtgagacaaaaacaaaggacaatgtttttgtgaatgtggtggcatctattcagtaccgcgctctggctgacaaagcaagtgacgctttctacaaactgagcaacacaaggtcccagatccaagcctacgtctttgacgtgatcagagcaagcgttcccaagctccatttggacgatgctttcgagcagaaggacgagatcgcaagggcggtggaggaagagcttgagaaggccatgtcggcttataggctttgagatcgtgcagactctcatcgtggacatcgagccagacgagcatgtgaagcgcgcaatgaacgagatcaacgcagctgcgaggctcagggcggctgcaaacgagaaggcggaaggcggagaagatcgtgcagattcaagcgcgccggaagggggaagcagaaagccaagtacctgtcccggagctgggcattgcgcgccagcgggcaggccatcgtggacgggctcanggacaancgtgcttggggttctcccgtcaacc

SEQ ID NO: 74369 - protein, 141 aa, Zea mays
  misc_feature: Ceres CLONE 1558748
  misc_feature (8)..(140): Pfam Name: Band_7 Pfam Description: SPFH domain / Band 7 family
MGNLCCCVQVDQSTVAIREQFGKFDSVLEPGCHCMPWFAGKRVAGHLTLRLQQLDVRCETKTKDNVFVNVVASIQYRALADKASDAFYKLSNTRSQIQAYVFDVIRASVPKLHLDDAFEQKDEIARAVEEELEKAMSAYRL

SEQ ID NO: 74370 - DNA, 799 bp, Zea mays
  misc_feature: Ceres CLONE 1558750
  misc_feature: Translation starting site: 264
  misc_feature (711)..(711): n is a, c, t, g, unknown, or other
ctggagctccccgcggtggcggccgctctagaactagtggatcccccgggctgcaggaattcgtctcacccctagaaaaaatccgtccaatcaaccgggctgctctgctgcctctccggcgccattgacgagcaagagagtgctccgacacctggtccgtcgcgtgccgtgcccacccgctaaggccagggcgccccgactcgagctcaccgcgtcgaactcgaaccgctgctgttcctcggcagggggcagggtcgtcgaggatgccggagcactcagagaacgcggcggcggacctgatgggcaacatcatggagaccatcgcggagaacctcccgaggcagaagtccgtgcggttcgacgacggcgacggctcctccatctccgagcaggccaagaagctgttcagcggcggcgagagcaggaagaagtcggtccaccacgtgctgggcggcggcaaatccgccgacgtgctgctgtggcggaacaagaagatctcgtccagcgtgctgggcgtggcgacctggggtgtgggtgttcttcgagtggctggactaccacttcctcaccatcctctgcttcgtgctcgcgctcggcatggccgtccagttcgcctggtccatcttctcgtccagcgtgcctcgcgtgcagctgccggtagagctgttcgcgagcgccagcgcggcccgccggcgccctagtgtacagggncgctgggcttccctccaggacgtggcctgcggtacgcgacctccagcggctgggtcatcgtggattcgccgggttcttcaactgcggc

SEQ ID NO: 74371 - DNA, 807 bp, Zea mays
  misc_feature: Ceres CLONE 1558752
  misc_feature: Encodes the peptide sequence at SEQ ID NO. 74372
  misc_feature (608)..(608): n is a, c, t, g, unknown, or other
ctggagctccccgcggtggcggccgctctagaactagtggatcccccgggctgcaggaattcgtctcacccctagaaaaaatccgtcgtattgtcccgaccccaaccgatcgtcgcctgctgcatccatagagacctccgcggcgctctctactaccgccaatcccacccagctgtgcccgtcccgcgcttcactggccaacccggcaaagggactaggactgagcatgggcctggaccgcgcccaccacaacatcgtgtgcctcgcggcgaactccatctgagacgatgacgtccccgacatggatcaacaggaatctgataaaactgctcggcctcggcgccatctgcgttaccgaacgttcgaatagaagctcccccacgtgccacttcttcatcgatgacgggtcccggatcgacgacggcgggacctacgaggtcgacaacctcggcatcgacatcaaggcggacgcgtagctcaagcacgacgagttcaacgaccgcaccctgggcctcgggctcaagagtaacaccgacggcctggtgaggtagcacgacaagaccctcggcagctacgagatcaacgccgtgtgcacatctgcctcgacnagcgtcgccccgtggaacgtcaacaaacacgagttctgctgcacctgctgaggcatcctctacaacagccacgtcaaagagatccatgaaatggtgactgggtacctgaccctgtgtccgacctactctagacgactaggcatcctcggtcactaagtggaaacggactcatgacgacaaagcaccctggtgaaagcac

SEQ ID NO: 74372 - protein, 62 aa, Zea mays
  misc_feature: Ceres CLONE 1558752
MTSPTWINRNLIKLLGLGAICVTERSNRSSPTCHFFIDDGSRIDDGGTYEVDNLGIDIKADA

SEQ ID NO: 74373 - DNA, 627 bp, Zea mays
  misc_feature: Ceres CLONE 1558753
  misc_feature: Encodes the peptide sequence at SEQ ID NO. 74374
  misc_feature (492)..(492): n is a, c, t, g, unknown, or other
  misc_feature (513)..(513): n is a, c, t, g, unknown, or other
  misc_feature (514)..(514): n is a, c, t, g, unknown, or other
  misc_feature (604)..(604): n is a, c, t, g, unknown, or other
agctccccgcggtggcggccgctctagaactagtggatcccccgggctgcaggaattcgtctcacccctagaaaaaagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgttgggcaagcccaaggtggcggcgtcccggcagcccccctggtacggcccccacgcgtcaagttactcgccccctcctccggcaacccccaaggcttactaccgggcgatttccccgggaaataaggggggggaaacccgccggggggttggccccccccaaaaaaaacccccaaaaaaaccctttccccccaaaaaaaacccccgaagcgggggaggggaatcccccccccccccccgggggggaaaaattctttggggggccccntttggggggggggggggaggnnttttttttttcccccccaaagagtggtttttcccccccccaaaaagagggggttaaaatttttttcgcgggagaaaaagacccccccccntttttttagaaaaaaaaagaaaa

SEQ ID NO: 74374 - protein, 74 aa, Zea mays
  misc_feature: Ceres CLONE 1558753
MAASTMAISSTAMAGTPIKVGSFGEGRITMRKTVGQAQGGGVPAAPLVRPPRVKLLAPSSGNPQGLLPGDFPGK

SEQ ID NO: 74375 - DNA, 803 bp, Zea mays
  misc_feature: Ceres CLONE 1558755
  misc_feature: Translation starting site: 316
  misc_feature: SWISSPROT Homolog: EC 3.2.1.23 Beta-galactosidase
ggagctccccgcggtggcggccgctctagaactagtggatcccccgggctgcaggaattcgtctcacccctgagacccatgtaatgatttgggggcactcgcgcgcgccccgcacaggaggccaagttctgggcggacaagaagaagtttgggacagaggccatctacggatccgccttgaacatccgcaaggatctcgatgcccaaatcctctcaaggttccaaaggccccctggtgctttgccatcatctctgcttggatatgaggcactgacaggttccctagatgattttggttttgaagattatcttaacatgcctcaagattctgaaggtttccgtcaacctgacatgcaccacggaatggaggttcgccttggtttgtccaagggacctatctgccctagcttcagttgaggcagtgaatgtagttctgcggttctgccgcacgttgatgcaccttagtccagtacactcgggtcaataaaagaccacattaggatggtgaaacggtgaaaactgatggcttgcatatgttcagagtgttatgttgtaatgaacagtgttatgttgtaatgaacgcatatatcgcatgattgatagctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcggcttgcagcacatccccctttcggccgctggcgtaatagcgaagaggcccgcacccgatcgccccta

SEQ ID NO: 74376 - DNA, 784 bp, Zea mays
  misc_feature: Ceres CLONE 1558756
  misc_feature: Encodes the peptide sequence at SEQ ID NO. 74377
  misc_feature (654)..(654): n is a, c, t, g, unknown, or other
ctccccgcggtggcggccgctctagaactagtggatcccccgggctgcaggaattcgtctcacccctagaaaaagcggcaagaattttccggcccgaaaccgaaagcacccgcaccaatctctgcgtctcttcgtcttcggctgcgcggcggcggcagcagcggaggaggttgaggagatgctgtccggcgacatccccccgagccagaccatctacctcaacaacctcaacgagaaggtcaagaaagaagaattgaagagatcgctttatgccttgtgctcacagtatggaaggatactggatgtggtggccctgaaaacacaaaaactgagagggcaagcatgggtggcgtttagcgaaattacagctgctaccaatgctttccgtggattgcaagattttgatttctacggcaaagaaatgcgagtacaatatgcaaaaacaaaatcagactgtattgcataagaagatggtacttatgcacctaaggagaacaggaagaagcaagaggagaaagctgctgagaaaaaacgacgaacagaagtaggcacacaagctgggcctcatgctgctgctgcccaaagcaatggaactggctatcaagcgtctcgtctgggcaaggcttcacaggaagccacctggcgcctcggaancacatcctcttcatccagaatctgcccgaccagacccacgagcatgatggctcccgatcctggttcccagcagtacccttgctttcccggaaaagtccggatgatccgaaacctaacccagggcatcgct

SEQ ID NO: 74377 - protein, 95 aa, Zea mays
  misc_feature: Ceres CLONE 1558756
  misc_feature (12)..(84): Pfam Name: RRM_1 Pfam Description: RNA recognition motif. (a.k.a. RRM, RBD, or RNP domain)
MLSGDIPPSQTIYLNNLNEKVKKEELKRSLYALCSQYGRILDVVALKTQKLRGQAWVAFSEITAATNAFRGLQDFDFYGKEMRVQYAKTKSDCIA

SEQ ID NO: 74378 - DNA, 800 bp, Zea mays
  misc_feature: Ceres CLONE 1558757
  misc_feature: Encodes the peptide sequence at SEQ ID NO. 74379
  misc_feature (692)..(692): n is a, c, t, g, unknown, or other
ggagctcaccgcggtggcggccgctctagaactagtggatcccccgggctgcaggaattcgtctcacccccctagaaaaaagcttgcttgctctctaacacgcacagacacagtcacacagcgttgcgcgagagagcttattgcaaattactctgtggaccgaaccggtcggtcggaagtcggaacaataagcagcagatagagagagagagagagagagatggggaagctgacgctggggcaccgcggcgaggcgtcagagccggacttcttcaggggcgtcctcggcgagctcgtcctcaccttcctcttcgtcttcatcggcgtcggagccgccatgaccgacggagcgacgacgaagggtagcaccgctggaggcgacctgacggcggtggcgttggggcaggcgctggtggtggcggtgatcgcgacggcggggttccacatctccggcggccacgtcaacccggccgtgacgctgtcgctggccgtcggcgggcacgtcacgctgttccgctcctccctgtacatcgccgcccagatgctcgcctcctccgcggcctgcttcctgctcaggtggctcacgggcgggctggccacgccggtgcacgcgctggcggagggcgtgggcccgctgcaaggcgtggtggcggaagcccttcttcaccttcagcctgctcttcgtcatctancgcaccattctggacccgcggaagctgctcccgggcgacgggcccctgctcaccgggcctcctcgtcgggccaaaatccgtcgcccgggggccgccctgtcccggggc

SEQ ID NO: 74379 - protein, 193 aa, Zea mays
  misc_feature: Ceres CLONE 1558757
  misc_feature (11)..(193): Pfam Name: MIP Pfam Description: Major intrinsic protein
  misc_feature (158)..(158): Xaa is any aa, unknown, or other
MGKLTLGHRGEASEPDFFRGVLGELVLTFLFVFIGVGAAMTDGATTKGSTAGGDLTAVALGQALVVAVIATAGFHISGGHVNPAVTLSLAVGGHVTLFRSSLYIAAQMLASSAACFLLRWLTGGLATPVHALAEGVGPLQGVVAEALLHLQPALRHLXHHSGPAEAAPGRRAPAHRASSSGQNPSPGGRPVPG

SEQ ID NO: 74380 - DNA, 747 bp, Zea mays
  misc_feature: Ceres CLONE 1558760
  misc_feature: Encodes the peptide sequence at SEQ ID NO. 74381
ctggagctccccgcggtggcggccgctctagaactagtggatcccccgggctgcaggaattcgtctcacccctagaaaaaaccacagcatccgcagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcagtgtttcttccattgaacaaaaggaggagtcccgtaagaacgaagagcatgtgaaccttatcaaggaatatcgtggcaagatcgaggctgaactgagcaatatctgtgatggaatcttgatgctgcttgactcccacctagtgccttcttctactgctgctgaataaaggtcttctacctcaagatgacgggtgactatcacaggtatcttgcggaatctaagactggtgctgagacgaaggaatctgctgagagcaccatggtgggcctataaagctgctcaggacattgctctggctgagctggcacctacccatcccgataggggctgggacttgctctttaggttttcaggcggggcaatttttggaaaatcctggaactcccccaga

SEQ ID NO: 74381 - protein, 117 aa, Zea mays
  misc_feature: Ceres CLONE 1558760
  misc_feature (3)..(118): Pfam Name: 14-3-3 Pfam Description: 14-3-3 protein
MSREENVYMAKLAEQAERYEEMVEYMEKVAKTVDVEELTVEERNLLSVAYKNVIGARRASWRSVSSIEQKEESRKNEEHVNLIKEYRGKIEAELSNICDGILMLLDSHLVPSSTAAE

SEQ ID NO: 74382 - DNA, 781 bp, Zea mays
  misc_feature: Ceres CLONE 1558762
  misc_feature: Encodes the peptide sequence at SEQ ID NO. 74383
  misc_feature (633)..(633): n is a, c, t, g, unknown, or other
ctggagctccccgcggtggcggccgctctagaactagtggatcccccgggctgcaggaattcgtctcacccctagaaaaaagtcggccgccgcagaccgggagtagccgacgcgccgtcactgaatcctcagatcacggctagccgtaatcacgacactctgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaggccgagcgtgagagaggtatcacaattgatattgctctgtggaagttcgagaccaccaagtactactgcactgtcattgatgcccctggacaccgtgacttcatcaagaatatgattactggcacttcccaagctgactgcgctgttcttatcattgactccacccactggtggtttttgaggctggtatctccaagggatggacagaccccgtgagcatggctctcctggcttccacgcntgggaggtgaagcacgatggattttgctgtttgcaaccaagaatgggatggccccccccaccccaaagttcctccaaagggcccctttttgaaaaaaaatttggggaaaaggaaaatcctccctcccctacccccgaaaagaaaaggg

SEQ ID NO: 74383 - protein, 135 aa, Zea mays
  misc_feature: Ceres CLONE 1558762
  misc_feature (5)..(136): Pfam Name: GTP_EFTU Pfam Description: Elongation factor Tu GTP binding domain
  misc_feature: SWISSPROT Homolog: EC 2.7.7.4 Sulfate adenylyltransferase
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTHWWFLRLVSPRDGQTP

SEQ ID NO: 74384 - DNA, 792 bp, Zea mays
  misc_feature: Ceres CLONE 1558763
  misc_feature: Encodes the peptide sequence at SEQ ID NO. 74385
ctggagctccccgcggtggcggccgctctagaactagtggatcccccgggctgcaggaattcgtctcacccctagaaaaaactcgtatagaaaactaagccgggcacgttacgctcaccaccatagcgtcccacgcgggctccccaaataaccctatcccccggccaccgggaactggaaccgatggaccgcctcatcgtcttctcccgccgccgccgccggtggatactcctccctgcggcaggtgcggcggcggccgtcgaacgcgtagaacatctaccaccaccctgccgtcgcagaacgtcgccgccgactcggtgcgcataaccgctcccgtcgcggcctttgctgatgccaacgcatcatccgccggacaccgtggccctggtgacatccgatctacaccacttggtcctttccgacgcagacgacgtccccctcagcgtctagcagctgggactgctcgccgcctcccgtgaggtagccgccaccgtctgcaccctagccgatgcatcaacctccaggatccttcgcgggtctggatcctctaaatccgggcccgaatgcagctgtaccgaggcactctccgatcggctcgtagacagggtcttcactgactgatgccagcgccttgcagtagcagatgcctggtgcttcactcgacatctcgtcctatgctgctacgccgatccttaacagaaaggggatgtgtcatctccctcgacatgtggggccaacgtggttgcttacggaacaaggcctgatggcataagcaaaggtgttgaggtcctc

SEQ ID NO: 74385 - protein, 47 aa, Zea mays
  misc_feature: Ceres CLONE 1558763
MDRLIVFSRRRRRWILLPAAGAAAAVERVEHLPPPCRRRTSPPTRCA

SEQ ID NO: 74386 - DNA, 805 bp, Zea mays
  misc_feature: Ceres CLONE 1558764
  misc_feature: Translation starting site: 168
  misc_feature (727)..(727): n is a, c, t, g, unknown, or other
ctccccgcggtggcggccgctctagaactagtggatcccccgggctgcaggaattcgtctcacccctagaaaaaacaagaggtggccgccgaagtccgccctcgccgcactgcgctcatttctgcatccccctcccgccgacgtccgcctcaccgccgccggataagatgggtcgcgtgatccgcgcgcagcgtaagggtgcggggtccgtgttcaagtcccacacccacctccgcaagggccccgcccgcttccgctccctcaacttcggctagcgcaacgggtacctcaagggcgtcgtcacctacttcttccaagaccccggccgtggcgcgccgatctccaaggtcactttccgccaccctttcaggtacaagccccagatggagctctttgtcgcatccaagggcatgtccacgggccaattctcctactgcggtcgccgagccaccctctccatcgtgcaaggtgctgcccctccgcgggatccctgagggtgccagcctctgcaacatctaccaccacttcggtgaccgcggtgtcttcaccagggcctctggggactactccattgtgatcagccacaaccctgacaacggaacatcaaggattaagctgccctctggcaccaagaagattgtccccaacagctgccgtgctatgactgggcacgtcgctggtggaggctcgactgataagcaatgctcaatgctggtaacgcttacgnatattaccgtgtgacgatgaacacctggccaaggtgcgtggtgtggccattaaccctgtgaagctccccacgcaggag

SEQ ID NO: 74387 - DNA, 757 bp, Zea mays
  misc_feature: Ceres CLONE 1558765
  misc_feature: Translation starting site: 141
  misc_feature (727)..(727): n is a, c, t, g, unknown, or other
ctggagctccccgcggtggcggccgctctagaactagtggatcccccgggctgcaggaattcgtctcacccctagaaaaaactccgcccacgcctccactacaccacactgagccgcagcagactcgcaagggaaaggagatggatcgtctgcccgagtcgacccggagcatgaggaagtacgcgtcggaggccggcgggcttcgcgcggcgcggcagggcccccacgggcggtcgctgacggcgcgcacggcgcacagcatgtccacaacggcgctgcgcaccaagtccaagtcggccgcgtcgctgctgcgcagggtgcccttcgcgccgctccgccccgtcgtcgccaacctgcaggaggtgttcctcggcaccaagctcgccgtgctattccccgaccgtgccgctcgccatcgccgcccagtgcgcgcacttcggccagggtgtgggtgtttacgctcagcctactcagcctcatcccgctcgccgagcgtgtcatcttcctcaccgagcagatcgcgatgatcccggccccaccgtgggcggcctcctcaacgcgacgtgcggctacacctcggagctcatgatctggctcttcgcgctcttggggagccagatcgaggtcgtgaagtgctcactccgcagctccgtcctctgcaaccctgctgctcgtgctctgcacgtccctctcctgcggcgggggtgggaacgcggctcctacagcngtactcacgacgcatgcggacgtctgcacg

SEQ ID NO: 74388 - DNA, 772 bp, Zea mays
  misc_feature: Ceres CLONE 1558766
  misc_feature: Translation starting site: 561
ctccccgcggtggcggccgctctagaactagtggatcccccgggctgcaggaattcgtctcacccctagaaaaaatccacactcttctcttctccccggccggaccggagtcaggcagccgaagcaagaaaagcaagcggccttggaagttggaatccatggcgtccacctcgtgcttcctccaccagtccaccgcccgcgtggccgcgtcgtcgtctccgcgcctcgccgccccaccgcgcatcgcgcaactgttcgtctgcaggaccagaacatcatgccgccgcggcagagagcgacgtgtcgcgccgcgccgcgctcgcgctcctcgacggcgtctcggacgtcggcaccaaggcgagccacgccgccgacgcctacggggaagcagccaacgtgttcggcaagaccaagaagaacacggacttcatctcctacgtcggcgacggcttcaagctgctgatcccgtcatagtggacccccgctaggagcggtagtgacccaggcaagtgctccgctacgaggacaacttcgacgccaacagctacctgtccctcatcatgcttcccaccctcaagaaaaaccgtaaccgattatggctcccccaaagaattcctttccccgggcaaaatacctggttcggaaagaaaggccttcgggggggaaagaccaaatccaaagggcgggggttcaaaaaccaagcccaagggccacccgcccaaaaatgggtggaaaaagccccccccccccgtggggggaacggccaaacaac

SEQ ID NO: 74389 - DNA, 742 bp, Zea mays
  misc_feature: Ceres CLONE 1558769
  misc_feature: Encodes the peptide sequence at SEQ ID NO. 74390
ctaaccgcggtggcggccgctctagaactagtggatcccccgggctgcaggaattcgtctcacccctagaaaaaaaccgtcgctgcgctacgccaggtgccaaggtcttcttcgggttcttcgccggcgaccagcagcaccaggcaattagacttgtgtaagaaatggatgcaactgccggttaattgcgacacagatttatatggacatagatattggggccatgtgtaagggcggaagctgttcctaccgcgtcaataaggggagtcctgctggttctaccaggaagatccgttcctcagcctctcaaggtcggatggcatctgacacagcgagggtaacgaaaacagaggcatcaaagctgaagaacctgatctcggcatcattcaaacccttgtctctgaccattcccatcggcgacggattccacgaatcgctccctttcagccattgtcatttatagtagagaaagacctacaagaacgtcgaggtgctttctgcaggatctcataatacttgcacgagctaggatgcagctcaagcctcctgcaagacccaagctctattcagggctcatgacccaagaagatttggatccatactgtgatctaataccaggcttgcctgaagacttggcgaagatatgtcttgcccttgtccctcgtgctcattttcctgcccatgggcgcagttttcaaagagggtggaatgtcgttccctcgaaagcaagggagctcgtagc

SEQ ID NO: 74390 - protein, 70 aa, Zea mays
  misc_feature: Ceres CLONE 1558769
MQLKPPARPKLYSGLMTQEDLDPYCDLIPGLPEDLAKICLALVPRAHFPAHGRSFQRGWNVVPSKARELV

SEQ ID NO: 74391 - DNA, 809 bp, Zea mays
  misc_feature: Ceres CLONE 1558770
  misc_feature: Translation starting site: 144
  misc_feature (548)..(548): n is a, c, t, g, unknown, or other
  misc_feature (739)..(739): n is a, c, t, g, unknown, or other
  misc_feature (755)..(755): n is a, c, t, g, unknown, or other
  misc_feature (788)..(788): n is a, c, t, g, unknown, or other
tccccgcggtggcggccgctctagaactagtggatcccccgggctgcaggaattcgtctcacccctagaaaaatctcccgcagagccgccgacaactctctctaccgtccgataccccaagcaccagcgcggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaactgagatccctagtgaagaagtggcagacattaatcgaagcccatgttgatgtcaagacaaccgacaactacatgttngcgtttgttctgcatcggcttcacgaagaggcgcccaaaccaggtcaagagaacctgctatgctcaggcatcccagatccgtcagatccgccgtaagatggttgaagattatgatcaaccagggcttctacatgtgaccctgaaagaacttgtttcgaagttcattccagaaagtatttggtaaggaggantggagaaagtctaccntccaggcatcttcccaccttcaaaaacgtcttncatcccgcaaaggtgaagaat

SEQ ID NO: 74392 - DNA, 806 bp, Zea mays
  misc_feature: Ceres CLONE 1558771
  misc_feature: Encodes the peptide sequence at SEQ ID NO. 74393
  misc_feature (744)..(744): n is a, c, t, g, unknown, or other
  misc_feature (745)..(745): n is a, c, t, g, unknown, or other
ctggagctccccgcggtggcggccgctctagaactagtggatcccccgggctgcaggaattcgtctcacccctagaaaaagtgtccacttccttcttcccatccccataccatcccattgcacgcgcgcgctgcgtttcattccgtagcaattgcaatggcagtatatggattgctagggtttctcggagatcgatccgatcgatcccggtctagtccgtccaagggaaggctccacaggccctcccaaccccgattcccaacaacaagcaaacgcacgcagtatccgcgcggtgcatcatttccgaaacacacctcgctttgctgccttgctgctgttcaagcagtacaacacagcgctgccatggcgatgaatgcaagtatacgcgcagtcaaaagcgccatatgcatgcatgctgcgtatcgatccaaacagctggtcctgggcggcctgcagcgtataaatggaagaagcgtgtatctatgcgcgcgatcgagcagtgcccagcgcacgcgccggacggataatcttcggccgccgctacatttcatgctgctgatcacctatacctgcctgcctaaccgtacccgtgcagtgtctaatgtatattgcatcaggtcgatgttgcactgcacatgcagctggaggccatgtcgaaagatgcgtccagtgcacgacgtgatgaaagtgctgatggcgtcgcgcaagttccagatgcaggagctctgggcactgccccccccnntttggggggggcccccgttgggcccttttcccccgaccttgtgtcggcaagcacctaccca

SEQ ID NO: 74393 - protein, 147 aa, Zea mays
  misc_feature: Ceres CLONE 1558771
  misc_feature (128)..(128): Xaa is any aa, unknown, or other
MAMNASIRAVKSAICMHAAYRSKQLVLGGLQRINGRSVYLCARSSSAQRTRRTDNLRPPLHFMLLITYTCLPNRTRAVSNVYCIRSMLHCTCSWRPCRKMRPVHDVMKVLMASRKFQMQELWALPPPXWGGPPLGPFPPTLCRQAPT

SEQ ID NO: 74394 - DNA, 824 bp, Zea mays
  misc_feature: Ceres CLONE 1558772
  misc_feature: Encodes the peptide sequence at SEQ ID NO. 74395
aaactggagctccccgcggtggcggccgctctagaactagtggatcccccgggctgcaggaattcgtctcacccctagaaaaaacgttctccaacaccgccgttgaacctcctccctattcacgttctctagcaccgccgttgaacctcctcccctctccctcttgcttccctctctcatcctctctgccgcttccccgctctccccaaactactctgtgccccgtcagatcgacctggactttggcgacagctacttctcgacgggcggcacgggcgtgctgctacttctgcttcctctaccacgcttgctgttgagcggttcaagcagagctgatggctacatcagaaccagtacaagagagtttggtggtgcactactcacaacctagtaggccccgggtcctccttgctgcttcaggaagtgtagccgctataaaatttgagagcctttgccgtaacttctctgagtgggcggatgtccgagctgtggccaccacgtcaaccttgcacttcgttgatagatcatctctaccaagtggcatcgatctgtacactgatgacgatgaatggtctacctggaagaagataggagatgaagtcttacacatcgagctgcagaaatgggcaaacgttatgatgattgctccaatgtcagaaaataccatggctaagatcgccagtgggttatgcgacaacctcttgacctagatcgtgagagcgtgagactacagcaaaccgctctgtgttgctccagccatgtaacacgttaatgtggtactactcattcacgggagcggcatcttcgcacaatcaaccaactgt

SEQ ID NO: 74395 - protein, 124 aa, Zea mays
  misc_feature: Ceres CLONE 1558772
  misc_feature (21)..(124): Pfam Name: Flavoprotein Pfam Description: Flavoprotein
  misc_feature: SWISSPROT Homolog: EC 4.1.1.36 Phosphopantothenoylcysteine decarboxylase
MATSEPVQESLVVHYSQPSRPRVLLAASGSVAAIKFESLCRNFSEWADVRAVATTSTLHFVDRSSLPSGIDLYTDDDEWSTWKKIGDEVLHIELQKWANVMMIAPMSENTMAKIASGLCDNLLT

SEQ ID NO: 74396 - DNA, 769 bp, Zea mays
  misc_feature: Ceres CLONE 1558773
  misc_feature: Encodes the peptide sequence at SEQ ID NO. 74397
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
ctccccgcggtggcggccgctctagaactagtggatcccccgggctgcaggaattcgtctcacccctagaaaaaacatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggatggcatcccacctgaccagcaacgtctcatctttgccggcaagcagttggaagatggcaggacccttgctgactacaacatccagaaggagagcaccctccacttggtgctgcgtcttaggggtggtatgcagatctgaactcgaaccctgggctcactgagagcacaagagcccgccccgggnnnnnnnnnnnnnnnnnnnnnnnnnnnnnnnnnnnnnnnnnnnnnnnnnnnnnnnnnnnnnnnnnnnnnnnnnnn

SEQ ID NO: 74397 - protein, 155 aa, Zea mays
  misc_feature: Ceres CLONE 1558773
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKDGIPPDQQRLIFAGKQLEDGRTLADYNIQKESTLHLVLRLRGGMQI

SEQ ID NO: 74398 - DNA, 795 bp, Zea mays
  misc_feature: Ceres CLONE 1558774
  misc_feature: Encodes the peptide sequence at SEQ ID NO. 74399
tccccgcggtggcggccgctctagaactagtggatcccccgggctgcaggaattcgtctcacccctagaaaaagacccttcgtcccgcatcgtttcctcctcctttttccccgttcgtcccctggattggcgtctacccggcgcgacccggaccgaatcctaagtccgcctgccgccgccgccgccggctcccgttggaaacgagtttggagtaaagaaaccaaccttgcatctgtgttctgtctgtctatgctgctttgctttggattcacaaaaaaataagccttgcatcttactgacttgagataactatgcctaaggacaggagctcccgcgtttcctctcacgagagccgccgggctcgtgcctccccatacttgtcagcgtctcatggacagagcagttcttcacgccggtcacaagaagtctcctgcggccgcggcagcgaaacaagctgcatagtgggaggatgttcggtgctcggtctgcatggaccacccgcacaacgctgtcctgctggtctgctcgtcgcacaataagggctgccgccccttcttgtgcgacacctggtcgcggcactccaattgctttgaccaggacccggaaggcctccaaggacccctccaaggattctgggaccaaattgcagcctgtgccccccagcgggggcccccccctttgtgcccccctggggccgggggcccgttcccccacttgtttcaagggaccttccgaaccgacgggaggggtcatttaacccccccctgtgccccgggtgcccccccacccttggga

SEQ ID NO: 74399 - protein, 102 aa, Zea mays
  misc_feature: Ceres CLONE 1558774
  misc_feature (1)..(102): Pfam Name: DUF1644 Pfam Description: Protein of unknown function (DUF1644)
MDHPHNAVLLVCSSHNKGCRPFLCDTWSRHSNCFDQDPEGLQGPLQGFWDQIAACAPQRGPPPLCPPGAGGPFPHLFQGTFRTDGRGHLTPPCAPGAPPPLG

SEQ ID NO: 74400 - DNA, 807 bp, Zea mays
  misc_feature: Ceres CLONE 1558777
  misc_feature: Encodes the peptide sequence at SEQ ID NO. 74401
ggagctcaccgcggtggcggccgctctagaactagtggatcccccgggctgcaggaattcgtctcacccctagaaaaagcgacacatctgaattctcaccattacctcgcacacagattatcgtctagcaggctcgatgttggttggcacccaccgtctctgctcgatcgcaacgcgcttggcatggcgtccaaggtgtggctatcgcctgcatctcgcctccgatccctatccaacgcaccatctcgcttacgctccaagcctgccaccacaaccgcctctttggtctctgcctgtccgcgacctgcgagcgccatggctgtgctgcgtgtgcttctcctccgccgacttcacgccaccgaacagcaagggcaggttcacgagcaagatgacgaggtggtggacaggaacatgctcccctactgcagcatcgacaggaagcacaagaacacgctgggagagatggagcacgagttcctgcaagccgtccaggccttctactatgaccaaaaggccatcatgtccaacgaggagttcgacaacctcaacgaggagctcatgtgggaggggagcagcgtcttcatgctaaacgaagatgagcaaaagcttttggaagcttccttggactatacctccggcaacccaatcatgtctgatgctgagttcgaccaactgaaacttagattaaagacagacggcagtgtcattgtgaatgagggtcccaggtgcagcctaaggactcataaggtgtacagtgacttgaatgttgactacctaaagatgttcctgctatatgttccagccacg

SEQ ID NO: 74401 - protein, 208 aa, Zea mays
  misc_feature: Ceres CLONE 1558777
MASKVWLSPASRLRSLSNAPSRLRSKPATTTASLVSACPRPASAMAVLRVLLLRRLHATEQQGQVHEQDDEVVDRNMLPYCSIDRKHKNTLGEMEHEFLQAVQAFYYDQKAIMSNEEFDNLNEELMWEGSSVFMLNEDEQKLLEASLDYTSGNPIMSDAEFDQLKLRLKTDGSVIVNEGPRCSLRTHKVYSDLNVDYLKMFLLYVPAT

SEQ ID NO: 74402 - DNA, 800 bp, Zea mays
  misc_feature: Ceres CLONE 1558778
  misc_feature: Encodes the peptide sequence at SEQ ID NO. 74403
ctggagctcaccgcggtggcggccgctctagaactagtggatcccccgggctgcaggaattcgtctcacccctagaaaagctctgctctgctctccttgcatagggtttatcttctcccctcctctgcccccatctcgcttctcgcacacggcagccggattccgaagcgcgccccctcggccccagccaaaagcatcgcagtttctaatcgtttggagagcacacaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaactgtcgtcaccccaaagtacacttcactgaagcctctgggagatagggtgcttgtgaagcttggtgccgcagaggagaagacagttggtggcattttgcttccatctactgcccagactaaaccacaaggaggtgaggttgttgctgttggagcaggaaggaccatcggggacaagaaaatagctgtggatatagagactggagcacaagtagtatactcaaagtatgctggggactgagggtgaattcaatgactcaaagcatctttatctcaaagaagacgatatcatgggtattcctgagacagatgatgtgaaagacatgaagctctccaatggaccgtggtctcatccaaggttgccgagcccgaaaacaaaactcctgggggggccttatcttcacctgaaacaactaaagaggagccgttccatagg

SEQ ID NO: 74403 - protein, 124 aa, Zea mays
  misc_feature: Ceres CLONE 1558778
  misc_feature (54)..(125): Pfam Name: Cpn10 Pfam Description: Chaperonin 10 Kd subunit
MSFVQLSGAGVAAVAFTNKSLVSRHAALRVCSSRRSIRSLVVKAATVVTPKYTSLKPLGDRVLVKLGAAEEKTVGGILLPSTAQTKPQGGEVVAVGAGRTIGDKKIAVDIETGAQVVYSKYAGD

SEQ ID NO: 74404 - DNA, 1554 bp, Zea mays
  misc_feature: Ceres CLONE 1558780
  misc_feature: Encodes the peptide sequence at SEQ ID NO. 74405
gtctcctggcgcggctgtagcctgtagggaacggcgggtgcgggtgacatgagctgcttgggctggttcaagcggaggtcgaggagcggaggatcggcggcgaagcgaggagcgtcggcgccggtgtcggcgtcgggccccgcgaccacaacgacgaccacgacgacggccacgacagcgtcggcggtgagcacgagccggtcggacgactcgggcgcggcgcggccggcgagcaagtcggcggggtcggccggctcgtcgtcgcagtcgcaccggagcatctcctcgctgtacgaggagcggggccacggccagctgcgggtgttcggctacgaggagctccagggcgccacggccgacttcagccgcgcgcagaagctcggcgagggcggcttcggcagcgtctacaagggcttcatccgcggcgccgacggcaagggggaccgcgtccccgtcgccgtcaagaagctcaaccagcgcggtatgcagggacataagcaatggttggcggaagtacagtttcttggtgttctggagcacccaaatctcgtaaagctacttggatattgcgctgttgatagcgaacgaggggcacaaagattgctagtctacgagtttatgcccaataagagcctggaagaccacttgttcaggcgagctaatcctcctatatcatggaacacaaggcttcaggttatcttgggggccgcagaaggattggcttacctgcatgaaggggtggaagttcaggtaatctaccgggacttcaaaacgtccaacgttctattggacaaggacttcagagcaaagttatcagacttcggcctagccagggaggggccaactggagcaaacactcacgtctcgactgcggtcgtcgggacgcacgggtacgctgcgccggagtacatggacacggggcacctgacggcgaagagcgacgtgtggagcttcggcgtggtgctctacgagatcctgacgggacggcggtcgctggaccggaacagaccggcggcggagcagaagctgctggagtgggtggcccagttcccgccggacagccgcaacttccggatgatcatggaccccaggctccgcggcgagtactcggcgaaggccgcccgggagatcgccaagctggccgacagctgcctgctcaagaacgccaaggagcggcccaccatgagcgaggtggtcgaggtcctcaggcgggccgtgcaggcgcacgccgagcctgacggccggactcccggccccggcgccagggggaagaaagccgccgccgccgccgccgccgccgcgccgtccaggcggtgatggctacatgtcgtcaccggtaaaggcgcgctgttgccttatttctgagaccattgtttggtcagtcctagccgtgactcggtgagttgtgattgtgacagcacaaaaggaatgtttatgcttgggtacattcttggacacattgcttagacgacttgtgtacatatagatgagttggcggaatgaactttgttagctttcgaaagtgagcatttgaaagaaaaaaaaaaaaaaaaa

SEQ ID NO: 74405 - protein, 422 aa, Zea mays
  misc_feature: Ceres CLONE 1558780
  misc_feature (105)..(386): Pfam Name: Pkinase Pfam Description: Protein kinase domain
  misc_feature: SWISSPROT Homolog: EC 2.7.11.1 Non-specific serine/threonine protein kinase
MSCLGWFKRRSRSGGSAAKRGASAPVSASGPATTTTTTTTATTASAVSTSRSDDSGAARPASKSAGSAGSSSQSHRSISSLYEERGHGQLRVFGYEELQGATADFSRAQKLGEGGFGSVYKGFIRGADGKGDRVPVAVKKLNQRGMQGHKQWLAEVQFLGVLEHPNLVKLLGYCAVDSERGAQRLLVYEFMPNKSLEDHLFRRANPPISWNTRLQVILGAAEGLAYLHEGVEVQVIYRDFKTSNVLLDKDFRAKLSDFGLAREGPTGANTHVSTAVVGTHGYAAPEYMDTGHLTAKSDVWSFGVVLYEILTGRRSLDRNRPAAEQKLLEWVAQFPPDSRNFRMIMDPRLRGEYSAKAAREIAKLADSCLLKNAKERPTMSEVVEVLRRAVQAHAEPDGRTPGPGARGKKAAAAAAAAAPSRR

SEQ ID NO: 74406 - DNA, 772 bp, Zea mays
  misc_feature: Ceres CLONE 1558781
  misc_feature: Encodes the peptide sequence at SEQ ID NO. 74407
  misc_feature (643)..(643): n is a, c, t, g, unknown, or other
  misc_feature (758)..(758): n is a, c, t, g, unknown, or other
tggagctccccgcggtggcggccgctctagaactagtggatcccccgggctgcaggaattcgtctcacccctagaaaaaccctagaaaaacaagtacgagaagcctgggctggagctcaccaccaaggccgccgtggccaagggcaagcacggcttcctgcccatgcccaagaagtcgtacggcaagtcggacgcgttcgcggacaccatcccgatggcgtcgcacccgtcgccgttcgcggccgcggccgccgtcgtggcggaagaggcgaccatcgccgaagcagtggcggtgtgcgcggcggcgtacgagaagaagaccgggtggggcagcgacatcgggtgggtgtacggcacggtgacggaggacgtggtgacggggtaccggatgcacatcaaggggtggcgctcccgctactgctccatctacccgcacgccttcatcggcaccgcccccatcaacctgacggagcggctgttccaggtgctccgctggtccacgggctccctggagatcttcttctcccggaacaacccgctgttcgggagcacgttcctgcacccgctgcagcgcgtggcgtacatcaacatcaccacgtacccgttcacggcgatcttcctcatcttctacaccacggtgccnggcgctgtcgttcgtgacggggcacttcatcgtgcagcggcccaccaccatgttctacgtgtacctggccatcgtgctgggcacgctgctgatcctggccgtcctgaaggtgaantgggcgggcgtgac

SEQ ID NO: 74407 - protein, 203 aa, Zea mays
  misc_feature: Ceres CLONE 1558781
  misc_feature: SWISSPROT Homolog: EC 2.4.1.12 Cellulose synthase (UDP-forming)
  misc_feature (199)..(199): Xaa is any aa, unknown, or other
MPKKSYGKSDAFADTIPMASHPSPFAAAAAVVAEEATIAEAVAVCAAAYEKKTGWGSDIGWVYGTVTEDVVTGYRMHIKGWRSRYCSIYPHAFIGTAPINLTERLFQVLRWSTGSLEIFFSRNNPLFGSTFLHPLQRVAYINITTYPFTAIFLIFYTTVPGAVVRDGALHRAAAHHHVLRVPGHRAGHAADPGRPEGEXGGRD

SEQ ID NO: 74408 - DNA, 821 bp, Zea mays
  misc_feature: Ceres CLONE 1558785
  misc_feature: Encodes the peptide sequence at SEQ ID NO. 74409
  misc_feature (695)..(695): n is a, c, t, g, unknown, or other
  misc_feature (751)..(751): n is a, c, t, g, unknown, or other
ctggagctccccgcggtggcggccgctctagaactagtggatcccccgggctgcaggaattcgtctcacccctagaaaaagccagtgccagtggcaggcttataaacactaggagtcgtcccttccttgctctgctttcctctctgctagctagctcttgtcttgtcactgagtgagcagaaggagtgtgtggtggagtgcaaaccaaatcaaacgaagaaaagtgggagcgaggaggaagaaaagaagaagaagaagacgacggcgacacccaccaccagcagcaagcagcaatcagcaaccagcataacgaaatgtcgatcaagtactgcgaccagcacaaggactgcgagcggcagcgtctgtaccgtcgcttctgcgccgccctggtgggcgtcatcgtgctcgtcctcctcatcgtgctcatcgtctggctcgtcctccgccccaccaagcctcgcttcttcctcaacgacgtgagcatcgtgtgcatcaacgtcagctccgcctcctacctcaccgtcaccatgcaggccacgctggcgtcgcgcaacaccaacgaccgcgtcggcatctactacgaccgcgccgacgtgtacgccgagtaccgggcgatgcagatcacggtgcccaccgcgctgccgcccttcttccgccgcccaacgacgccgccgtctgggcgccctttctctccngcctcaacgtcccgctgccgccctacctcgccaccgcgctcacacaggacgagacngccggggtacctgctcgtcaccatccgcgtcgacggctggatccgctggaaggccggggccttcatcacc

SEQ ID NO: 74409 - protein, 169 aa, Zea mays
  misc_feature: Ceres CLONE 1558785
  misc_feature (40)..(169): Pfam Name: Hin1 Pfam Description: Harpin-induced protein 1 (Hin1)
  misc_feature (146)..(146): Xaa is any aa, unknown, or other
MSIKYCDQHKDCERQRLYRRFCAALVGVIVLVLLIVLIVWLVLRPTKPRFFLNDVSIVCINVSSASYLTVTMQATLASRNTNDRVGIYYDRADVYAEYRAMQITVPTALPPFFRRPTTPPSGRPFSPASTSRCRPTSPPRSHRTRXPGYLLVTIRVDGWIRWKAGAFIT

SEQ ID NO: 74410 - DNA, 785 bp, Zea mays
  misc_feature: Ceres CLONE 1558787
  misc_feature (340)..(340): n is a, c, t, g, unknown, or other
ctgagctcccgcggtggcggccgctctagaactagtggatcccccgggctgcaggaattcgtctcacccctagaaaaagtcacaccttccctcggtcccttccatctcctaaccgccgccgccgccgccgctgcccaaaaccctacctaccctcttcttcccctcactctcctttcatctccattctaatggcggcccaacacgtccggcgaagctgctagtgcttgtatctactatctcatcaagtacatcacagatctactagagtatccccagcgccagctgcatggccaccctcaaccatttagtactccttggcgccgacgaacacgacaacccntaccagctgattgctgcggacgcggctttctgctcccaaaccccgaagacaaaaaatcccgccctgggcccccgccttgggaaaggttgcccaggccttggggggaaaccccccaaattccccgaaccaaacccccgtcccctccccccccaaaaaaaagttttgggaataaaaacaccggggggggggggcctcctcaccccccccggggaaaaacttttttggccccccgggttaaaaaaagggcccccctgccaaaaaatgtggaacccgggggtaatttgttcccaaaaaaaaggggggggtccccccgggggggaaaaaaaggaaaaaaaaaccccccccccaaaaaaaattttttggggggccccaaaagctcttttgggggaagttgttttttttttcacccccggggaggttttcccccaaaaaaaaaaagaaggga

SEQ ID NO: 74411 - DNA, 807 bp, Zea mays
  misc_feature: Ceres CLONE 1558790
  misc_feature: Encodes the peptide sequence at SEQ ID NO. 74412
  misc_feature (678)..(678): n is a, c, t, g, unknown, or other
  misc_feature (792)..(792): n is a, c, t, g, unknown, or other
ctcaccgcggtggcggccgctctagaactagtggatcccccgggctgcaggaattcgtctcacccctagaaaaaatctcaagccaccatcgaccttcaagtctcgctacgtagcagtgcaataaaaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggcctgccaggtcgtgctcatgggcgccgtcgagggctaacgcatcgccggcngccgctccggcgaggtcgtcgaacccgctctatccccggcgcagctttcgaccgcttcggccttcccgaagaacccccaaggctttcgccgaacctcaaaggtgaagagctcangaacgggcgccctcc

SEQ ID NO: 74412 - protein, 174 aa, Zea mays
  misc_feature: Ceres CLONE 1558790
  misc_feature (65)..(175): Pfam Name: Chloroa_b-bind Pfam Description: Chlorophyll A-B binding protein
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEG

SEQ ID NO: 74413 - DNA, 780 bp, Zea mays
  misc_feature: Ceres CLONE 1558791
  misc_feature: Encodes the peptide sequence at SEQ ID NO. 74414
ctggagctcaccgcggtggcggccgctctagaactagtggatcccccgggctgcaggaattcgtctcacccctagaaaaaccttccgccctccgcccaaaaccccacgcgagctcccattcccatccatggcgaccaccacctcttcctcctcgctgaccactcctctcctccgccccaaccccaataccaaccctgctcccagatctctccaactcctcaggagcaggaggtgcgctcgtgccgtaactaccgccgtagccggaggtgcggtgccttacggggctaatccgcggcgcgggatttggtcgatcagggatgacttggtggtgccaaggtcgccctacttcccagtggagtccgcggcggggcaagagcgtgagccgtcgcccatggtgatggagcggttccagagcatcgtcagtcagctgttccaacacagaattattcagagcggaggccccgttgaggatgatatggccaacatcattgtagcacagctgctctacctcgacgctattgatcccaataaggatatcattatgtacgtgaattcgccaggagggtcagtgacagctggaatggctatatctgatacaatgaagcatatcaagcctgatgtatccactgtttgtattggactagctgcaagcatgagagctgttctactaagtgctgggaccaaaggacaacgatacagctgaccaaactcaaggatcatgatccatcaacctctctgtaggggcccaaagacagggagactgatccttgagactcaagc

SEQ ID NO: 74414 - protein, 103 aa, Zea mays
  misc_feature: Ceres CLONE 1558791
  misc_feature (1)..(104): Pfam Name: CLP_protease Pfam Description: Clp protease
  misc_feature: SWISSPROT Homolog: EC 3.4.21.92 Endopeptidase Clp
MVMERFQSIVSQLFQHRIIQSGGPVEDDMANIIVAQLLYLDAIDPNKDIIMYVNSPGGSVTAGMAISDTMKHIKPDVSTVCIGLAASMRAVLLSAGTKGQRYS

SEQ ID NO: 74415 - DNA, 725 bp, Zea mays
  misc_feature: Ceres CLONE 1558792
  misc_feature: Encodes the peptide sequence at SEQ ID NO. 74416
ctccccgcggtggcggccgctctagaactagtggatcccccgggctgcaggaattcgtctcacccctagaaaaaagacgcatcgcttccttgtccatcctacctccccttccccccgcccaaatcccgtgacggtcgccgcccccgccgtgctctcgcccgcgcgggagacgacgcagcacccccccgcgtaggatccgcggcggtcggcaggatggtggtggccacggaggaaatggtggtctactgctttgacaccctcgtcgcctatttcaccggcgagcggccgccgcctcccgccttcgaggatggaaaccacccattgtttgtgacctggaagaaggctgccaatggttcagaaccacgcctacggggatgcataggaactctggagtcccgtcagattgtcagcggctttagggactacgccctaactagtgcgctgagggaccgacgctttcccccaatacaatcaaaggaactcccaaccttggagtgcacggtatctatactcactgattatgaaattgcagaggactacctcgactgggaggttgggaaagcatggttttatttattggattttacaggctccagaactcccaacccaaaaaccccaaggggggaaccctatttttgccccgaaaaatttgcccggggcccctttaaaaggggggtggggaaacccccttggggggaaaaaaacaattcttgtttttgtttttt

SEQ ID NO: 74416 - protein, 170 aa, Zea mays
  misc_feature: Ceres CLONE 1558792
  misc_feature (4)..(134): Pfam Name: AMMECR1 Pfam Description: AMMECR1
MVVATEEMVVYCFDTLVAYFTGERPPPPAFEDGNHPLFVTWKKAANGSEPRLRGCIGTLESRQIVSGFRDYALTSALRDRRFPPIQSKELPTLECTVSILTDYEIAEDYLDWEVGKAWFYLLDFTGSRTPNPKTPRGEPYFCPEKFARGPFKRGVGKPPWGEKNNSCFCF

SEQ ID NO: 74417 - DNA, 800 bp, Zea mays
  misc_feature: Ceres CLONE 1558797
  misc_feature: Encodes the peptide sequence at SEQ ID NO. 74418
  misc_feature (750)..(750): n is a, c, t, g, unknown, or other
  misc_feature (753)..(753): n is a, c, t, g, unknown, or other
  misc_feature (769)..(769): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (776)..(776): n is a, c, t, g, unknown, or other
ccccgcggtggcggccgctctagaactagtggatcccccgggctgcaggaattcgtctcacccctagaaaaaacatacagcccctcttgcccacaccacctcgctgaaccggaagacccgcacacacacgccacttgtagaccatggcgccccgggtggcggacaagtcgcctctaccgccggccaccggcctggggctgggcgttggcggaggagtcggaggcgtgggcatgggcccgcactacagaggcgtgaggaagcgtccatggggacgctacgccgccgagatccgcgaccctgccaagaaaagccgtgtgtggctcggcacgtacgacacggccgaggaggccgccaaggcgtacgattccgccgcccgcgagttccgaggcgccaaggccaagacgaacttcccgttcccctcccagtgctccgtcgcctccggtgctgccggtagcgccagtagcaacagcaccgtggattcgagcggtggcggtagcggctgtggcatccaggcgcctatgcaggccatgccgcttcctccggctctcgatctcgacctctttcatcgggcggcccgccgtgaacgcagtctccacccggcatgcgggtttccgttcaaggggctaatccctgttcgccctggcccaaaaccccccaaaaaggaattttttttttcctaaaaaaaagggggggttgtctcccccccggcccccccccagaaaacccaaagaattttccttttggtggggnccnccgccccccccccccncnnnnanagaatattaatgtgtggggggccg

SEQ ID NO: 74418 - protein, 178 aa, Zea mays
  misc_feature: Ceres CLONE 1558797
  misc_feature (32)..(83): Pfam Name: AP2 Pfam Description: AP2 domain
MAPRVADKSPLPPATGLGLGVGGGVGGVGMGPHYRGVRKRPWGRYAAEIRDPAKKSRVWLGTYDTAEEAAKAYDSAAREFRGAKAKTNFPFPSQCSVASGAAGSASSNSTVDSSGGGSGCGIQAPMQAMPLPPALDLDLFHRAARRERSLHPACGFPFKGLIPVRPGPKPPKKEFFFS

SEQ ID NO: 74419 - DNA, 774 bp, Zea mays
  misc_feature: Ceres CLONE 1558799
ctccccgcggtggcggccgctctagaactagtggatcccccgggctgcaggaattcgtctcacccctagaaaaatcgtttgcataccgatcagcaggattatgatggttttgtcgagcttgatcgtgtaaagttgagcggcagcaacaaaaaactttcgatactacaacttggcatcaaacgaaataacaaggttcagaaaaaactgcatggagttacccactttagtcgtattcagatgcctatatcttcagatcctcttaccggttgttttccgtgcaaaagttggtgaacactatcggctccctcataagggaattatccctagagaacttggagtgattgctaggtacaaggggcaaaggaaaattgcagatcctggtttccaaaaccctcaatgggttgacggggagcttttgatactagatggaaagttcatcagagatggtcctgtgatagctttcttttactggacatctaatgttcatcttttcgaattctttagacagttgaagcttcctgacttagttccttctaaaagtagttaaaggccattataatttcagcatagctgcgtttggagccaaccggagttgcctggcatcgagtacagattctgatgtggagaaaaaggcgcctgccatgaaatcatggcatctccacccaactcctgatagcctggccacaagggtgggaaaaaaaaacccattcccaagaaggattatcatcctggcccaaaatgggtggaccggcggggcgcatttttcctaaattc

SEQ ID NO: 74420 - DNA, 953 bp, Zea mays
  misc_feature: Ceres CLONE 1558800
  misc_feature: Encodes the peptide sequence at SEQ ID NO. 74421
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (17)..(17): n is a, c, t, g, unknown, or other
  misc_feature (18)..(18): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (72)..(72): n is a, c, t, g, unknown, or other
nttttttttnnttattnnttcatccccaaaaaccaaaacacaaaacacccacacccctnnnnngtctcaaanattaaaaagtggaactccccgcggtggcggccgctctagaatagtggatcccccgggctgcaggaattcgtctcacccctagaaaaaattaactaaattgacattgctgaggccttggagttgagggatggaggatctgattatcttggcaagggtgttcttaaggctgtcagcaacgtaaacaacattattggaccagcgattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggcgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaacgttggggatgaaagtgggttttgcacctaacattcaggaaaaaaaagaaggcccttgaactattggaaggcagcccataggaaaaaggctggcctaccactgggaaaaggtgggtcatttgggaaatgagatggttgcctgccttcctgaaattctttcgggtggaggaaaaaaacaaaaaccttaatgaattctttaaattttccaaggggaagggaggaaacaacccgaagtggcccctcaaaaaaaaaaaaattttcccaggggggggaaacaaa

SEQ ID NO: 74421 - protein, 128 aa, Zea mays
  misc_feature: Ceres CLONE 1558800
  misc_feature: SWISSPROT Homolog: EC 4.2.1.11 Phosphopyruvate hydratase
MVQQLDGTSNEWGWCKQKLGANAILAVSLAVCKAGAMVKKIPLYQHIANLAGNKTLALPVPAFNVINGGSHAGNKLAMQEFMILPTGASSFKEAMKMGVEVYHNLKSIIKKKYGQDATNVGDESGFCT

SEQ ID NO: 74422 - DNA, 768 bp, Zea mays
  misc_feature: Ceres CLONE 1558801
  misc_feature: Encodes the peptide sequence at SEQ ID NO. 74423
ctggagctcaccgcggtggcggccgctctagaactagtggatcccccgggctgcaggaattcgtctcacccctagaaaaatctcctcgcttgccctaattccgcatccccggctgaggcagcagcggcggcgccggcaccggcaccggctcaccagcgataccgggaagaatggggaggtacagtcccgcgtacagccccccgaggagaggacatggcggcaggggaaggagcccacctcccaggagaggatatggcggtggccgtggtgaccatggctctgtcagcctcctggtccgcaacattccattgagatgcaggcctgaggaactacgtgtccctttcgaacggttcggccctgttcgggatgtttacctgccaagagattatcacactggggagccaagaggatttgggttcgtggagttcgttgatgcttatgacgcttctgaggcacagtaccacatgaatcgccagatgtttgctgggcgtgaaataactgttgtacttgctgcggatacacggaaaaggcctgaggacatgcgtagacgaactggaccaagaggttattctggtcatgaagggcgtcgtccgaatcgtcatggtgcaggacggtcccgatctcgttcatactcgcgttcccgctcaccgcgccctcgtggttcgtggtagatcacagtcatactcccctggcccggaaaaggcggatgactactcggcttcccccacctcgggcaaaggaggagcacccgaggtcctccaaacagcc

SEQ ID NO: 74423 - protein, 166 aa, Zea mays
  misc_feature: Ceres CLONE 1558801
  misc_feature (40)..(111): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MGRYSPAYSPPRRGHGGRGRSPPPRRGYGGGRGDHGSVSLLVRNIPLRCRPEELRVPFERFGPVRDVYLPRDYHTGEPRGFGFVEFVDAYDASEAQYHMNRQMFAGREITVVLAADTRKRPEDMRRRTGPRGYSGHEGRRPNRHGAGRSRSRSYSRSRSPRPRGSW

SEQ ID NO: 74424 - DNA, 794 bp, Zea mays
  misc_feature: Ceres CLONE 1558807
  misc_feature: Translation starting site: 200
  misc_feature: SWISSPROT Homolog: EC 2.3.1.119 Icosanoyl-CoA synthase
ctggagctccccgcggtggcggccgctctagaactagtggatcccccgggctgcaggaattcgtctcacccctaaaaaaaacgtctccggctccggcgtccgcttccaccaactcacaccaaagtggcgacatcgccttccgccgcctgacacgtctggagttgttgttttagccgccagctcgctcccatctatctccatggagtctgctcccgccgcggtcatggagcgggagcgcctcacagccgagatggccttccgcggcgcggacgaagcgcggcgggacggcggcgagccggcgcccagcatcgtcatcaagatccgccgccggctcccggacttcgcccgcagcatcaagctcaagtacgtcaggctcgggatccgacacggaggcagccccacgtcggtgctgccgatgctctgcgtgccggcggtcgccgccgccgcctactcgttcgtccgcctcgacgtcatctactactccatcgacctgctcacctgcgtcgcctggctcggcaccgcgctgctgctgctcaccgtctactacttcaagcggccccgcccggtgtacctcgtgggacttcgcgtgctacaagccggaggagcagctcaagatctccaagtccgccttcctcgagatgaccgagagcacggggtccttcaatgatgcggctctggatttccagaccaagatcacaatccgctccgcgctcggcgacgagacatacctgggcacccggcgtgcaggcgcggccgccgatgctcaacatggcggaatgcgcgatggatgccaa

SEQ ID NO: 74425 - DNA, 877 bp, Zea mays
  misc_feature: Ceres CLONE 1558810
ctccccgcggtggcggccgctctagaactagtggatcccccgggctgcaggaattcgtctcacccctagaaaaaagccgctgccccgaagccacctctttgtgcctccacttgcgtgccgctagccacagccgctcgtcgatctgagctgccgccgccgccgtcgttcgccgattggagccaccgccgtcacccagtcagtggccgattggagccgcctccgcgaggcctgtggtcgtcagcccgtcagccgccgattggagccgccgctgcgagagaagcatgcagtcgtgcaagtcctgtgatcctaactgattatgcactccaatgggctgcggagcacaaaggggagaaaaacaaaaacgagtgggaggtggccgtgggccatgttgctgctgctgacgaaggcgggcgcgacccataagtaaagggcgtacaacagctccccctcccctcgttccaggcttccaggccgccggttcagggttttcttaaccgcaaaattttctaacattcccgtttccgcccccaaggggaaaacacggttcccccccttggggcccccccccccccgggaggggtttaaccaaatttttgtgcccccggaagtttaatttaaaaaccccggggttccgcccccgtggggagaaaaacctgggggggccctctcaaaaaacctggacagtgtctcctgtgtaaaaaaaaaaaggtgttctctctttgtgttatattccccaccttttctataatttttccccccccctttttgtagagggggaaaaaatccccccgtgttcttcacaaaaaaaaaaacccccgcggggggagggggggcccctcaaaagaagaaaaaaaactctttggggccaaaaaacaaa

SEQ ID NO: 74426 - DNA, 792 bp, Zea mays
  misc_feature: Ceres CLONE 1558812
  misc_feature: Translation starting site: 153
ctccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccaaagcatatggtacggccctgatcgccccaagtatcttggcccgttctccgagcagacgccgtcgaacctgaccggagagttccccggccactacggatgggacaccgcgggcctctcggccgacccagagacattcgcgcgcaaccgggagctggaggtgatccactcccggtgggcgatgctgggcgcgctgggctgctctgttcccggagatcctggccaagaaccgcgtcaagttccgcgaggcggtgtggttcaaggccggcgcgcatatcttctcggagggcgggctggactacctggggaactccaacctggtgcacgcacatagcatcctggacatctgggcgtgccacgtggtgctcatgggcttcgtcgagggctaacgcgtatgcagcagccgctcggggaaaggctcgactaggtgtacaccagcgtcgccttcgatccagtagaactcgtcgaacaacagggacaacgacgccgagctccatgtgcatgagctcaagaaacgaccc

SEQ ID NO: 74427 - DNA, 742 bp, Zea mays
  misc_feature: Ceres CLONE 1558815
  misc_feature: Encodes the peptide sequence at SEQ ID NO. 74428
ctcaccgcggtggcggccgctctagactagtggatcccccgggctgcaggaattcgtctcacccctagaaaaactcagctagcctgcttgcttcgagcctagctgtctccgtccgtctagctccagctctccctcgaggcccggaacgcgaggacgacgaagagcagagcagggcagagccccagccagccacaatgccgtcgtcggggatcaccgcggtggacgcggccgccaaggggatgaagctggagcggtacgccagcgggggcgcgctgctgctgcggcgggcttcgtgggcacgcactgctcgctggcgctgagggcccgcggcgacggcgtcctgggcctcgacaacttcaactcctactacgacccgtcgctgaagcgcgcgcgccaggcgctgctggccagccgcggcgtcctggtgctcgacgccgacatcaacgacgccccgctgctggagaggctcttcgacgtggcggcgttcacgcacgtgctgcacctggccgcgcaggccggggtgcggtacgccatggaggcgccgcagacgtacgtggcgtccaacgtggccgggctcgtcagcgtcttggaggtgggcggccagcacgccgacccgcagccggcggtcgtctgggcctcgtcctcgtccgtgtacgggctcaacaccgacgcgccctttctccgagacccacgcaccgaaccgacgggcgtcgctgtacgcggccacccaggagggccggcg

SEQ ID NO: 74428 - protein, 70 aa, Zea mays
  misc_feature: Ceres CLONE 1558815
  misc_feature: SWISSPROT Homolog: EC 5.1.3.6 UDP-glucuronate 4-epimerase
MEAPQTYVASNVAGLVSVLEVGGQHADPQPAVVWASSSSVYGLNTDAPFLRDPRTEPTGVAVRGHPGGPA

SEQ ID NO: 74429 - DNA, 802 bp, Zea mays
  misc_feature: Ceres CLONE 1558816
  misc_feature: Encodes the peptide sequence at SEQ ID NO. 74430
tcccgcggtggcggccgctctagaactagtggatcccccgggctgcaggaattcgtctcacccctagaaaaaccgcactgcagtggcctagccggcgtcgtcctccccctctctcgctcctctgtcctcccctctccacttgagaagaacacaattaggaaaaaaaggcaaaaaacatttaccttttttctatctgtatattatctgaataaatcaagaggaggaagaggggagggagcgagggaggggggaggagtagcaaatccagactccatagcaaccagctcgcgagaaggggaaaagggggaggaagagcttcgcttgtgtattgattgctcgctgctccagtccctgcattcgtgccgtttttggcaagtaggtggcgtggcaagcatggtgccgggctatgactgcgccgcctccgtgctgctgtgcgcggaggacaacgctgctattctcggcctggacgacgatggggaggagtcctactgggcggtcgccgctacgccgccacgtgacaccgtcgccgccgccgccgccaccggggtcgccgtcgatgggattttgacagacttccccttgctctcggatgactgcattgcgacgatcgtggagaaagaggtggagcacatgcccgcggaggggtacctccagaagctgcaacgacagcatgggggacttggatttggccgccgtcaggaaggacgccatcgattgtatttgggaagatcctctccacgtatgagttccactgtaggcttgaaacccttagtatcactgggaagcagtcccactccaattg

SEQ ID NO: 74430 - protein, 136 aa, Zea mays
  misc_feature: Ceres CLONE 1558816
MVPGYDCAASVLLCAEDNAAILGLDDDGEESYWAVAATPPRDTVAAAAATGVAVDGILTDFPLLSDDCIATIVEKEVEHMPAEGYLQKLQRQHGGLGFGRRQEGRHRLYLGRSSPRMSSTVGLKPLVSLGSSPTPI

SEQ ID NO: 74431 - DNA, 734 bp, Zea mays
  misc_feature: Ceres CLONE 1558817
  misc_feature: Encodes the peptide sequence at SEQ ID NO. 74432
  misc_feature (222)..(222): n is a, c, t, g, unknown, or other
  misc_feature (265)..(265): n is a, c, t, g, unknown, or other
  misc_feature (315)..(315): n is a, c, t, g, unknown, or other
ctccccgcggtggcggccgctctagaactagtggatcccccgaggctgcaggaattcgtctcacccctagaaaaagccacacaagcaaagaacttggccccgcctcccgtctcttaccgcacatgcgcgtcgggccgcgtcgacatagctgcttgccgccgacacccgcagccgcaatggccgtcgcccactgcgccgccgcgccggggcgtgactcccccntcctggctcgtcgccgcgctcgtggcagcgttgccggccaccntgcgccggcggccaggagcaagaagtcgtacacggccatcttcagcttcngggactcgctctccgacgccggaacctcatcgtcaacggcacgccaaatgtgccttaccaacggggggccctcccttaagggaatgaactttttttccccaaagcccaccgggcccgcgtggttccaaaaggggccccccccgggggggaaaaattcccggggccaaaaaaaatttttggggggggggccccatgtgcgccgcccccccccgttttcaaggggccaaggggggaaaaggaactttctcaaaaaaagggggggccaaattttttgccctttcccccggggggggaaaaggcccccccgagaagaaacccccccttttcctaaaagggggggccgggggggttttttaaaacaacgggttttttttgtggaaaaaaaacggggtgttccttataataaaaaaaaaaaaaaa

SEQ ID NO: 74432 - protein, 204 aa, Zea mays
  misc_feature: Ceres CLONE 1558817
  misc_feature (34)..(34): Xaa is any aa, unknown, or other
  misc_feature (48)..(48): Xaa is any aa, unknown, or other
  misc_feature (65)..(65): Xaa is any aa, unknown, or other
MRVGPRRHSCLPPTPAAAMAVAHCAAAPGRDSPXLARRRARGSVAGHXAPAARSKKSYTAIFSFXDSLSDAGTSSSTARQMCLTNGGPSLKGMNFFSPKPTGPAWFQKGPPPGGKNSRGQKKFLGGGPHVRRPPPFSRGQGGKRNFLKKRGGQIFCPFPRGGKRPPREETPPFPKRGGRGGFLKQRVFFVEKKRGVPYNKKKKK

SEQ ID NO: 74433 - DNA, 700 bp, Zea mays
  misc_feature: Ceres CLONE 1558819
  misc_feature (212)..(212): n is a, c, t, g, unknown, or other
ctcacccgcggtggcggccgctctagaactagtggatcccccgaggctgcaggaattcgtctcacccctagaaaaaaagaaaaagaagatcaaggaggtttctcatgagtggtcattggtcaacaagcagaagcccatatggatgaggaagccagaagaaatcacaaaagaagaatatgctgccttctataagagcttgacaaatgactggngaggagcatctggctgtgaagcacttctctgtggagggtcaactggagttcaaggctgttctctttgttcctaagagggccccctttgatctctttgacaccaagatgaagcagaacaacatcaagctctatgtgcgcagggtgttcatcatcggacaacctgcgatgagctgatcccctgagtgggctgagcattcgttgaagggtatttgttgactgctgagggaacctttccccctcaaataatcttcctcggtggagaacctcttccaagcaggaaaacatgaattcccttgaaaagggggaatcccacggaaaaaaaaccctttgggtgaaaaaaaaatttggggttttaaaaccccctttctttttggagaaattggcttggaagaaaccaggggagggaaccttccaaacaaaggttttttaacaaaaggggtttttttccccccaggaaaaccccccaaaaaacttttgggaaaatcacc

SEQ ID NO: 74434 - DNA, 825 bp, Zea mays
  misc_feature: Ceres CLONE 1558820
  misc_feature: Encodes the peptide sequence at SEQ ID NO. 74435
  misc_feature (746)..(746): n is a, c, t, g, unknown, or other
  misc_feature (825)..(825): n is a, c, t, g, unknown, or other
agctccccgcggtggcggccgctctagaactagtggatcccccgggctgcaggaattcgtctcacccctagaaaatagaaaaagtccgtggagaagcgggagcaggtggcggcgatggaagagcaaggcggccaggcggcgctcgggtgggcggccagggacgactccggcgtcctctccccctacagcttctccagaagggttcctaaagacgacgatgtcacgatcaaggtgctctactgcgggatctgccacaccgacctgcacgtcatcaagaacgactggcgaaacgccatgtacccagtcgtcccggggcacgagatcgtgggcgtggtgaccggcgtcggcggcggcgtcacgcggttcaaggccggcgacacggtcggcgtgggctacttcgtggggtcctgccgctcctgcgacagctgcggcaagggggacgacaactactcgcgcggggatcgtgctcacctccaacggcgtcgaccacgcgcacggcggcgcgcccaccagggggggattctccgacgtcctggtcgcgagcgagcactacgtggtccgcgtccccgacggcctggcgctggaccgcaccgcgccgctgctctgcgccgggcgtcaccgtgtacagccccatgatgcgccacggcctcaacgagcccggcaagcacctccggcgtcgtcgggctcagcggcctcggcccacgtcgccgtcaagttcggcaaggcctttccggaatgaaagtcanccgtcatcagcacgtccgcccagcaagcgccaagaaggccatcgtagaacttcgggcgcgggacgagttcctcatcagn

SEQ ID NO: 74435 - protein, 173 aa, Zea mays
  misc_feature: Ceres CLONE 1558820
  misc_feature (33)..(165): Pfam Name: ADH_N Pfam Description: Alcohol dehydrogenase GroES-like domain
  misc_feature: SWISSPROT Homolog: EC 1.1.1.195 Cinnamyl-alcohol dehydrogenase
MEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFVGSCRSCDSCGKGDDNYSRGDRAHLQRRRPRARRRAHQGGILRRPGRERALRGPRPRRPGAGPHRAAALRRASPCTAP

SEQ ID NO: 74436 - DNA, 680 bp, Zea mays
  misc_feature: Ceres CLONE 1558821
  misc_feature: Encodes the peptide sequence at SEQ ID NO. 74437
  misc_feature (404)..(404): n is a, c, t, g, unknown, or other
  misc_feature (415)..(415): n is a, c, t, g, unknown, or other
ggagctcaccgcggtggcggccgctctagaatagtggatcccccgggctgcaggaattcgtctcacccctagaaaaaaccactaccactctcgattaccagccctctcgccttctccgctcctccgtcgtcgccgaaccccatggccccaaaaccctaaactgagcccgccgctgcttctccagtccgcacgaagcgccccacaaaatgccgcggctgacgccggcgcacgccaccctcatcctggaccacgtcgctggggcgaatccctcgatccccaccgcagtcaccatcgcgttaatcgctgggatcccctctccctacgatacgaccacgcgcctccgccgcggggtcctgctccgcgcctcgccaccgaccccgtatccgatcctctctcagatcccntcacgtctggnctcgcttccggactgcggctcccccatcgaagccgcccaatcggcgtaacaggattcctggagggcttcgggccaaaatttgaaaccactgcaagggttttttttgggggccccaagggccgggggggccaaaggggccacggggggaagttctcccccgggtccgcttcgaaaaaggcccttccccccacagtgaaaacattttaaagggcccccccccgggaaatttcccccctcccaaaaaaaccccccagggggggccggt

SEQ ID NO: 74437 - protein, 85 aa, Zea mays
  misc_feature: Ceres CLONE 1558821
  misc_feature (70)..(70): Xaa is any aa, unknown, or other
MPRLTPAHATLILDHVAGANPSIPTAVTIALIAGIPSPYDTTTRLRRGVLLRASPPTPYPILSQIPSRLXSLPDCGSPIEAAQSA

SEQ ID NO: 74438 - DNA, 824 bp, Zea mays
  misc_feature: Ceres CLONE 1558822
  misc_feature: Translation starting site: 245
  misc_feature: Pfam Name: DUF868 Pfam Description: Plant protein of unknown function (DUF868)
  misc_feature (759)..(759): n is a, c, t, g, unknown, or other
  misc_feature (798)..(798): n is a, c, t, g, unknown, or other
  misc_feature (799)..(799): n is a, c, t, g, unknown, or other
  misc_feature (804)..(804): n is a, c, t, g, unknown, or other
ctccccgcggtggcggccgctctagaatagtggatcccccgggctgcaggaattcgtctcacccctagaaaaaatcttcttcttcctccttcagtcacccggcctgtcgtgtcgatctcactctcagggtccggtccggtccggtgcatcatatatacccttggtcgatcgatcgaccagatagatacactagatagctaggattgcattgtgttccaccaaaagccagccacaacacatcgacatgatgcaggacttgttctcggtcccttcgtgtttctcggcgggcgagaagcttccggacgtcccggcgtccgctgcggccaccaccaggtccgggcagagcgcggcgacgctggtctaccgcgcgggaatcgccggccacgaccgcctggtgacggtgacgtggtgcaggaacctgctcacccacgggctgaccgtgtcgatcgaagggtcggcgggcggcggcaaggacaagagcggcggcggcagggagtggggcgacgccgacggtggcgcggcctcgtcctccaacaagggctgcagcaccgcctgcaaggtggagatgcagccgtggcacttttggcgcaagtacggcgccaagcagttccacgtcgacggcagggccgtgggacgtggtctgggacctcaggagcgcgaggtactccgacgagcccgagccgctgtccgactactacgtccgccgtggtgtcggaacgaggaggtggtccctcctcctcggcaacctcaagaaaggangcgttccgggcgcaccggggtcccccggccgtcgctgcnnggacncccgcactgggtgtgcaaaa

SEQ ID NO: 74439 - DNA, 792 bp, Zea mays
  misc_feature: Ceres CLONE 1558823
ctggagctccccgcggtggcggccgctctagaactagtggatcccccgggctgcaggaattcgtctcacccctagaaaaaatgtttttcaccccgtatgggcgcgtggcaacccgagctctcatgacacgtaatgtgacctgcacatattcaccatttcttgctcagaagactccctcctgctgtgtatctcatctcatcggcttataatgacacaattgcgaactgcccaacatgctcctgtggctgccacaacccaactgcgtcaaactgtgcgaatcacgattcaccatattctacgcgctgcaatcgatgatcctggcaaatggactggtcagccccttgtacaatgcacttcccacatgctgccctataataatccactggcatgtgagagctcaactacaacgattactgcagagtgaaaatcactatcacacaacttaatcttccgcatgaattacacgcagtgaagcttgctaccgcagcatccacactgtgataatatcactcagttgttcatcttcaactacaaaccacttactccatatggtggtcgcatacatgatactgcaatgccctgagtgtggagatatctacaatgatgtgctgatgcaagccggcaaacatgggaatgtgcagtcacatgtgcattctcgcaaggactgccggactttcactttcatacagggtacgggcctacccacgcccagtttacaacaatggatgataatttggtgcatgccagtctcatgcaaatatccgatggcatgcgaatgctagcgctctcata

SEQ ID NO: 74440 - DNA, 800 bp, Zea mays
  misc_feature: Ceres CLONE 1558824
  misc_feature: Encodes the peptide sequence at SEQ ID NO. 74441
ggagctcaccgcggtggcggccgctctagaactagtggatcccccgggctgcaggaattcgtctcacccctagaaaaaactccgcaagacgcaagaccacctcaccagcctcctcgtccccgatctcctcccacccgcatccaagggtttccttctcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgccaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagggtgaaggctatagccgaaatatttgctgacgctgggttttcagatgttacaaagaatttcttggctgtcctggcggacaatggcaggctgaaatatattgaacgcattgcggacagatttgttgatttgactatggaacataacggggacatggagagttgtggtcacgacagttatttcactcaccaaggacgacgagaaagaaactcaggaaaccttgccaggatatccttggggtaaacaaaactatcttggttgaaacagagattgactacagcatcatgggcaggataagg

SEQ ID NO: 74441 - protein, 185 aa, Zea mays
  misc_feature: Ceres CLONE 1558824
  misc_feature (56)..(186): Pfam Name: OSCP Pfam Description: ATP synthase delta (OSCP) subunit
  misc_feature: SWISSPROT Homolog: EC 3.6.3.14 H(+)-transporting two-sector ATPase
MAAARHLRSGLPLLRAHLASSESAAVAQVSRGFASQAAKPTGKEIKVPKALFGGTGNYASALFLTAAKSNALDKVESEIKAIVEASKKSPLFSQFIKDLSVPKATRVKAIAEIFADAGFSDVTKNFLAVLADNGRLKYIERIADRFVDLTMEHNGDMESCGHDSYFTHQGRRERNSGNLARISLG

SEQ ID NO: 74442 - DNA, 868 bp, Zea mays
  misc_feature: Ceres CLONE 1558825
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (426)..(426): n is a, c, t, g, unknown, or other
  misc_feature (513)..(513): n is a, c, t, g, unknown, or other
  misc_feature (805)..(805): n is a, c, t, g, unknown, or other
  misc_feature (807)..(807): n is a, c, t, g, unknown, or other
  misc_feature (808)..(808): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagcggggctcaccgcggggccgccgctctagaatagtggaaccccgggcctgcaggaattcgtctcaccccctagaaaaagcctcaccgaattcgtcggtcgtcacctgatattttttccgacggacacacaagcatatatacatacacgccgacatagggatgatggcttcctctagtcctcagcgtgcagccggcgcccccgtcgccggcgtgctgctggtggcggctgccgccctgtgctcgtgcggcgccatggcgcagctgaccgcggactactacgactgcacatgccctgacgcctacaacatcgtgaagcaggtccctgatcgnagcgcacaaagtccgacgtgcgcatctacggccagccctcaacccgccctccaactttccaccgaccggcctttccttccaaggggnctgccaaatgggcttccggggggcctcccctgggaccgccccgctttccccgggggggggttggggcccaaacctcccccacctggaaaaaaaaaacccctgggggccccccccggggcccccaacccaacccaaaccttcccgggccccccccaaagggggttttccccccccccgttggggtttggggaccaaaaaaaaattgtaaaaaaaagggggggggggccccccccccgtggaaaaaaaaaaaaaaaccccccccttggcgccccccccacgggggggggaggantnnttttttcccccccccccggggcccccccccacaaaaaaaaatttcccttctgggtgcccc

SEQ ID NO: 74443 - DNA, 790 bp, Zea mays
  misc_feature: Ceres CLONE 1558826
  misc_feature: Translation starting site: 145
tggagctcaccgcggtggcggccgctctagaactagtggatcccccgggctgcaggaattcgtctcacccctagaaaaaacagccatcacacgcatactgcatacacaacacagagcatcagaaggagctacgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggcgagttccccggcgactacgggtgggacaccgcggggctgtcggcggacccggagaccttcgccaagaaccgcgagctggaggtgatccactgccgctgggccatgctcggcgcgctcgggtgcgtgttcccggagctgctcgcccgcaacggcgtcaagttcggcgagggcggtgtggttcaaggcgggctcccagatcttcagcgagggcgggctggactacctcggcaacccgagcctggtccacgcgcagagcatcctggccatctgggcgtgccaggtggtgctcatgggcgccgtcaggggggaaccgcgtcgccggcggcccgcttcggagaagtggtcgacccgctgtaccttggcggcactccgacccgctcgggctcgcgaagaacccgaaggcgtcgccagctcaaggtgaggagatcaggaccgc

SEQ ID NO: 74444 - DNA, 816 bp, Zea mays
  misc_feature: Ceres CLONE 1558828
  misc_feature: Encodes the peptide sequence at SEQ ID NO. 74445
  misc_feature (711)..(711): n is a, c, t, g, unknown, or other
  misc_feature (799)..(799): n is a, c, t, g, unknown, or other
ctggagctccccgcggtggcggccgctctagaactagtggatcccccgggctgcaggaattcgtctcacccctagaaaaaaccagcaagaccaacctacccacttctgactgaccactgtgccgcgccgtgctcaccgaacggtcgaccacacagaacgactgatggccgcgtcggcgctgcaccagaccaccagcttcctcgggcaggccctggtcgcccgcgccgccggcgtcgatgccggcggccgcatcaccatgcgccgcaccgtcgagagcgtgtccccagagcatatggtgacggacctgaccgccccaagtaccttggcccgttctccgagcagacgccgtcttacctgaccggcgagttccccggcgactatgggtgcgacaccgcgggcctctcagccgacccggagaccttcgcgcgcaaacgggagctagatgtgatccactcccggtgggcgatgctgggggcgctgggctgcgtgttcccggatatcctggctaagaacggcgtcaagttcggcgaggcggtgtggttcaaggtcggcgcgcatatcttctcggagggcgggctggactacctggggaaccccaacctggtgcacgcgcagagcatcctggccatctgggcgtgccatgtggtgctcatgggcttagtcgaggggctaccgcgtcggcggcggtcgggatcggggaagagctcgacntagtgtacccgcggcgtcgccttcgatccggctgggcttagacgacgaaccgggatcacgcgcccaggctcaaggtggatgagctcangaaacgtcgcctttgcc

SEQ ID NO: 74445 - protein, 82 aa, Zea mays
  misc_feature: Ceres CLONE 1558828
MLGALGCVFPDILAKNGVKFGEAVWFKVGAHIFSEGGLDYLGNPNLVHAQSILAIWACHVVLMGLVEGLPRRRRSGSGKSST

SEQ ID NO: 74446 - DNA, 782 bp, Zea mays
  misc_feature: Ceres CLONE 1558829
  misc_feature: Encodes the peptide sequence at SEQ ID NO. 74447
  misc_feature (677)..(677): n is a, c, t, g, unknown, or other
ctggagctccccgcggtggcggccgctctagaactagtggatcccccgggctgcaggaattcgtctcacccctagaaaaattgtaactgtagatgatcagcaaactcagtgtatcattgatcatcaagctcttccccgcctcctgaatttattgacacagaaccacaagaaaagcattaagaaagaggcatgctggacgatttcaaatattactgctggaaacaaagatcagatacaggctgtcataagtgctggtattatcgctcctttgttgcaactgcttcaaggagcagagtttgatatcaagaaggaggctgcttgggccatctcaaacgctacctctggtggttcccatgagcaaatcaagtacttggtgtctgagggctgcatcgtgccgctgtgcgaccttcttgtttgccctgatccgagaattgtaacagtttgtctggagggtcttgagaatattcttaaagtaggggagcacgacaagaccatgggcgcaacaggtgacattaatgttttcgctcagatgattgacgacgcggaaggcctggaaaagatcgagaacctacagagccatgataataatgaaatctatgaaaaggctgtgaagcttcttgagacttactggatgggaggaggaagatgatgcaatggctactgctggggaagctgcntccgctgtttttgactttagcaaagtggcaaccctcctggtgggtggtttgacctgcactgaatacagtatttgaccaaaagggtgttaattccctcatgacaac

SEQ ID NO: 74447 - protein, 51 aa, Zea mays
  misc_feature: Ceres CLONE 1558829
MGATGDINVFAQMIDDAEGLEKIENLQSHDNNEIYEKAVKLLETYWMGGGR

SEQ ID NO: 74448 - DNA, 812 bp, Zea mays
  misc_feature: Ceres CLONE 1558830
  misc_feature: Translation starting site: 347
  misc_feature: SWISSPROT Homolog: EC 2.1.1.68 Caffeate O-methyltransferase
  misc_feature (773)..(773): n is a, c, t, g, unknown, or other
  misc_feature (774)..(774): n is a, c, t, g, unknown, or other
  misc_feature (777)..(777): n is a, c, t, g, unknown, or other
  misc_feature (778)..(778): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (787)..(787): n is a, c, t, g, unknown, or other
  misc_feature (788)..(788): n is a, c, t, g, unknown, or other
  misc_feature (790)..(790): n is a, c, t, g, unknown, or other
  misc_feature (794)..(794): n is a, c, t, g, unknown, or other
ctccccgcggtggcggccgctctagaactagtggatcccccgggctgcaggaattcgtctcacccctagaaaaagtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaagggaggccggcggcggcaaggcggcgctggcgcccgaggaggtggtggcgcggatgcccgcggcgcccagcgaccccgccgccgccgcggccatggtggaccgcatgctccgcctgctcgcctcctacgacgtcgtccggtgccagatggaggaccgggacggccggtacgagcgccgctactccgccgcgcccgtctgcaagtggctcacccccaacgaggacggcgtgtccatggccgccctcgcgctcatgaaccaggacaaggtcctcatggagagctggtactacctcaaggacgcggtgctggacggcggcatcccgttcaacaaggcgtacgggatgacggcgttcgagtaccacggcacggacgcgcgcttcaaccgcgtgttcaacgagggcatgaagaaccactcggtgatcatcaccaagaagctgctggacttctacacgggcttcgaggctgtcacctcgtggaaannagnngnnnnnncnncntttngccccccccgcctccccc

SEQ ID NO: 74449 - DNA, 779 bp, Zea mays
  misc_feature: Ceres CLONE 1558831
  misc_feature: Encodes the peptide sequence at SEQ ID NO. 74450
  misc_feature (691)..(691): n is a, c, t, g, unknown, or other
ctggagctccccgcggtggcggccgctctagaactagtggatcccccgggctgcaggaattcgtctcacccctagaaaaaacaccgctctaaattaccaacccatccatcctccagtcctcagtccagactccagagtcctcaccggcttctccccgactccccgtcaccgatggagctgttcgcgcgcgcgaaggtggtgcggctcaggagccaccacgacaagttcctgtacgcggacgaggacgaggtgcgcgtgacgcaggaccgggacgggtcctcggcgaacgcgcggtggaccgtcgaggcggcgccgcacagcgcgggcgccgtccgcctgcgcagccgctacgggcgctacctcaccgcctccggggagccgttcctgctggggatgacggggcggaaggtgacgcagacggcgcccgccgcgccgcgcccggccaacgcgtccgtggactgggagcccctgcgggacggcttccaggcgcgcctccgcaccaaggcgggccacttcctccgcgcctacggggggctcccgccctggaggaactccgtcacccacgacgtgccccaccgcaccgccacgcatgactgggtgctctgggacgtctaggtcgtgcagctcctcacgcccgcgccgccgcccgagcgcaccggctccgcgcccgtcgtcaagttgccggactcgncgcccgcgacggacctcggcaagccaccgcaggcgcacggggcgctacaccgcccatccaagtcctacgcgacgcccacgcccacggt

SEQ ID NO: 74450 - protein, 147 aa, Zea mays
  misc_feature: Ceres CLONE 1558831
  misc_feature (1)..(145): Pfam Name: DUF569 Pfam Description: Protein of unknown function (DUF569)
MELFARAKVVRLRSHHDKFLYADEDEVRVTQDRDGSSANARWTVEAAPHSAGAVRLRSRYGRYLTASGEPFLLGMTGRKVTQTAPAAPRPANASVDWEPLRDGFQARLRTKAGHFLRAYGGLPPWRNSVTHDVPHRTATHDWVLWDV

SEQ ID NO: 74451 - DNA, 820 bp, Zea mays
  misc_feature: Ceres CLONE 1558832
  misc_feature: SWISSPROT Homolog: EC 1.10.2.2 Ubiquinol--cytochrome-c reductase
  misc_feature (739)..(739): n is a, c, t, g, unknown, or other
ggagctccccgcggtggcggccgctctagaactagtggatcccccgggctgcaggaattcgtctcacccctagaaaaaatctacctccgtgcgtcgtgcgcctaggcgcgtaccctagccgagatcagatcggacgcgagcgccaccaccgaccggcatgaagatgacgacacgatgctgcgggttgcggggagaacgatctcgtcttccctctcctggcgcccctccgcggcggttgcctgcggccccctcgcctgcgctggcgtccccaaccgggactactactcggctcgcggacggaggccggcgcggttctcgcatcgactcccccttctttgtctcttccagcggtttctcttctactgaaacagctgtcccaacgaaccaagatgctggcctagctgacctcccatgctctgtggctgctgtgaagaatcctgacccataaggtggtttatgatgagtacaaccatgaaagatatcctcctggagatcccagcaagcgtgcctttgcatactttgtcctgagtgcgtgggacgttcatatatgcttcactgctgcgtcgtctcctactgaagtctgtcctgagcatgtcagccagcaatgatgtgcttgcccttgcttcacttgacgtggacctctccagtatctagccacgaaccacagtgaccgtgacattggcgtggaaagccagtctttatctggcgatccgaccgaggatgacatccagcttgccancctgtgtggatgtggcatctctgcgccacctaacacgagggaaacaggttgttagaaaaaaacccgtgaatgcctgggtgc

SEQ ID NO: 74452 - DNA, 823 bp, Zea mays
  misc_feature: Ceres CLONE 1558833
  misc_feature: Encodes the peptide sequence at SEQ ID NO. 74453
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (662)..(662): n is a, c, t, g, unknown, or other
  misc_feature (672)..(672): n is a, c, t, g, unknown, or other
  misc_feature (680)..(680): n is a, c, t, g, unknown, or other
  misc_feature (689)..(689): n is a, c, t, g, unknown, or other
ctggagctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccacctagagatggatccgcaccagagaccagggggttttttttnnnnnnnntntttttttttncccccccncctcttttntcctcttttcggtacccccggttttccgtggggtaacccttgccttgggggtgggggaccaagggcggactccgggaagaacctttttcagggggaaacaagggaacagggtgcctgggaaggcttaaagaggt

SEQ ID NO: 74453 - protein, 193 aa, Zea mays
  misc_feature: Ceres CLONE 1558833
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (170)..(170): Xaa is any aa, unknown, or other
  misc_feature (171)..(171): Xaa is any aa, unknown, or other
  misc_feature (172)..(172): Xaa is any aa, unknown, or other
  misc_feature (173)..(173): Xaa is any aa, unknown, or other
  misc_feature (177)..(177): Xaa is any aa, unknown, or other
  misc_feature (182)..(182): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEEAGAAVEQFNGYTFQGRPLRVNCGPPPPRDGSAPETRGFFXXXXFFFXPPPLXSSFRYPRFSVG

SEQ ID NO: 74454 - DNA, 767 bp, Zea mays
  misc_feature: Ceres CLONE 1558835
  misc_feature: Encodes the peptide sequence at SEQ ID NO. 74455
  misc_feature (534)..(534): n is a, c, t, g, unknown, or other
  misc_feature (543)..(543): n is a, c, t, g, unknown, or other
  misc_feature (552)..(552): n is a, c, t, g, unknown, or other
ctcaccgcggtggcggccgctctagaactagtggatcccccgggctgcaggaattcgtctcacccctagaaaaagacccaagcaagcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctactacgacggccgctactggaccatgtggaagctgcccatgttcggctgcaccgacgccacgcangtgtacaangagctgcangaggccatcgccgcgtacccggacgccttccaccgcgtcatcggcttcgacaacgtcaggcagacgcagtgcgtcagcttcatcgcctacaagccccccggcagcgagtagagaccgtggctagatcgacccatggccatgcctcttgcctgttgatcggatcaactttctggcattggttcctctctctctctcttccctcttttttttccctc

SEQ ID NO: 74455 - protein, 170 aa, Zea mays
  misc_feature: Ceres CLONE 1558835
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
  misc_feature (128)..(128): Xaa is any aa, unknown, or other
  misc_feature (131)..(131): Xaa is any aa, unknown, or other
  misc_feature (134)..(134): Xaa is any aa, unknown, or other
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCTDATXVYXELXEAIAAYPDAFHRVIGFDNVRQTQCVSFIAYKPPGSE

SEQ ID NO: 74456 - DNA, 743 bp, Zea mays
  misc_feature: Ceres CLONE 1558837
  misc_feature: Encodes the peptide sequence at SEQ ID NO. 74457
ctcaccgcggtggcggccgctctagaactagtggatcccccgggctgcaggaattcgtctcacccctagaaaaagacccaagcaagcaagctcgatctactactactactagctggtacacatactagccagcctgccagccagcttgccatggcgcccaccgtgatgatggcctcgtcggcaaccgccgtcaccccgttccagggtctcaagtcagccgccagcctccccgtcgcccgccgcagcagcaggagcctcggcaacgtcagcaacggcggaaggatccggtgcatgcacgtgtggccggcctaccgcaacaagaagttcgagacgctgtcgtacctgccgccgctgtcgacggacgacctgctgaagcatgtggactacctgctgcgcaacggctggataccctgcctcgagttcagcaagctcgagttcgagtaccgcgaggactccacatcccagtgctactacgacggccgctactgcaccatgtgaatgctgcccatgtttcgctgcacttacgcacccaagtggaccagtacctgcaagaggccatccccgcgatcccggaaggccttccatcgaaccacggggttcaacaagatcgggcggaccaatgggtttaagtttaatcgccaaaaagcacccccggaatgaaaataaagcccgggccaatatcggccccaaggccatggcccctgccggtgttgataggaatgaccttttttatcttttttttt

SEQ ID NO: 74457 - protein, 115 aa, Zea mays
  misc_feature: Ceres CLONE 1558837
  misc_feature (58)..(116): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVTPFQGLKSAASLPVARRSSRSLGNVSNGGRIRCMHVWPAYRNKKFETLSYLPPLSTDDLLKHVDYLLRNGWIPCLEFSKLEFEYREDSTSQCYYDGRYCTM

SEQ ID NO: 74458 - DNA, 681 bp, Zea mays
  misc_feature: Ceres CLONE 1558839
  misc_feature: Encodes the peptide sequence at SEQ ID NO. 74459
  misc_feature (555)..(555): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (592)..(592): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (609)..(609): n is a, c, t, g, unknown, or other
  misc_feature (630)..(630): n is a, c, t, g, unknown, or other
  misc_feature (646)..(646): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
ctggagctccccgcggtggcggccgctctagaactagtggatcccccgggctgcaggaattcgtctcacccctagaaaaaattattgggatctacaggactccattattggatgaccatggacaagtccgttaccataatcacgaaaagcatgtacaggttaccagatgtacatcgtggaaacgcaaatgtccgttatgcatggcttccttgctccaaaagcactgtgcatgaaatgatgctgaatagttctttacaagttcataagccgcccattaagtgtgcagcctatggagagggcacattccgtacaccaggcaatcgttctgatgactgtggggaaattcccggctgttggatgaaaattggcattgcccatatgatgttggtgcccgggttataaagggggaaaccttaaaaatggttccccctgggattttaacccccggcaaccctatgggggaacaatttttgaaagggggaaacaaaaggaccctttaaaaaccccccaaacttttaatttgtttgtggggggggaaaaaaaaaattttttttnttnnntnnnnnnnnnnnatannnaaagaaaagcccgnccccnnntccgcccccncccctacaacggggggtaggntacggtctggaggccncnnnncccccccccccgtccacagggtgatttttt

SEQ ID NO: 74459 - protein, 94 aa, Zea mays
  misc_feature: Ceres CLONE 1558839
MDKSVTIITKSMYRLPDVHRGNANVRYAWLPCSKSTVHEMMLNSSLQVHKPPIKCAAYGEGTFRTPGNRSDDCGEIPGCWMKIGIAHMMLVPGL

SEQ ID NO: 74460 - DNA, 775 bp, Zea mays
  misc_feature: Ceres CLONE 1558841
  misc_feature: Encodes the peptide sequence at SEQ ID NO. 74461
ctggagctccccgcggtggcggccgctctagaactagtggatcccccgggctgcaggaattcgtctcacccctagaaaaagcggtgtccaccactccctcctcctctcctctccagtcctatccatccggcacgcccagcatccatccactcctcccctgctccggatccggctccggctccgccatgggcctttcaacagtttactccccggccggaccgcgcctcgtgccggcccctctcggccgctgccgctctgcccagcctcgccgcccgcgccgagccccgactcgccaccgtccggtgctccgtcgacgccaccaagcaggcgcatgatggcgtggccacggcggtcgcgacagaagcgccggcgtcacagaaggagtgcttcggggtcttctacaccacctacgacctcaaagcggaggacaacaccaaatcctggaagaagctagtgaatattgctgtgtcaagcacggccgggatgatatcaaatcacctgctgttgaaactacactcaggtgaaggtttcggaacagaccaaccgataacacttaagctactcggctcacaaaagaacgtttcaagcctcccaaagggtagctatgggaactggaaggactccccggtgtccccggactgaaggaaaaccccaatggggttaaaacctaacctaacctttcaagaaaagtaaatggggcccctcctttttgggcccttacccccccaaggtcccggtttgggggcaaaaatccccccaccggaaaaataatggg

SEQ ID NO: 74461 - protein, 52 aa, Zea mays
  misc_feature: Ceres CLONE 1558841
  misc_feature: SWISSPROT Homolog: EC 1.1.1.82 Malate dehydrogenase (NADP(+))
MISNHLLLKLHSGEGFGTDQPITLKLLGSQKNVSSLPKGSYGNWKDSPVSPD

SEQ ID NO: 74462 - DNA, 786 bp, Zea mays
  misc_feature: Ceres CLONE 1558843
  misc_feature: Encodes the peptide sequence at SEQ ID NO. 74463
atagctggagctccccgcggtggcggccgctctagaactagtggatcccccgggctgcaggaattcgtctcacccctagaaaaatagacagacacacacacacactcaacagcaacagctaagcctctcccaccagacagcaacatggctgaggaggaggccaagaaggtggaggtggaggtcaccaaggagcccgaggcggcacccgcggccgccgcggaggcggcggcgaaggaggacgtcgccgacgacaaggccgtcatccccgcgaccgacccgccgccgccgccggccgacgactccaagggcctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaagaaagtatccgctattctttcatgggaaaacaccaagaaagcaaacatagaagctgaactgaagaagattgaggaacaactgcaaaagaagaacgctgaatatgcagagaagatgaagaacaaggttgcaatgatacacaaggaagccgtaaagaagcgagcgatggtggaggcaaaacgccagtgaggaggtcctgaagggcgatgagatggctgccaagtaccgggccacccgacacgctgctgagaagctcatcggttgcttcggagcctaaggaagccttcaagtcagaccgaa

SEQ ID NO: 74463 - protein, 176 aa, Zea mays
  misc_feature: Ceres CLONE 1558843
  misc_feature (91)..(177): Pfam Name: Remorin_C Pfam Description: Remorin, C-terminal region
  misc_feature (31)..(89): Pfam Name: Remorin_N Pfam Description: Remorin, N-terminal region
MAEEEAKKVEVEVTKEPEAAPAAAAEAAAKEDVADDKAVIPATDPPPPPADDSKGLAIVEKVADEPAPEKPAPAKQGGSNDRDLALARVETEKRNSLIKAWEENEKTKAENKAAKKVSAILSWENTKKANIEAELKKIEEQLQKKNAEYAEKMKNKVAMIHKEAVKKRAMVEAKRQ

SEQ ID NO: 74464 - DNA, 787 bp, Zea mays
  misc_feature: Ceres CLONE 1558845
  misc_feature: Encodes the peptide sequence at SEQ ID NO. 74465
  misc_feature (679)..(679): n is a, c, t, g, unknown, or other
ggagctccccgcggtggcggccgctctagaactagtggatcccccgggctgcaggaattcgtctcacccctagaaaaactcacccagtcctcgactagccgacgccgagaagcccctctatggcgaggcgaaggcgcgcagctatcctgcctcgcttccctccaaattcccaaagctctcgcgcgcggtgacatggcaggagcgcctcgccgcctccctcctccctgccgcctcgccgtccccgtccgccgccgcgcaacggtcgcagccgcagccgccgcctctttccactacccatgctccgcccgcgcggggctgcgcctacgctaccaccctcccctcttctcgcataacgctgccaggcgcgggtgtggcctgcgggtggtgcggtgcatggcagcgtcggacgcggcgcaactcaaggccgcgcgggaggacatcaaggaactccttaagagcacatactgccacccgcatcatggtccgtctggggtggcatgattcgggtacccatgacaaggatattaaggactggccacagcgaggtggagctaatggaagtttaaggttcgatgctgagctgactcatggaaccaatgccggcctgattaatgcattgtagcttatccagcctatcagagacatatacgcaggtatcacttatgcagatgtgctcaangtcagacaatactgctgccattgacgaagctgctggtccacatactaccatgcacatatggtacgtgtctgatgtcacagcagctgcacagtgtcacgcccgcagggg

SEQ ID NO: 74465 - protein, 47 aa, Zea mays
  misc_feature: Ceres CLONE 1558845
  misc_feature: SWISSPROT Homolog: EC 1.11.1.11 L-ascorbate peroxidase
MVRLGWHDSGTHDKDIKDWPQRGGANGSLRFDAELTHGTNAGLINAL

SEQ ID NO: 74466 - DNA, 796 bp, Zea mays
  misc_feature: Ceres CLONE 1558847
  misc_feature: Translation starting site: 229
ctcaccgcggtggcggccgctctagaactagtggatcccccgggctgcaggaattcgtctcacccctagaaaaaattcccctgctcgatccccggcgaggaattcgcccccgaatccatcgatttgctcagtccagtccgccgatccgtggatcgattcgtgcgtgggctctgtcctccccggggttccgatctggtcctcgcctcgccggaggaggagctggaggagatgaacggcaccgggggcagccaccaccagcagcagcacaggctccggcagcagcagcagcagcaggcgctcctgatgcagcaggcgctgcagcagcagcagcagcaacatcagtaccagtccggcgtcctcgccgccgcggcagccgcggccatgacccagatggaacctatttccaatggcaatcttccacctggctttgatccttccacttgtcgcagtgtgtatgttggaaacgtgaaccctaatgtcacggagagcctgttgattgcagctttccagagtgctggccttgtggaaagatgcgagctcatacggaaagagaatcatcctttgggatttgtgactactatgatagaaggtctgctgctctagcgatcttgacccttcagggcggtccaatatttggacatgcaatcaagggaacctgggcttaccccaagttcccaaaggggggaaacgggcggggattttcccaatttttggggggggagattaaagtccgaaaaagaaaaaaaaaaattctttttcccgttttccacggaaaacccttttgggcctaaaaaat

SEQ ID NO: 74467 - DNA, 792 bp, Zea mays
  misc_feature: Ceres CLONE 1558849
  misc_feature (356)..(356): n is a, c, t, g, unknown, or other
  misc_feature (359)..(359): n is a, c, t, g, unknown, or other
  misc_feature (362)..(362): n is a, c, t, g, unknown, or other
ctggagctccccgcggtggcggccgctctagaactagtggatcccccgggctgcaggaattcgtctcacccctagaaaaacccctagaaaaaacgatcacacaccactccacagcagtagcaagagggatagagcaaggccacacacacacacacaccactagtaggctagcctagccttttagtcgtcgaggaggagcaagaagggcgcgcacgcaagcaggcagcaagaaagagccgatcgaccgagagctagccgcgatggcgaggtcttcaagatgatggtggcggcagctctgctggccttggccctggccgtgtcgaccgccgaagcgaggaacatcagacacgacgacnganaangaagacgacgcgggttgtgcagccgcagaccttccccgcccctttcgaccgccttcgggggcgggggggtcccccgggcgtttcggggggcctcccccgggggggaaaattttcctgggaaaaaaagaatttccccgggttttaaaaattgcccgggggaagggggaaaaaaaccccttacccggggtgtttaattttgcccccgggggaaggggaaaatttcccctttttttttgggggggggggctccccccggggtttttagaggttttttgtggggagttttccccggggtttccccaccccgggggggttcctttcccccccaaaaacccccaaaaaaggcccgtgagaaaaccaaaaaaaaagggggggggaaaaaaagggggggggcccccccttttttcttgtaaaaaaaaccaccccccct

SEQ ID NO: 74468 - DNA, 789 bp, Zea mays
  misc_feature: Ceres CLONE 1558851
  misc_feature: Encodes the peptide sequence at SEQ ID NO. 74469
ctggagctccccgcggtggcggccgctctagaatagtggatcccccgggctgcaggaattcgtctcacccctagaaaaaaaaagcactcaacgatatcctccagtccttcgaaaaccctgaaaccttggtgaagccgagacgagcaatgcatccaagcagctagtgcttagcatctatggcgacctccgttcgtggtttcagtagcgccctcagggatgtgccgggcagctacggccttccgctggtgggcgccgtccgcgaccgcctcgacttctactacttccagggccaggacaagtacttcgagtcccgcgtcgagcgctacggctccaccgtggtgcgcatgaacgtcccgccgggccccttcatggcgcgcgacccgcgggtggtggcggtcctggacgccaagagcttccccgtcctcttcgacatggacaatgtggagaagagggacctgttcacgggcacctacatgccctccacctccctcaccggcggccaccgcgtctgcgcctacctcgacccctccgagcccacccacgccaaggtgaagcagctgctcttctccctcctgctctcccgcaaggacgacgtcatccgcagtcttccgctgcaacttctcctcgctgctcgccacagtcgagtcggacctcgcacgaggcggccaaggccgaagtcaacaagctcaacgacgtcacctccttcgactgcatcggcgagccctacttccggcgtggcgcccctcgggcgacgggacctcagcaaggggcgggccccaccaaggccgg

SEQ ID NO: 74469 - protein, 204 aa, Zea mays
  misc_feature: Ceres CLONE 1558851
  misc_feature: SWISSPROT Homolog: EC 4.2.1.92 Hydroperoxide dehydratase
MATSVRGFSSALRDVPGSYGLPLVGAVRDRLDFYYFQGQDKYFESRVERYGSTVVRMNVPPGPFMARDPRVVAVLDAKSFPVLFDMDNVEKRDLFTGTYMPSTSLTGGHRVCAYLDPSEPTHAKVKQLLFSLLLSRKDDVIRSLPLQLLLAARHSRVGPRTRRPRPKSTSSTTSPPSTASASPTSGVAPLGRRDLSKGRAPPRP

SEQ ID NO: 74470 - DNA, 800 bp, Zea mays
  misc_feature: Ceres CLONE 1558853
  misc_feature: Encodes the peptide sequence at SEQ ID NO. 74471
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (648)..(648): n is a, c, t, g, unknown, or other
  misc_feature (649)..(649): n is a, c, t, g, unknown, or other
  misc_feature (688)..(688): n is a, c, t, g, unknown, or other
  misc_feature (791)..(791): n is a, c, t, g, unknown, or other
ctggagctccccgcggtggcggccgctctagaactagtggatcccccgggctgcaggaattcgtctcacccctagaaaaatgttcaggagaccatcaagaaacaagtatcaagcatgtatttgtggccgaagacactaaaagtacctatcatggatccctctaaagcatcaaaaaggcctgttggaattctacttgtgaaggttgtgagagcccaaaatctgcggaagaaggatctgctgggtaaatctgacccatacctgaaacctaagatgtcagatgataaacttccatccaagaagacaactgtaaagcgcagcaatctccatccagagtggggtgaagacttcaagtttgttgtgacagatccataaaaccacgctcttgaagtgaatgtcttcgactgggaacaggttgggaaacatgaaaacatgggaatgaacatgatcccacttagagaactcctaccagaggggactaaagttactaccctcaacttggcttaggaacatggtaccccaacgatgtacaaaatgtagaagtctcgtgggtgagccttactctagagctcacatatcagccctttcaaggaaaagataaaatcnnnnnnnnnnnnnnnnnnncacacggtggctgatcgtgataaaaanntagctgcagatggcactcccagctggtggtggcctggcntttatggtggtctctgaaaccccatgaccctgcatgggaagccccctaccaacccatatgcgaaaataattttcaaaggccgaggaagagaaaaaactaagtncatcaggaa

SEQ ID NO: 74471 - protein, 85 aa, Zea mays
  misc_feature: Ceres CLONE 1558853
  misc_feature (26)..(84): Pfam Name: C2 Pfam Description: C2 domain
  misc_feature: SWISSPROT Homolog: EC 2.7.11.13 Protein kinase C
MYLWPKTLKVPIMDPSKASKRPVGILLVKVVRAQNLRKKDLLGKSDPYLKPKMSDDKLPSKKTTVKRSNLHPEWGEDFKFVVTDP

SEQ ID NO: 74472 - DNA, 808 bp, Zea mays
  misc_feature: Ceres CLONE 1558854
  misc_feature: Encodes the peptide sequence at SEQ ID NO. 74473
  misc_feature (506)..(506): n is a, c, t, g, unknown, or other
  misc_feature (536)..(536): n is a, c, t, g, unknown, or other
  misc_feature (711)..(711): n is a, c, t, g, unknown, or other
ctccccgcggtggcggccgctctagaactagtggatcccccgggctgcaggaattcgtctcacccctagaaaaaatcaggaagaaccttgtgaagaagtgtgttgagctcttctttgagattgctgagaacaaggaggactacaacaagttttacgaggctttctccaagaacctcaagcttggcatccatgaggactcgcagaacaggaccaagatcgccgagcttctgagataccactccaccaagagtggtgatgagctgaccagcctcaaggactacgtgaccaggatgaaggagggacagaatgacatctactatatcactggtgagagcaagaaggcagtggagaactcccccttccttgagaagctgaagaagaggggctatgaggttctgtacatggttgatgccattgacgagtatgctgttggtcagctcaaggagtttgagggcaagaagcttgtctctgccaccaaggagggtctgaagcttgatgagactgangacgagaagaagaggaaggaggagctgaangagaagtttgaggggctgtgcaaggtcatcaaggaggttctgggtgacaagttgagaaagggtgtgggtgtctgatcggcgtgtggtactcaccgtgctgccttgtgacctgccaagtatggcttggaccgcaaccttggagaggatcatgaaagcccaagccctgagggactcnagcatgggcgggctacttgtcgagcaaaagaaaaagggagatcaccccgaagacccctatcagggagagcctccccaagcgtgcccaggctgaaaaa

SEQ ID NO: 74473 - protein, 202 aa, Zea mays
  misc_feature: Ceres CLONE 1558854
  misc_feature (1)..(203): Pfam Name: HSP90 Pfam Description: Hsp90 protein
  misc_feature (168)..(168): Xaa is any aa, unknown, or other
  misc_feature (178)..(178): Xaa is any aa, unknown, or other
PRGGGRSRTSGSPGLQEFVSPLEKIRKNLVKKCVELFFEIAENKEDYNKFYEAFSKNLKLGIHEDSQNRTKIAELLRYHSTKSGDELTSLKDYVTRMKEGQNDIYYITGESKKAVENSPFLEKLKKRGYEVLYMVDAIDEYAVGQLKEFEGKKLVSATKEGLKLDETXDEKKRKEELXEKFEGLCKVIKEVLGDKLRKGVGV

SEQ ID NO: 74474 - DNA, 674 bp, Zea mays
  misc_feature: Ceres CLONE 1558855
  misc_feature: Encodes the peptide sequence at SEQ ID NO. 74475
  misc_feature (622)..(622): n is a, c, t, g, unknown, or other
ctggagctcaccgcggtggcggccgctctagaactagtggatcccccgggctgcaggaattcgtctcacccctagaaaaatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgacttcctctttcggcgagaagccgggtcaccgtcttttggcatcagggaaaccccggaggaaaatccccctggggggggaaagcctggggggcccaaattttttcccggggaggcccccccggggggttttttccggggaaaaaaaaaaaaagggggtttcggggccttttggaaagagggggggggggccacaaaaagggggggtttttattcccggtccccccccgaggaaaaaaaaaaggcccccccccccttttttttttntgtggggggggggggccccccccccgggggggagagagaaacaccccccccc

SEQ ID NO: 74475 - protein, 173 aa, Zea mays
  misc_feature: Ceres CLONE 1558855
  misc_feature (4)..(122): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (157)..(157): Xaa is any aa, unknown, or other
MGKIKIGINGFGRIGRLVARVALQSEDVELVAVNDPFITTDYMTYMFKYDTVHGQWKHSDITLKDSKTTSSFGEKPGHRLLASGKPRRKIPLGGESLGGPNFFPGRPPRGVFSGEKKKKGVSGPFGKRGGGPQKGGVFIPGPPPRKKKRPPPPFFFXWGGGAPPPGGREKHPP

SEQ ID NO: 74476 - DNA, 811 bp, Zea mays
  misc_feature: Ceres CLONE 1558856
  misc_feature: Encodes the peptide sequence at SEQ ID NO. 74477
tcaccgcggtggcggccgctctagaactagtggatcccccgggctgcaggaattcgtctcacccctagaaaaaacccatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcgtaggtgccggagtacctcaccggagaggtccctggagactatggctacgacccttttggcctgggcaagaagccagaggacttcgcctagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacaccctcaactacttcggcaacagcatccccatcaacctggtggtggccgtgatcgcggaggtcatcctcgtcagcggcgccgagtactaccggatgcacaacggactgtacctagaggacagctgcaccccgggtggacccttcgacccccctgggactggccagcgaccccgaccagggcgccatcctcatgttgaa

SEQ ID NO: 74477 - protein, 82 aa, Zea mays
  misc_feature: Ceres CLONE 1558856
MAALAPSKILGTQLNFAGSSRYATAAPTAGAQKIVSLFSKKPAQKPKPAAVSSSSPDISDELAKWYGPDRRIYLPDGLLDRS

SEQ ID NO: 74478 - DNA, 823 bp, Zea mays
  misc_feature: Ceres CLONE 1558863
  misc_feature: Encodes the peptide sequence at SEQ ID NO. 74479
ctctccgcggtggcggccgctctagaactagtggatcccccgggctgcaggaattcgtctcacccctagaaaaaaagatccgcgctttgatccgtccgccgccgcccgagaccatgccggccacggacctccagggctcctccccgttctcctccttcggccgcaccctcctctccctccgccgcgacgccccggcgtccgcgtccgcggcggctgcgatgccgccgcccggcgtcgacccggagctcgaggagttccacgcccacgtcgccgcgcacctcgcggacctgagcggccccggcgctgctggggaggaggagttcatgtccatcgcgtggatccggcgcctgctggaggcgttcctgctctgccaggaggagttccgggtggcggtggccgaggcgcgccgccgccgcgccggggccactccccccgccgccgagaggctggtggccgagttcggcgaccgcgccgtcaaggccctcgacgtctgcaacgcgggcgcgcgacggcgtcgaaccaggcgcgcccgctgggagcgcctcgcgggcatcgcgggcgtccgcgctgctggcgccccgccgaccggccagattccaggagggccagcttccctcccgcggcggaaggcgctctcgggacctcctcggggcccctcattcgagaaaacccccaaccgcccccgccacgggggccccccgggggggcctgccccgaatccctcggggtccccggggaaaccggttccttttggccccggcctgggggttttcccttcccccggccctccccccaccaaggggggggggcccccgtgggcccc

SEQ ID NO: 74479 - protein, 236 aa, Zea mays
  misc_feature: Ceres CLONE 1558863
  misc_feature (1)..(232): Pfam Name: DUF793 Pfam Description: Protein of unknown function (DUF793)
MPATDLQGSSPFSSFGRTLLSLRRDAPASASAAAAMPPPGVDPELEEFHAHVAAHLADLSGPGAAGEEEFMSIAWIRRLLEAFLLCQEEFRVAVAEARRRRAGATPPAAERLVAEFGDRAVKALDVCNAGARRRRTRRARWERLAGIAGVRAAGAPPTGQIPGGPASLPRRKALSGPPRGPSFEKTPNRPRHGGPPGGPAPNPSGSPGKPVPFGPGLGVFPSPGPPPTKGGGPPWA

SEQ ID NO: 74480 - DNA, 756 bp, Zea mays
  misc_feature: Ceres CLONE 1558864
  misc_feature: Translation starting site: 148
  misc_feature (680)..(680): n is a, c, t, g, unknown, or other
ggagctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaagccgtgtggttcaaggccggctcccagatcttcagcgaagggtggactggactacctcggggacccgagccctcatcacgcgcagagcatcctcgccatctgggcctgccaggtcgtgctcatgggccgcgtctaaggctaacggatcnccgggcgcccgttcgggcgaggtcgtcctacccgcttaaatccggacggagatttaaaccggttcggcttcgcgaa

SEQ ID NO: 74481 - DNA, 772 bp, Zea mays
  misc_feature: Ceres CLONE 1558865
  misc_feature: Translation starting site: 423
  misc_feature: SWISSPROT Homolog: EC 3.4.22.16 Cathepsin H
ctggagctcaccgcggtggcggccgctctagaactagtggatcccccgggctgcaggaattcgtctcacccctagaaaaaagatccgcgctttgatccgtccgccgccgcccgaaaaaacggcccccgcgacgcgcttcggttcgcacgcttcgccgtcaggtacggcaagagctactatagcgcggcggaggtccataagcggttcaggatcttctcggagagcctccagctggtccgctccaccaaccagcaaaggcctctcctaccgcctcggcatcaaccgcttcgggaacatgagctgggaggagttccgtgcgacccggctcggcgcaccccagaactgctccgccacgcttaccgggaaccaccggatgcgcgccaccacctttgcgctgccggagacgaaagactgcagggaggatggggattgtaatcccactgaaaaaccagggccactgtggatcatgctggaccttcagcactacgggtgcacttgatgctgcatatacccagacaactggcaagcccatctctctctctaaccaacagcttgttgactggtggttttgcattcaacaatttcggatgcaacgggatgccttcaatccccaggcctttggaatactcaaaatacaatggtgggctttgacactgaggtatcctaccccttaccaagctgtcaatgggaatctgcaaagtttaaaaatggaaaatgttgggacctcaaggttttgggactcggttaacatcacccgggggggcgtggagaa

SEQ ID NO: 74482 - DNA, 754 bp, Zea mays
  misc_feature: Ceres CLONE 1558868
  misc_feature: Encodes the peptide sequence at SEQ ID NO. 74483
tggagctccccgcggtggcggccgctctagaactagtggatcccccgggctgcaggaattcgtctcacccctagaaaaactccccatctcgctcttgcggagatcgaagagaagctgaggcctagcgccgcacccgccgccgcatcagccatcagccatggcgatggccgctcgcctcgtctcgcgctcccgtcagctacattcggttcaagcagcttttgcgaatggaggtgccactcaagttcgctcctttgccaaggatgcagctccagctgaccgtcctcctgttggtgggggatgatctcctgaagggcatattctttgaggtaaagaagaagtttgagacagctctcggcgtccttaaaaaggaaaagatcattattgatccagatgacccagcggcagtttctcaatatgctcaagtcatgaagactgtaagggaaaaggcggatcttctttctgattctcaaaggattaaatataccattgagaccttcaccaagggcatccctgatgcacggacttacttggatactcttcaacagctcggaataaagagtggtcttatagatcatattggaatcgacccctttgatgatggagctcctgagaaagatgaaacggatattaagaaacaccctttttaggagtgacagaaaaaactacggcaccctttatggcagagtttgacaagatttacgcaaagctggcatcccgggaagggagattcctcctaaatccgagaaagacttgg

SEQ ID NO: 74483 - protein, 140 aa, Zea mays
  misc_feature: Ceres CLONE 1558868
MEVPLKFAPLPRMQLQLTVLLLVGDDLLKGIFFEVKKKFETALGVLKKEKIIIDPDDPAAVSQYAQVMKTVREKADLLSDSQRIKYTIETFTKGIPDARTYLDTLQQLGIKSGLIDHIGIDPFDDGAPEKDETDIKKHPF

SEQ ID NO: 74484 - DNA, 809 bp, Zea mays
  misc_feature: Ceres CLONE 1558869
ctccccgcggtggcggccgctctagaactagtggatcccccgggctgcaggaattcgtctcacccctagaaaaaaagccaggccactctaccaccgcacgctcaactcaaacccccgtcccgaacgcagaagaccggcggcagcggcggggtgtgtgtggactggactgaaaccaattgccatcaatccaggcatccatccatccacccgcacccgccccgctgacggcggcaatggcccggctcgtgctctccgagtgctgcggcctcgcgccgctcacgccgcctgcgcgccggccggggcgccattgcggcgccatcaccccccgcgctctccgcggcgccgcgccgtcgtcccgcgtccgcgtccatccacagcgactgggcgctccgcatctcctggcccactcgcctcgcctccaccgccgtcgaggaggacaagacgaccgccgcgccgggacaggaggagggcgcggcggcccgcagggagttcgacccgggggcgccgccgccgtggaggctggcacatatcggcgccgacatacccaagcactgctgggtcaaggacacgtggcgctgcatgagctacgtgctgcgctgacttgccgtcgtcctgcgtcgtaccgcagctgacgcgcgcctggacagatgggtcgtgtgggcactctactgtgccgcgcatgggaccatgttgggggcgctcttcctactccggcacgactgtgggagacgggagcttctcgaatcacgcacatcttaaacagagtcgccaggacgccttactcgaatcctcgatgcggaagactatcc

SEQ ID NO: 74485 - DNA, 806 bp, Zea mays
  misc_feature: Ceres CLONE 1558870
  misc_feature: Encodes the peptide sequence at SEQ ID NO. 74486
  misc_feature (690)..(690): n is a, c, t, g, unknown, or other
  misc_feature (691)..(691): n is a, c, t, g, unknown, or other
ctggagctcaccgcggtggcggccgctctagaatagtggatcccccgggctgcaggaattcgtctcacccctagaaaaagagccaggcagccagccccggagccctggacagcagcagtgaactcgaggccgcttcgccacctcgccactcgcctcttctcgctctcgccaccgggccagggaagggaccatccgatcggctccgtcatggctggagctgctgctctcaatgagggtatcctttcttccgtgtccgagaaaaatgttgctgctcatccatggcatgatttggagataggaccagaggctcctgaagtgttcaattgtgtggttgagattcctagaggcagcaaggttaagtatgagttggacaagatatctggtctgatcaaggtggatcgtgtcctttactcctctgttgtttacccacataactatggtttcattccacgcacgctctgtgaggatagcgaccccatggacgtcctcgtactgatgcaggaacaagttgtccctgggtgtttcctgcgagctcgtgctattgggctcatgcctatgatcgatcagggtgagaaagatgataagatcatagctgtctgtgctgatgaccctgaattccgtcactacaaggacatctcgggactccccccgcatcgccttcaagagatcccgccgcttttttgaagattnntaaaagaatgaaaaccaaagagttgcagtggaagattttcctcccagcccgaagaatgcatcaaagcaatcgagcactccaatgggactggtaatgcctcgtacgtcatggaaag

SEQ ID NO: 74486 - protein, 158 aa, Zea mays
  misc_feature: Ceres CLONE 1558870
  misc_feature (39)..(153): Pfam Name: Pyrophosphatase Pfam Description: Inorganic pyrophosphatase
  misc_feature: SWISSPROT Homolog: EC 3.6.1.1 Inorganic diphosphatase
MAGAAALNEGILSSVSEKNVAAHPWHDLEIGPEAPEVFNCVVEIPRGSKVKYELDKISGLIKVDRVLYSSVVYPHNYGFIPRTLCEDSDPMDVLVLMQEQVVPGCFLRARAIGLMPMIDQGEKDDKIIAVCADDPEFRHYKDISGLPPHRLQEIPPLF

SEQ ID NO: 74487 - DNA, 809 bp, Zea mays
  misc_feature: Ceres CLONE 1558873
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (311)..(311): n is a, c, t, g, unknown, or other
  misc_feature (448)..(448): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaagctgggactcacccggtggcggccgctctagaactagtggatcccccgggctgcaggaattcgtctcacccctagaaaaaagtcgtcgccagtttcgttccgctgcagcagcggcagacgctcccctcctcgacgccgtcggcttctcctcatcctcgcccgctccngtccgctgactggaagtggtctaccacagaaggttaccatattgtctaaagttttaaaaagttgggatcattggaacaatgccgccacataagattgagactgggcataagatgtggtccatgatatgccatggatnactacgggaagcgcctagctacagcctcctctggatacacaattaagatccttgggcgttaagtggaaacctcaacccagcaggttgggaaaaccttgaattggaaacccaaggggccccattttgggaaaattcccctggggcccccccccccaaagtttgggggtccccggggctgtggaaatccccggcgaaattttaaaaaaagggccggggggtaaatattcttctggaaaggggaaaggggaaaaaccaccccccctttaaaaaaaaatggggggcccctttttacccccccccccccttttttgtggtggaaaaaaaaaaaaaaaacccccccccccgcgggggaaaaaacccc

SEQ ID NO: 74488 - DNA, 853 bp, Zea mays
  misc_feature: Ceres CLONE 1558874
  misc_feature: SWISSPROT Homolog: EC 2.4.1.12 Cellulose synthase (UDP-forming)
  misc_feature (626)..(626): n is a, c, t, g, unknown, or other
  misc_feature (822)..(822): n is a, c, t, g, unknown, or other
ctggagctccccgcggtggcggccgctctagaatagtggatcccccgggctgcaggaattcgtctcacccctagaaaaagaagaaaagattatttttcaagaaagcagaaaacccgtctcctgcatatgctttgggtgaaattgatgaaggtgctccaggtgctgatatcgagaaggccggaatcgtaaatcaacagaaactagagaagaagtttgggcagtcttctgtttttgtcgcatcaacacttcttgagaacggagggaccctgaagagcgcaagtccagcttctcttctgaaggaagctatacatgttatcagctgcggctacgaagacaagaccgactggggaaaagagattggctggatttacggatcgatcacagaggatatcttgactggatttaagatgcactgccatggctggcggtctatttactgcatcccgaagcggcctgcattcaaaggttctgcgcctctgaacctttccgaccgtcttcaccaggtccttcgctgggcccttgggtctgtcgaaattttcttcagcaagcactgcccactttggtacggatacggcggcgggctaaaaattcctggaaaggttttcttatattaactccatcgtttnatccctggacgtccattcctctcctggcttactgtaccttgcctgccatctgcctggtccacggggaagtttatcacaccagagcttaccaatgtcgccagtatctggttcatggcacttttcatctgcatctccgttgacggcatcctggaaaattaagggtggagtggcgtggccattcgacgactggtggaangaacgagcagttctgggttcatcggaagcgt

SEQ ID NO: 74489 - DNA, 828 bp, Zea mays
  misc_feature: Ceres CLONE 1558876
  misc_feature: Encodes the peptide sequence at SEQ ID NO. 74490
  misc_feature (770)..(770): n is a, c, t, g, unknown, or other
tggagctccccgcggtggcggccgctctagaatagtggatcccccgggctgcaggaattcgtctcacccctagaaaaaactctcttcttctccactcggccgggcactctccttgccccggcctcacaccatcacatgtccacaatgctgccgtcctccagatcgagatctgggccgaacgagtcccccgtcagcaggggcaggccgagcacgccatcctccaaccaccgcccctccacgccgtcctccaaccaccgcccctccaccccgggcggcaccaggaggagcagcgtcggcacgccatccacgccgcgctcccgcagcaacggcgcgggccccttcaagtccgagcccaactcgccgccgtcggccgccgcgcagaagccccgcctctcgttcgaccgctccccgagatccggggacaccaagcccgtcgtcgagcgccgggtgcccaagatcggcacgactcctgaaaagcatctccggagggaggccgaactgcaggcgcggcttgagtccgcccaggaggacctgaagaaggcgaaggatcaactggcattcatcctcggagagagggaccgtcttgtcggggagctcaacgaggccaagagagtcgctgatgagactcacgagaagctccaggatgccctcatggccaagatgtgggccgaagatgccactgagatcgagaagttccgggcggatgagctcgagcaggcaggcatcgacgaagcgcaaaggcggaaggacaagtggcagaaggaatatgnagtgtgtgcgtggccagcatgccgctgacttggagagtctggtcaacccacgggagga

SEQ ID NO: 74490 - protein, 220 aa, Zea mays
  misc_feature: Ceres CLONE 1558876
  misc_feature: SWISSPROT Homolog: EC 3.2.1.18 Exo-alpha-sialidase
  misc_feature (212)..(212): Xaa is any aa, unknown, or other
MSTMLPSSRSRSGPNESPVSRGRPSTPSSNHRPSTPSSNHRPSTPGGTRRSSVGTPSTPRSRSNGAGPFKSEPNSPPSAAAQKPRLSFDRSPRSGDTKPVVERRVPKIGTTPEKHLRREAELQARLESAQEDLKKAKDQLAFILGERDRLVGELNEAKRVADETHEKLQDALMAKMWAEDATEIEKFRADELEQAGIDEAQRRKDKWQKEYXVCAWPACR

SEQ ID NO: 74491 - DNA, 825 bp, Zea mays
  misc_feature: Ceres CLONE 1558877
  misc_feature: Encodes the peptide sequence at SEQ ID NO. 74492
  misc_feature (752)..(752): n is a, c, t, g, unknown, or other
ggagctccccgcggtggcggccgctctagaactagtggatcccccgggctgcaggaattcgtctcacccctagaaaaatttccggcctccgcttcccatcccgatcagcctgccgcagtgccgctccttccctccctctacccgtcgccgctgctgccatggacgaagtcgtcagccagattttggagaagcaagtgctgtctgccgcgaaggcggtggaggacaagctcgatgaggagatcgccgcgctcgaccgcctcgatccggacgacatcgaggcgctccgcgagcgccggatccagcagatgcgccgcgccgccgagcgccgcgccaagtggcgtgcgctggggcacggggagtacaccgaggtccccgagaaggagttcttctccatcgccaaggccagcgagcggctcgtctgccacttctaccgcgacaactggccctgcaaggtcgtggacaagcacctgtcggctctggcaaaacagcacgtggagacacggttcgtgaaggtccacgccgagaaggcccccttcctgacagagaagctcaggatagtcgtcctcccgaccctcgccatagttaagaacgccaaggtcgagggactacgtggtcggcttcgacgagctcggcggcaaggacgacttcagcaccgaggaacctggaagagcgcctggcgaggtccccaggtcgtcttcctggacgggcgaaggggtccgcgcacgcgtcgtagcaggccgctgccgccaccnaaacggaagcgtccgggcagtcgggcaccgggcggactcgtcccgattccgagattagctctccctgtggtta

SEQ ID NO: 74492 - protein, 222 aa, Zea mays
  misc_feature: Ceres CLONE 1558877
MDEVVSQILEKQVLSAAKAVEDKLDEEIAALDRLDPDDIEALRERRIQQMRRAAERRAKWRALGHGEYTEVPEKEFFSIAKASERLVCHFYRDNWPCKVVDKHLSALAKQHVETRFVKVHAEKAPFLTEKLRIVVLPTLAIVKNAKVEGLRGRLRRARRQGRLQHRGTWKSAWRGPQVVFLDGRRGPRTRRSRPLPPPKRKRPGSRAPGGLVPIPRLALPVV

SEQ ID NO: 74493 - DNA, 781 bp, Zea mays
  misc_feature: Ceres CLONE 1558879
  misc_feature: SWISSPROT Homolog: EC 4.2.1.33 3-isopropylmalate dehydratase
  misc_feature (276)..(276): n is a, c, t, g, unknown, or other
  misc_feature (277)..(277): n is a, c, t, g, unknown, or other
  misc_feature (281)..(281): n is a, c, t, g, unknown, or other
  misc_feature (292)..(292): n is a, c, t, g, unknown, or other
  misc_feature (293)..(293): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (326)..(326): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (334)..(334): n is a, c, t, g, unknown, or other
  misc_feature (335)..(335): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (344)..(344): n is a, c, t, g, unknown, or other
  misc_feature (345)..(345): n is a, c, t, g, unknown, or other
  misc_feature (349)..(349): n is a, c, t, g, unknown, or other
  misc_feature (350)..(350): n is a, c, t, g, unknown, or other
  misc_feature (354)..(354): n is a, c, t, g, unknown, or other
  misc_feature (359)..(359): n is a, c, t, g, unknown, or other
  misc_feature (360)..(360): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (369)..(369): n is a, c, t, g, unknown, or other
  misc_feature (381)..(381): n is a, c, t, g, unknown, or other
  misc_feature (386)..(386): n is a, c, t, g, unknown, or other
  misc_feature (387)..(387): n is a, c, t, g, unknown, or other
  misc_feature (392)..(392): n is a, c, t, g, unknown, or other
  misc_feature (393)..(393): n is a, c, t, g, unknown, or other
  misc_feature (398)..(398): n is a, c, t, g, unknown, or other
  misc_feature (404)..(404): n is a, c, t, g, unknown, or other
  misc_feature (409)..(409): n is a, c, t, g, unknown, or other
  misc_feature (410)..(410): n is a, c, t, g, unknown, or other
  misc_feature (417)..(417): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (430)..(430): n is a, c, t, g, unknown, or other
  misc_feature (431)..(431): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (456)..(456): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (473)..(473): n is a, c, t, g, unknown, or other
  misc_feature (474)..(474): n is a, c, t, g, unknown, or other
  misc_feature (476)..(476): n is a, c, t, g, unknown, or other
  misc_feature (483)..(483): n is a, c, t, g, unknown, or other
  misc_feature (485)..(485): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (502)..(502): n is a, c, t, g, unknown, or other
  misc_feature (508)..(508): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (542)..(542): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (558)..(558): n is a, c, t, g, unknown, or other
  misc_feature (560)..(560): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (585)..(585): n is a, c, t, g, unknown, or other
  misc_feature (586)..(586): n is a, c, t, g, unknown, or other
  misc_feature (598)..(598): n is a, c, t, g, unknown, or other
  misc_feature (599)..(599): n is a, c, t, g, unknown, or other
  misc_feature (604)..(604): n is a, c, t, g, unknown, or other
  misc_feature (605)..(605): n is a, c, t, g, unknown, or other
  misc_feature (607)..(607): n is a, c, t, g, unknown, or other
  misc_feature (608)..(608): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (618)..(618): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (629)..(629): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (643)..(643): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (656)..(656): n is a, c, t, g, unknown, or other
  misc_feature (665)..(665): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (679)..(679): n is a, c, t, g, unknown, or other
  misc_feature (680)..(680): n is a, c, t, g, unknown, or other
  misc_feature (682)..(682): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (691)..(691): n is a, c, t, g, unknown, or other
  misc_feature (696)..(696): n is a, c, t, g, unknown, or other
  misc_feature (698)..(698): n is a, c, t, g, unknown, or other
  misc_feature (699)..(699): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (725)..(725): n is a, c, t, g, unknown, or other
  misc_feature (732)..(732): n is a, c, t, g, unknown, or other
  misc_feature (735)..(735): n is a, c, t, g, unknown, or other
  misc_feature (737)..(737): n is a, c, t, g, unknown, or other
  misc_feature (738)..(738): n is a, c, t, g, unknown, or other
  misc_feature (743)..(743): n is a, c, t, g, unknown, or other
  misc_feature (746)..(746): n is a, c, t, g, unknown, or other
  misc_feature (748)..(748): n is a, c, t, g, unknown, or other
  misc_feature (754)..(754): n is a, c, t, g, unknown, or other
  misc_feature (764)..(764): n is a, c, t, g, unknown, or other
  misc_feature (774)..(774): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
tggagctcaccgcggtggcggccgctctagaactagtggatcccccgggctgcaggaattcgtctcacccctagaaaaaagtttgttggatcaactgtagaaagtctaaccatggaagagcgtatgacactgtgcaacatggttattgaagctggtggaaagaacggtgttgtgcctgctgatgaaacctagaaaaaaaggaccaacgtgctcgatctccatctcgaccgtcgcgtgctacgcgggtatagctacgctacgtacgaatgcatgggnnccgngtccccccccnngnnnnnttnnnnnnnnnnnnnnnnnnnnnnncncnnnnccnnccnnncccnncccnncccnccccnnccnnncccncccccccccccnccccnnccccnnccccncccccnccccnnccccccncccccnnnccccnncccnnnnnccnnnnnnnccnnnncnccnnnncccnnnncccnncnccccccncncccccnnnccccccccncccccncnnnncccccnnncccccnnnccccccccccccncccccccccnnncccncncccnnncnnncccccccnnnncccnncccccccccccnnccccnncnnccnnnccccncnnnncccccncnnnnnccnnnccncccccnnnnnccnccccccccnccccnnnnnnnccnncncccnnnncnccccncnncccnnnnnccccccccnnnccccccnccccccnccncnnccccnccncncccccncccccccccnccccccctcncnnncct

SEQ ID NO: 74494 - DNA, 700 bp, Zea mays
  misc_feature: Ceres CLONE 1558883
  misc_feature: Encodes the peptide sequence at SEQ ID NO. 74495
  misc_feature (351)..(351): n is a, c, t, g, unknown, or other
  misc_feature (395)..(395): n is a, c, t, g, unknown, or other
  misc_feature (504)..(504): n is a, c, t, g, unknown, or other
  misc_feature (523)..(523): n is a, c, t, g, unknown, or other
  misc_feature (526)..(526): n is a, c, t, g, unknown, or other
  misc_feature (529)..(529): n is a, c, t, g, unknown, or other
  misc_feature (539)..(539): n is a, c, t, g, unknown, or other
  misc_feature (545)..(545): n is a, c, t, g, unknown, or other
  misc_feature (555)..(555): n is a, c, t, g, unknown, or other
  misc_feature (638)..(638): n is a, c, t, g, unknown, or other
ctcaccgcggtggcggccgctctagaactagtggatcccccgggctgcaggaattcgtctcacccctagaaaaatcgactcaaatcgtgaaactattgagaaaattccattccaacgacatcgaaggagcctgcgaagcgagcgagagtctataatggcgaacggaggcgagctgcagctgctgggctcatggtacagcccctacgtgatccgcgccaaggtggcgctggggctgaaggggctcagctacgagttcgtcgaggaggacctctcccgcaagagcgacctgctgctgaagctcaacccggtgcacaggaaggtgcccgtgctagtccacggcggaccgccccngtgtgcgagtcgctcgtcatcctgcagtacgtcgacgagacctngggcaggcaccggggaccccctctcctgccccgccgacgcctacgaccgcgccatggctcgcttctgggcagcctacgtcgacgacaagttctacaaggagtggaaccnggctgtctggtcgacgacngcnganaagggcggcngaagcnctcggcgtcntcgtccccgtggtgggagacgctggaagcagcgcctcaaggaatgctcccaagggaaaccctttctttggggggggacgcccntccgggttcctgggacatcgggcctcggggaacttcccgggtggtgggattaaggggggggg

SEQ ID NO: 74495 - protein, 178 aa, Zea mays
  misc_feature: Ceres CLONE 1558883
  misc_feature (5)..(73): Pfam Name: GST_N Pfam Description: Glutathione S-transferase, N-terminal domain
  misc_feature: SWISSPROT Homolog: EC 4.4.1.5 Lactoylglutathione lyase
  misc_feature (66)..(66): Xaa is any aa, unknown, or other
  misc_feature (81)..(81): Xaa is any aa, unknown, or other
  misc_feature (117)..(117): Xaa is any aa, unknown, or other
  misc_feature (125)..(125): Xaa is any aa, unknown, or other
  misc_feature (129)..(129): Xaa is any aa, unknown, or other
  misc_feature (131)..(131): Xaa is any aa, unknown, or other
  misc_feature (134)..(134): Xaa is any aa, unknown, or other
  misc_feature (162)..(162): Xaa is any aa, unknown, or other
MANGGELQLLGSWYSPYVIRAKVALGLKGLSYEFVEEDLSRKSDLLLKLNPVHRKVPVLVHGGPPXCASRSSSCSTSTRPXAGTGDPLSCPADAYDRAMARFWAAYVDDKFYKEWNXAVWSTTAXKGGXSXRRXRPRGGRRWKQRLKECSQGKPFLWGGTPXRVPGTSGLGELPGWWD

SEQ ID NO: 74496 - DNA, 793 bp, Zea mays
  misc_feature: Ceres CLONE 1558886
  misc_feature (560)..(560): n is a, c, t, g, unknown, or other
ctccccgcggtggcggccgctctagaactagtggatcccccgggctgcaggaattcgtctcacccctagaaaaaatcctgctgctgcccctctttgccccagtctgcaggctgcaggagatgactcctttcgacctccactaaccagctaatcacatagctcgaccccgcagcgggatggatcccgtccttccatctggagtgcgccctcctctaactcccccctcgccctcatcatctggcttccacttgggtccagcctgctgctagctgtactctgcatcaaactgtcgcggaaactgaccggattatacggtgttcctcttcccggctacatgctgatgcgacacgatcagctggctctctggacaattcggctcttagggtggcttccaagtttgtagccatgctcgcccctatcaacgcccgtagcagcatgtggagatcatcactacctctgtgatacgacggacatgacctaatcgattgctgtgacttccagtgttcgatccgagcgctgcgcatgcgtatactgcaagtaccagcctgtgatcacagtgntggcgtttcatcaaactgctcgtgttatgacatgaccgcactcaaacgagattgtcctaacttccgatatagcttggcataggaaaagttcctaatggcccaaaacaaacgaggtttggcctggtaccagctggttccgccattatgaattgggccacctgttttcccgcccccacataagttgccgggggaaatggtacccccaatcaatttcccaatgtccccgaaaaagg

SEQ ID NO: 74497 - DNA, 775 bp, Zea mays
  misc_feature: Ceres CLONE 1558889
  misc_feature: SWISSPROT Homolog: EC 2.4.1.134 Galactosylxylosylprotein 3-beta-galactosyltransferase
  misc_feature (722)..(722): n is a, c, t, g, unknown, or other
tcaccgcggtggcggccgctctagaactagtggatcccccgggctgcaggaattcgtctcacccctagaaaaatagaagaacagaagggaatagttatccgcttcactatcgggcacagtgctacatccaacagtatactggacaaagctatagattcagaggacgctcagcatcatgactttcttaggctggaccatgttgagggatatcatgaactctcagctaagacaaaaatattcttctctactgctgttggcatctgggacgctgacttctacgtcaaggtcgatgatgatgtgcatgtaaacctaggaatgcttgccactacccttgctcggcataaatcgaaaccaagaacttatattggctgcatgaagtcaggcccagttcttgctgacaagaatgtgaagtaccatgaacctgagtactggaaatttggggaggaaggaaataagtacttccgtcatgctacagggcagatatatgccatttcgaaagatctggcgacttatatctcaatcaatcggcctatcttgcacaaatacgcaaacgaagacgtgtcgcttgggatcgtggttcatcgggtttggaagttaatcacatcgatgaaaggaacatgtgctgtggaactccaccagactggtgagtggaaagggcaagctggcaatgtcctgcgtagcgtctttcgactgggagctgcagtggcattatggcagtcttnttgagaggatcaaaagatgtacatggctcggctgccggcgaaggggattcacc

SEQ ID NO: 74498 - DNA, 798 bp, Zea mays
  misc_feature: Ceres CLONE 1558894
  misc_feature: Encodes the peptide sequence at SEQ ID NO. 74499
ctggagctccccgcggtggcggccgctctagaactagtggatcccccgggctgcaggaattcgtctcacccccgagacccccgcggaggcaccggcagcgcccgtccgccgaggcgaaaactacctaagccaagaaagcctctgcgcccaacaagcgtgccaacccgacccacccgccgtacaccgagatgatctcggaggctgtcacctccctcacggagcggactgcgtccacccagtacgcaatcgcccagctcgtcaaggacaagcacaacgacaagcgtcccgcccaacttcaacatagctcctgctcggccagctcaagaagctcgtcgccggcggcaagctcaccaaggtgaagaactcctacaagctgtccgcactgagccccggccgacgccaaggcgaagcccaagtccgagaccgctgtgaacaagcccaaggcctgtgccaagaaccccaaggccaccaccaagcaccaaggacaagctcaaggacaagtcccctcgcaatgcgaagcccgccgcagagccaaacgctgccgcgaaggctggcgctaagccgaaacgtgcagctgccaagctcaaagcggccgccaagccgaaagccaagccagctgccaaggctaacgcgaaggctgccacggcctacgctaagccagctggcaagaaggcatgtcgctccgcctaggacgcctagacgtcggcaagtgacacgcccggggtagatagcggcgcccgacatgaagccctctgattcgggcaaggacgcccctggccaagaggccgacccaggaaa

SEQ ID NO: 74499 - protein, 56 aa, Zea mays
  misc_feature: Ceres CLONE 1558894
MISEAVTSLTERTASTQYAIAQLVKDKHNDKRPAQLQHSSCSASSRSSSPAASSPR

SEQ ID NO: 74500 - DNA, 742 bp, Zea mays
  misc_feature: Ceres CLONE 1558895
  misc_feature: Encodes the peptide sequence at SEQ ID NO. 74501
  misc_feature (322)..(322): n is a, c, t, g, unknown, or other
  misc_feature (326)..(326): n is a, c, t, g, unknown, or other
ctcaccgcggtggcggccgctctagaactagtggatcccccgggctgcaggaattcgtctcacccctagaaaaaagctcaccgctcactcacaagcacgctgcgaaacacagacgcagagacccgcgcacagatcgaagcggaggatgaaggtggaggtggtggagacgacgctggtgccgccgagcgaggcgacgccgcggcacgcgctgtggctgtccaacctggacctggcggtgcccaagacccacaccccgctcgtctactactacccgaggcccgccgcgtccggcgccggggaaggagggaaaggagaaaggganttangggtcgtttcttcgacccggcgcgcctgcagagaggcgctgtccacgtgcgctggtgcggcttctacgccttctggtctgggcagcatggtctgtccggccccatggcgagactggctcccacatacgactgggcacctcgcatacgggctgccgcttgcttcttgcggtacccggcgtgtcccgaaggtatccccggggcccaacttaaaaagcttttccgccggaaactttcttaagaccccttccccccccctatgggggtgggggcgtcccctggggtgtttccggccctttaacaaatccccggtgttcccggggggggagccccctggcccccccgccatttggggggcccccccgggtggttctccgcaagggggacaacggcttttcccaaaaaaagccggggggggg

SEQ ID NO: 74501 - protein, 199 aa, Zea mays
  misc_feature: Ceres CLONE 1558895
  misc_feature: SWISSPROT Homolog: EC 2.3.1.144 Anthranilate N-benzoyltransferase
  misc_feature (59)..(59): Xaa is any aa, unknown, or other
  misc_feature (61)..(61): Xaa is any aa, unknown, or other
MKVEVVETTLVPPSEATPRHALWLSNLDLAVPKTHTPLVYYYPRPAASGAGEGGKGERXLXVVSSTRRACREALSTCAGAASTPSGLGSMVCPAPWRDWLPHTTGHLAYGLPLASCGTRRVPKVSPGPNLKSFSAGNFLKTPSPPLWGWGRPLGCFRPFNKSPVFPGGEPPGPPAIWGAPPGGSPQGGQRLFPKKAGGG

SEQ ID NO: 74502 - DNA, 859 bp, Zea mays
  misc_feature: Ceres CLONE 1558896
  misc_feature: Encodes the peptide sequence at SEQ ID NO. 74503
ggagctccccgcggtggcggccgctctagaacagtggatcccccgggctgcaggaattcgtctcacccctagaaaaagaggaagagagacagcgcgaagcggcagcggtagccagcaaaggcggctagagctgttgcccatgcaaggcgagtaccggtcttccagcgaggagtcggcggccgctgcagcagccgcagccatggctcctctggcggccgccgcggccgcagcagtgaagatggaggcggagcaggcggcgatggcgagcgcggctgcgccgcagctggggtcggcgcaccagcaccagcaccagcaccagcagatgcagccgcggcggcagtaccgcggcgtgcgcatgcgcaagtggggcaagtgggtggcggagatccgggagccgcacaagcgcacgcgcatctggctggggtcctacgccacggccgtggcggcggcgcgcgcctacgacacggccgtgttctacctgcgcggccggtcggcgcggctcaacttccccgacgagatcccgtcgctggcgccgtcggagggcgagggcgacggcgacggcggggagccgccgcaccgcaaaaggggggggggggggggggggggggaatgttttccccccggttcatcccggaagaagggcatccagaggggggggtcccccctgggacgccgctgcaaaaccgggaatgaatggggccccccccccgcccccaccggggaacgcccaaaggggaccaccttgaccaaccaccaaccaccttcccgcagcttgcggaaagcaccacccccccccccccccgaaaaagcgggcgggcgggccgaaaccacccggccagggaaaggttaaaaaccattc

SEQ ID NO: 74503 - protein, 236 aa, Zea mays
  misc_feature: Ceres CLONE 1558896
  misc_feature (66)..(117): Pfam Name: AP2 Pfam Description: AP2 domain
MQGEYRSSSEESAAAAAAAAMAPLAAAAAAAVKMEAEQAAMASAAAPQLGSAHQHQHQHQQMQPRRQYRGVRMRKWGKWVAEIREPHKRTRIWLGSYATAVAAARAYDTAVFYLRGRSARLNFPDEIPSLAPSEGEGDGDGGEPPHRKRGGGGGGGECFPPGSSRKKGIQRGGSPLGRRCKTGNEWGPPPAPTGERPKGTTLTNHQPPSRSLRKAPPPPPPEKAGGRAETTRPGKG

SEQ ID NO: 74504 - DNA, 748 bp, Zea mays
  misc_feature: Ceres CLONE 1558897
  misc_feature (374)..(374): n is a, c, t, g, unknown, or other
  misc_feature (494)..(494): n is a, c, t, g, unknown, or other
  misc_feature (495)..(495): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (561)..(561): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (592)..(592): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (636)..(636): n is a, c, t, g, unknown, or other
  misc_feature (655)..(655): n is a, c, t, g, unknown, or other
  misc_feature (656)..(656): n is a, c, t, g, unknown, or other
  misc_feature (663)..(663): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (683)..(683): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (732)..(732): n is a, c, t, g, unknown, or other
  misc_feature (741)..(741): n is a, c, t, g, unknown, or other
  misc_feature (742)..(742): n is a, c, t, g, unknown, or other
gctccccgcggtggcggccgctctagaactagtggatcccccgggctgcaggaattcgtctcacccctagaaaaaacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcgcgaaacgcgtgctgggagctgtactgcctcgagcatggcattcaggcatcatggccatgatgcccgagtgacaagaccattgcggcggagggtcgatgatcgctttcatacaccctttccttcaanttgagaactgggctgctggggaaaggcacgttcccccccgatggccctggttttttttgggtttgaaacccttttgaaagcccccccccgggggggtgaccccccaaaagtagtataaannaaaaaaaaaaaaagaggggagnnnaggagaaggggaggaaagaaagaggaggaagaagagaaaggncgggagggtgcgnnnnnagtaggaggcaggnggggggcgcgtcgnnnccgannnncgcggcagnnnccggccgcncccccgcacaccccccccnnccccccncccccnnnnnnncnnnccgnaccccccccacgcagcccccgcgnnnnnnnnnnccaccccccccacccnccccccccnnccccct

SEQ ID NO: 74505 - DNA, 643 bp, Zea mays
  misc_feature: Ceres CLONE 1558898
  misc_feature: Encodes the peptide sequence at SEQ ID NO. 74506
  misc_feature (372)..(372): n is a, c, t, g, unknown, or other
ctcaccgcggtggcggccgctctagaactagtggatcccccgggctgcaggaattcgtctcacccctagaaaaagccgcgccgtgcgcgcaatccccctcgctcgcaccatggcgctgcagctccagctgccgcggccgctcgccgccgcacggccctctatcctcctcccttccccagcccatggtgcctccgcttccgcgaccccccttcacgcccgcgaggcgggttgcgttttcgctccaacaacgtgcgcctcctcagcccaaccgcgcgtccgccgctctcgggacccctactacgatctcgacgaggacgacgaagaggaggcggaagtcgacgaggacgatgaagacgacgagggagggctacnagagcgatgatgacctgttcgggtttggaatatccctggtggaactttatcaaaacaagccccttcgggctttaaagcaagaaaacccgggaccccccaaactcccaatggggaaaaaaaaaaactgggggagggaaaaaaaaaacccaaaacccctttggaaaaaaaatccgggggaaatccccccggaaaaaaaaaaaaaaagccccccccgccccccccccagggggaataaaaaagggggggggagaaaattttttttaacaaaaaa

SEQ ID NO: 74506 - protein, 90 aa, Zea mays
  misc_feature: Ceres CLONE 1558898
  misc_feature (88)..(88): Xaa is any aa, unknown, or other
MALQLQLPRPLAAARPSILLPSPAHGASASATPLHAREAGCVFAPTTCASSAQPRVRRSRDPYYDLDEDDEEEAEVDEDDEDDEGGLXER

SEQ ID NO: 74507 - DNA, 835 bp, Zea mays
  misc_feature: Ceres CLONE 1558900
  misc_feature: Pfam Name: Sec10 Pfam Description: Exocyst complex component Sec10
  misc_feature (531)..(531): n is a, c, t, g, unknown, or other
  misc_feature (611)..(611): n is a, c, t, g, unknown, or other
  misc_feature (627)..(627): n is a, c, t, g, unknown, or other
ctccccgcggtggcggccgctctagaactagtggatcccccgggctgcaggaattcgtctcacccctagaaaaactgaatctactggctcaatcggacgtgcaaaaggagcatctttgaccacatcaccacagcaacagatatctgttactgtagtaacggaatttgttcgctggaatgaggaagccataaccagatgcacactactgttttctcagcctactactgttgcagctaacgtgagatccatatttgcatgcttgcttgatcaagtgagccaatacttaactgaagggcttgaccgtgctagagagagtttaaatgaggccgcagctttgcgggatagatatgtcatcgggacaagtgttagtaggagagtggcagctgctgctgcttctgcacaagaggtggcagcttcagctggtgagagcagctttagatcctttatgattgctgtgcagcgttgtaccagtagcgtagctattcttcagcagtacttctcaaataccatatctcggctcttgctacctgntgatggtgctcatccgtctgcttgtgaagatatggggtcagcagtatcagtagttgaagctgctgctcacaaaggactgnctacatgtattgatanctgtatgtctgaaggtgaaaagaaattgttgtcttcggacaagagggctacagattatccgaacccagaatgaatggagctgcaccagatcatcggccaaactattggcttggtaaaagaatttaagccaatcctcccccggggttccttaaggttgcaattcagggccccttgaagagcctcaaacaaaaatttccttttttgaact

SEQ ID NO: 74508 - DNA, 746 bp, Zea mays
  misc_feature: Ceres CLONE 1558901
  misc_feature: Translation starting site: 143
  misc_feature (620)..(620): n is a, c, t, g, unknown, or other
ctccccgcggtggcggccgctctagaatagtggatcccccgggctgcaggaattcgtctcacccctagaaaaagagacgtctgtttctccccagctccaagccggacgacgcagcgtagcagcagagagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgttctccgccgcgctggcgctgtcgttggtgctgctgtcctcggccgccacctcccctccgcccgcgggcgccgacatcgcggggctgaccccgtgcaaggagtccaaggcgttcgcgaagcgcgagaagaactcgatcaagaagctcaccgcgtcgctgaagaagtacgcgcccgacagcgcccccgcgctcgccatctacgccaccatcgagaagaccaagcgccggttcgagaactacggcgagctcaggctgctgtgcggcgccgacagcctgccgcacctcatcagcagcggcgaccagcggcactggggcgagttcgtcaccccaggcctgctcttcctctacatcnccggctggattcgggtggtgtcggcacgagctacctcatcgccatcagcggcgagaagaagcccgccatgaggggaatcatcatcgacgtcgagctcgccacccggctccttcccaggggggtctt

SEQ ID NO: 74509 - DNA, 778 bp, Zea mays
  misc_feature: Ceres CLONE 1558902
  misc_feature: Encodes the peptide sequence at SEQ ID NO. 74510
ctccccgcggtggcggccgctctagaactagtggatcccccgggctgcaggaattcgtctcacccctagaaaaagattcccgctgacagcgaagctgaggagaatcccaagaaacagagctggtgaaattgcattgtcgcaacaggcaagagaagaggagaagaaagaaatggctgcaatacctgcagcgatcccgggctgctgctcttcgtctcgcctgcctcagcttgctggcctccctgcctccacaagcagaaggcgcttcaaggtcacggccatggcgcccaaaaagaaggtgaaccgctacgacgagagctggtcgaagcagtggttcggcgcgggcatcttcgcggagggcagcgaggaggtgtccgtggacgtgttcaagaagctggagcggcgcaaggtgctgagcaccgtggagaaggccggcctgctgtccaaggccgaggagctgggcctgacgctctcctcgctggagaagctgggcctgctctccaaggccgaggacctgggcctgctcagcctcgtcgagaccgcggcggggacgtccccgtccgtcctcgcctccatctcgctgccgctcctcgtggccccgtcgccgccggtggtcgtcgtgcccgacgactccgtcgcgctcgtcgccctaaaagccgtcgttgccggcggtgctcgccgcgggaagcccccgggctgttcgtggggctctgtcctggctccctggcctgcaggagtcggatgaatgcattgatctgcacctgcgccagtagaacccagt

SEQ ID NO: 74510 - protein, 154 aa, Zea mays
  misc_feature: Ceres CLONE 1558902
  misc_feature (1)..(153): Pfam Name: DUF1118 Pfam Description: Protein of unknown function (DUF1118)
MAPKKKVNRYDESWSKQWFGAGIFAEGSEEVSVDVFKKLERRKVLSTVEKAGLLSKAEELGLTLSSLEKLGLLSKAEDLGLLSLVETAAGTSPSVLASISLPLLVAPSPPVVVVPDDSVALVALKAVVAGGARRGKPPGCSWGSVLAPWPAGVG

SEQ ID NO: 74511 - DNA, 835 bp, Zea mays
  misc_feature: Ceres CLONE 1558904
  misc_feature: Encodes the peptide sequence at SEQ ID NO. 74512
  misc_feature (617)..(617): n is a, c, t, g, unknown, or other
  misc_feature (680)..(680): n is a, c, t, g, unknown, or other
  misc_feature (760)..(760): n is a, c, t, g, unknown, or other
tccccgcggtggcggccgctctagaactagtggatcccccgggctgcaggaattcgtctcacccctagaaaaaaagagaacaaaaataaagcaagaggcgagaggggagagcaacgacgccatcggagggaggaaagagaagaagacgatccgctagcgtgtgcgtggcgacgagatgtggcggaggcgagtgggcgccctccttctccgatctccacgaacttcttcctcggcctcctcggcctgccagagccgccgccaccatcttctccccagcgaggaacctcttgctctcaaccgtcttgccaggcttttcacgtcccaggctggaagtgatggtggcgatacccagaagccctttattgcttttgtcttaggtggtcctgggagtggcaaaggaacacagtgcactaagattgcttcggattttggatttgcccatctgagcgctggtgatattctccgacatgaaatagcatctggcagtgagaaagggggagttgatcctagaaatcataaaggaagggaggggattgttccgtctgagataactgtggaactcatcagaaaagcgatggaaatgaacaatgctaaaaggggttcttattgatggcttncccaaggtgtgaggaaaacagaatcgcttccgaaaggattggttggaacagaacagacattgntgattttcttttgactgtcctgagggatgagatgggttaacgcccttcttaggccgtacccagggaagaagttgatgatnacattgagacaatccagaagcgttctaaaaagtgtttgaaaggttgaaaaaatcccgggccgtttgacaaccaac

SEQ ID NO: 74512 - protein, 144 aa, Zea mays
  misc_feature: Ceres CLONE 1558904
  misc_feature (66)..(143): Pfam Name: ADK Pfam Description: Adenylate kinase
  misc_feature: SWISSPROT Homolog: EC 2.7.4.3 Adenylate kinase
MWRRRVGALLLRSPRTSSSASSACQSRRHHLLPSEEPLALNRLARLFTSQAGSDGGDTQKPFIAFVLGGPGSGKGTQCTKIASDFGFAHLSAGDILRHEIASGSEKGGVDPRNHKGREGIVPSEITVELIRKAMEMNNAKRGSY

SEQ ID NO: 74513 - DNA, 778 bp, Zea mays
  misc_feature: Ceres CLONE 1558905
  misc_feature: Encodes the peptide sequence at SEQ ID NO. 74514
ctccccgcggtggcggccgctctagaatagtggatcccccgggctgcaggaattcgtctcacccctagaaaaatccgaaccgctcgctgctggctcctccgcgcgcgtgttcgcggcatggccacgcttccaatggagctctcccccgccgccatttcccccttcaccaccctccccatctactattcttcgcgtgctcaccgccgcctcctcgcccacttcttctccgtcgcttcagcaccgggcggagcgaaagggcaccgaccggcggcctccgccgttgaggtgggcggcgtcaagatcgcgcgcgaagatgttgtgaaggaggatgatccgacaaacaacgtgcccgacaatatcttttcgaagatcggcctgcagctgcacaggagggataaccatccccttgggattttgaagaacacaatttatgattactttgacaagaacttcactgggcagtttgacaagtttgatgacctgtgccctcttgtttctgtcaagcagaattttgatgatgtcttggtcccttctgaacatgtaagccggagttacaacgacacatattatgttgatggtcaaacagtctttaggtgtcataccagtgctcatcaagctgagctgctaaggcatggacatacacactgtcttgtaactggagatgtctaacagtagggatcccattgattcaactcactatccctgtcctccatcaaatggaaagggttccgtggtcttctctcctgaaggaatggtccaggatctctccatgggtggg

SEQ ID NO: 74514 - protein, 183 aa, Zea mays
  misc_feature: Ceres CLONE 1558905
  misc_feature: SWISSPROT Homolog: EC 6.1.1.20 Phenylalanine--tRNA ligase
MATLPMELSPAAISPFTTLPIYYSSRAHRRLLAHFFSVASAPGGAKGHRPAASAVEVGGVKIAREDVVKEDDPTNNVPDNIFSKIGLQLHRRDNHPLGILKNTIYDYFDKNFTGQFDKFDDLCPLVSVKQNFDDVLVPSEHVSRSYNDTYYVDGQTVFRCHTSAHQAELLRHGHTHCLVTGDV

SEQ ID NO: 74515 - DNA, 827 bp, Zea mays
  misc_feature: Ceres CLONE 1558907
  misc_feature: Encodes the peptide sequence at SEQ ID NO. 74516
  misc_feature (535)..(535): n is a, c, t, g, unknown, or other
  misc_feature (771)..(771): n is a, c, t, g, unknown, or other
ctggagctccccgcggtggcggccgctcctagaactagtggatcccccgggctgcaggaattcgtctcacccctagaaaaaagccaccgcgccggcgagccgaagcgagcgcggagctaaggatgccgcggaccaccgtggtagagagctccggctgcccgccgctccgcgccctcaccaccgacatcctcggcctcgtcaaagtcgtcgaggcccacgcgaggccggcgggcgccgccaaggtcgtcgagacgtggggcgcgcctgacgcttcccgtgccatcgttgctgcctccctcgccgatcgtgccgccgaccccgtcttggctgtggcgaggaggaacggcgtggttgagctgctgaatcccttgaatggaagtgctctggctgctgtcaagaccgcggggtcagcgccaaatgacagtggcgctgaaggtgatcccctcgccgcactgcatcttttcgcaagacagacttcggactcgatcttaggcacatttcttgcctgcacggagaaggggaaagcttctatcangtccatcacgaaagaaaatgcagattccgggttcggatgttgggccatcagccacaatgggatgtgtgcaatgggggccaatgtgcaattttgctcagtagatcatggcgaaagctatgtgatattttggagggaaaaggcattagaagtgaactttgtgggataatcacatctagtagtaaagacatggtcctggctaaatctcccccgagcaaatagtcttgggcatattcacntcgaaccttgggtcactggctgggaaccttcttgtgcaagaatgatcatccgtaaa

SEQ ID NO: 74516 - protein, 192 aa, Zea mays
  misc_feature: Ceres CLONE 1558907
  misc_feature (138)..(138): Xaa is any aa, unknown, or other
MPRTTVVESSGCPPLRALTTDILGLVKVVEAHARPAGAAKVVETWGAPDASRAIVAASLADRAADPVLAVARRNGVVELLNPLNGSALAAVKTAGSAPNDSGAEGDPLAALHLFARQTSDSILGTFLACTEKGKASIXSITKENADSGFGCWAISHNGMCAMGANVQFCSVDHGESYVIFWREKALEVNFVG

SEQ ID NO: 74517 - DNA, 696 bp, Zea mays
  misc_feature: Ceres CLONE 1558908
  misc_feature: Encodes the peptide sequence at SEQ ID NO. 74518
  misc_feature (123)..(123): n is a, c, t, g, unknown, or other
  misc_feature (124)..(124): n is a, c, t, g, unknown, or other
  misc_feature (409)..(409): n is a, c, t, g, unknown, or other
  misc_feature (449)..(449): n is a, c, t, g, unknown, or other
  misc_feature (450)..(450): n is a, c, t, g, unknown, or other
  misc_feature (507)..(507): n is a, c, t, g, unknown, or other
tccccgcggtggcggccgctctagaactagtggatcccccgggctgcaggaattcgtctcacccctagaaaaactctcgctccgttgctcgcctcgggtcaaaccctaagcagggagttgatnnttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaangaaatgaacaagaacaagaagcttgttaagaagcttgccnnagagtaccatgcttttctggcatcagaagccatcatcaagcagattccccgtctccntgggtcctggtcttcaacaagcaggcaagtttcccgacccttggttactcaccaggaatcccctggaggcccagggggaaacaaaactaaggccacccgtcaaggttccacctcaagaaaggttctttgccatggggggtttgccctttggcaacctttgggcattgggagaaaaagccgaatccccct

SEQ ID NO: 74518 - protein, 185 aa, Zea mays
  misc_feature: Ceres CLONE 1558908
  misc_feature (9)..(148): Pfam Name: Ribosomal_L1 Pfam Description: Ribosomal protein L1p/L10e family
  misc_feature (90)..(90): Xaa is any aa, unknown, or other
  misc_feature (104)..(104): Xaa is any aa, unknown, or other
  misc_feature (123)..(123): Xaa is any aa, unknown, or other
MSKLQSESVKDAISQIVGDAKEKNRKFTETVELQIGLKNYDPQKDKRFSGSVKLPHIPRPKMKVCMLGDAQHVEEAEKMGLDYMDVEALXEMNKNKKLVKKLAXEYHAFLASEAIIKQIPRLXGSWSSTSRQVSRPLVTHQESPGGPGGNKTKATRQGSTSRKVLCHGGFALWQPLGIGRKSRIP

SEQ ID NO: 74519 - DNA, 838 bp, Zea mays
  misc_feature: Ceres CLONE 1558909
  misc_feature: Encodes the peptide sequence at SEQ ID NO. 74520
  misc_feature (824)..(824): n is a, c, t, g, unknown, or other
ggagctcaccgcggtggcggccgctctagaactagtggatcccccgggctgcaggaattcgtctcacccctagaaaaaacgccagccttgccgagaggccgagaccaatcgccgccatctcccggaatgacggggtgacgaaaccgcgccgcaccagacaagacagaggagccgccgccgcgacccacaggccaccgggtcgccgaggaggggatccagcgagccatgtcgaccgacgtgcccatgagccccgagctcgagcaggtggacggcgagatccaggacatcttccgagcgctccagaatgggttccagaagatggacaagatcaaggactccagcaggcagtccaagctgctggaggatctcacggccaagatgagagagtgcaagcgcttgatcaaagagtttgaccgtatactcaaggatgaggagaaaaagaacacccctgatgtcaacaagcagctcaatgacaagaagcagttcatgatcaaagaactcaactcctatgtgaccttaaggaaaacgtaccagagcagccttggtaataagaggatcgaactattcgatacgggtaatgaccaggtggctgagggaactccagttcaaatggcatcagaaatgtcaaatcaagaactcattagcaccggaaggaaacaaatggaccaaactgatcaagctattgagcgctcaaaaatggttgtagcacaaaactgttgtagtgggagctcagactgctggcactctgacacagcaaacggaacatatgaaagagataggcaatgagctagattctggtcacttttcactggagaagctagtcnatggtgaaagaaat

SEQ ID NO: 74520 - protein, 186 aa, Zea mays
  misc_feature: Ceres CLONE 1558909
MSTDVPMSPELEQVDGEIQDIFRALQNGFQKMDKIKDSSRQSKLLEDLTAKMRECKRLIKEFDRILKDEEKKNTPDVNKQLNDKKQFMIKELNSYVTLRKTYQSSLGNKRIELFDTGNDQVAEGTPVQMASEMSNQELISTGRKQMDQTDQAIERSKMVVAQNCCSGSSDCWHSDTANGTYERDRQ

SEQ ID NO: 74521 - DNA, 809 bp, Zea mays
  misc_feature: Ceres CLONE 1558917
  misc_feature: Encodes the peptide sequence at SEQ ID NO. 74522
ccccgcggtggcggccgctctagaactagtggatcccccgggctgcaggaattcgtctcacccctagaaaaattcttcccgtcgaaagacggagagaggaaaagggacaagggcaaggcaagagagaggcgtcgtcgtttgatctgctgccggagtgcgaagaggaagaggaagaggaagaggagcgccggagttgtaaagatgttcctggtggactggttctatggggtgctggcatcgcttgggctgtggcagaaggaggctaagatcctcttccttggcctcgacaacgccggcaagaccaccctcctccacatgctgaaggacgagcggctcgtacagcaccagccaacgcagtaccccacgtcagaagagttgagcatcggcaggatcaagttcaaggcgttcgaccttgggggccaccagatcgcccgccgcgtctggaaggactactacgccaaggttgatgctgttgtgtacttggtggatgctgttgacaaggaacgttttgccgagtcgaagaaggagctcgatgcgcttcttgcagatgactcccttgcaaacgttcctttcctcatactgggcaacaagattgacatcccatacgcggcttcagaggaggagctgaggtactacctcggcctgagcaacttcacaaccgggtaaggcaacgtgaacttggccgactcaaacgtccgccccctggaaatcttccatgtggcagggtggtgcgcaaagatgggctattgggcgaagcctttcaatgggatgtctcccagacatccaaggtgagtcgctgctggtcctct

SEQ ID NO: 74522 - protein, 154 aa, Zea mays
  misc_feature: Ceres CLONE 1558917
  misc_feature (6)..(154): Pfam Name: Arf Pfam Description: ADP-ribosylation factor family
MFLVDWFYGVLASLGLWQKEAKILFLGLDNAGKTTLLHMLKDERLVQHQPTQYPTSEELSIGRIKFKAFDLGGHQIARRVWKDYYAKVDAVVYLVDAVDKERFAESKKELDALLADDSLANVPFLILGNKIDIPYAASEEELRYYLGLSNFTTG

SEQ ID NO: 74523 - DNA, 955 bp, Zea mays
  misc_feature: Ceres CLONE 1558918
  misc_feature: Encodes the peptide sequence at SEQ ID NO. 74524
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (285)..(285): n is a, c, t, g, unknown, or other
  misc_feature (294)..(294): n is a, c, t, g, unknown, or other
  misc_feature (316)..(316): n is a, c, t, g, unknown, or other
  misc_feature (334)..(334): n is a, c, t, g, unknown, or other
  misc_feature (335)..(335): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnngccaagctgggactcaccgcggtggcggccgctctagaatagtggatcccccgggctgcaggaattcgtctcacccctagaaaaaatacttggcaatcctctctagctagctcagcatccgacgaccggacttgcacgatggatgctgctctgctcgtcgtctccctcgtcctctgcctgctggcggctgcccctgcngcgtccgcngcgcgggccttcttcgtcttcngcgactccctcgtcgacnnacggcaacacaactacctgctgaacacggggcgcgcccgacgcgcccccctaacggatcgaattccccacgcacaaagcacggggcccctctcccacggggtttaaaatcccccaaaatcatctaggaagaaccctccggggcccaaaactgggcggccctaacccgaggccccccaattccccaaaaggaaaaaaaagcttccttcgggggcccaacattttttcgttctgccgggcggttcggggagtcctccccccaccccacgggaaaaacaaattttttgggaaaaaacctttccgggaattggttgcgaaccaaacccggccgggaaaatttcccgggggagggaaaccacccccggaaaaaaaacccttagcccccccccctctcggggggaaaccaccccgggggggaaaccaaccccctctctggaaaaaaaaagcccccccccgggggtcaattaaagccaccgggggcggggaaaaaaaaaactatccttttgaaaaaaaacaaaacctaccctccgttgggcccaccccttttctctccggggggcggccccccccccccaaaattaacccccccccccgaaaaaaaaaaacccccccgttcttttac

SEQ ID NO: 74524 - protein, 71 aa, Zea mays
  misc_feature: Ceres CLONE 1558918
  misc_feature (31)..(31): Xaa is any aa, unknown, or other
  misc_feature (37)..(37): Xaa is any aa, unknown, or other
MDAALLVVSLVLCLLAAAPAASAARAFFVFXDSLVDXRQHNYLLNTGRARRAPLTDRIPHAQSTGPLSHGV

SEQ ID NO: 74525 - DNA, 818 bp, Zea mays
  misc_feature: Ceres CLONE 1558919
  misc_feature: Encodes the peptide sequence at SEQ ID NO. 74526
  misc_feature (746)..(746): n is a, c, t, g, unknown, or other
ctcaccgcggtggcggccgctctagaactagtggatcccccgggctgcaggaattcgtctcacccctagaaaaagttttcgcctcgcgcccgcgctgctgtcctgctgctgctattttgccattgcatccatttccgggggacggagtggaggagggcgtcgcctgcgttgcttcacgtgggaagcgtagcgtgcttcgtttaggcctctcgccaatatccgagggttaatctagagaggcctttggctttgccagacgcgcctgtacgtacgtacgcgcctgtctgggaggcagtcgcttgctctcgcttccaatggccgagatctgctgcgaagaagccaagtccacgccggcgaccgccgtggctgcggcttcagtctccgccacggccgctgcggccgccgccgtggcagtggcctcctcggcgttagagaggaggcgacgcaggttggagatgaggaggttccgcgtcgcgggcgatcccgaagcgccggtcgcggaggacgtccgcgccgccaagcagcagaggctggcgcgcacgctgtccagcacctgccccgacgcgggctcaggctcgggctcggactccgacaggcctgccctacccgagcggttgcccaggtacgagggtcacctccgtctgcggccgacgccgcgagatggaagacaccgtctccgtttagccaggactttgtgcccggcacagcaaacagcactttcctcggcgtcctccaaccgccaccgnctgctcccacttaacaaaccatgtgcccaaacatgaatgcaccaaggtggtcgccggactagcacacggaag

SEQ ID NO: 74526 - protein, 155 aa, Zea mays
  misc_feature: Ceres CLONE 1558919
MAEICCEEAKSTPATAVAAASVSATAAAAAAVAVASSALERRRRRLEMRRFRVAGDPEAPVAEDVRAAKQQRLARTLSSTCPDAGSGSGSDSDRPALPERLPRYEGHLRLRPTPRDGRHRLRLARTLCPAQQTALSSASSNRHRLLPLNKPCAQT

SEQ ID NO: 74527 - DNA, 821 bp, Zea mays
  misc_feature: Ceres CLONE 1558920
  misc_feature: Translation starting site: 123
  misc_feature (611)..(611): n is a, c, t, g, unknown, or other
ctggagctccccgcggtggcggccgctctagaactagtggatcccccgggctgcaggaattcgtctcacccctagaaaaagccggacgacgcagcggagcagcagagagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgttctccgccgcgctggcgctgtcgtcggtgctgctgtcctcggccgccacctcccctccgcccgcggccgccgacatcgcggggctgaccccgtgcaaggagtccaaggcgttcgcgaagcgcgagaagaactcgatcaagaagctcaccgcgtcgctgaagaagtacgcagcccgacagcgcccccgcgctcgccatctacgccaccatcaagaagaccaagcgccggttcgagaactacagcaagttcaggctgctgtgcggcgcctacggcctgccgcacctcatcgtcagcggcgaccagtggcactggggcgagttcatcaccccgggcctgctcttcctctacatcgccggctggantcgggtgggtcggcaggagctacctcatcgccatcagcggcgagaagaagcccgccatgagggagatcatcatcgacgtcgagctcgccacgcggctcctccccagggagttcatctggcccgtcgccgcctagcgcgagctcatcatgggggacctcgtcgtcgacgacaaggacatcggctactactagctgcgcttgttcaactgct

SEQ ID NO: 74528 - DNA, 805 bp, Zea mays
  misc_feature: Ceres CLONE 1558921
  misc_feature: Encodes the peptide sequence at SEQ ID NO. 74529
ctccccgcggtggcggccgctctagaactagtggatcccccgggctgcaggaattcgtctcacccctagaaaaagccggacgacgcagcggagcggcagagagccagacaccagagatggccgccctcgccgccgcctccacgggcgccttcgccgcaaagacacgcgagcgcctctccgtggcctgctgcgccgccacgggcgacagcaggagcgtgtagctcgggtcctccgagaagacgttctacaacgcgctggccctgtcgtcggagctgctgtcgtcagcgtccagctcccctccgacagcggccgccgacatcgcggggatgagcccgtgcaaggagtacacagcgtccgcgaagtgcgagaagaactagatcaagaagctcaccgcgtcactgaacaagtacacggccgacagcgcccccgcgctcgccatgcacggcgccatggagaagaccaagcgccggttcgagaactacgacaaatgcagactgctgtgcggcgcctacggcctgccgaacctcatcgtcaacggcgaccagtggcactggggcgacgtcgtcagagagggcctgctcttcctctacatcaccggctggatcaggtgggtcggcaggagctacctcaatctcatcagcggcgaataaaagcccggccggaggtagatcatcatcgacgtcgagattggcacgcggcatcatccccaagggggttcatgcttggcccgatcgccgaacctaccgcgaaggttcatcagccggggaaacctccttccgtccaaagaaacaagggaccaagcggg

SEQ ID NO: 74529 - protein, 70 aa, Zea mays
  misc_feature: Ceres CLONE 1558921
  misc_feature (2)..(71): Pfam Name: PSI_PsaF Pfam Description: Photosystem I reaction centre subunit III
MHGAMEKTKRRFENYDKCRLLCGAYGLPNLIVNGDQWHWGDVVREGLLFLYITGWIRWVGRSYLNLISGE

SEQ ID NO: 74530 - DNA, 815 bp, Zea mays
  misc_feature: Ceres CLONE 1558923
  misc_feature: Encodes the peptide sequence at SEQ ID NO. 74531
ctggagctccccgcggtggcggccgctctagaactagtggatcccccgggctgcaggaattcgtctcacccctagaaaaaacccgggaccagcccctttccactaagccatctccttccacctcacctcaccgtggcagttcttctctcatcaccatctcaaacaaccacactctcaccacccagtgctcccttccttcaagaacacgctaccggtgcctgtggatggccagatcccagcgcccctctccttcttcaacaagcctgctgccttcccggagcaacccgcgcatgcacctctggtggatgccgtgggcttgacggctgctgcggggcttgagtggacgcagccgacggagcacgaactgcttgaggaaaactcccatatgtcgtcaattgattgtctacagactggctcggctgtgtccaccgggctggcgctatctctggatgaccggcgacactgcggccgaggcgctgggaactcctcaggagattcacaactgctcctgctgcccatgctggaagatgacatctcacgcgatgtccaacggcttgacgctgatatagaccgatctatgagagctcaagtcacccactcatcttcattgagtgaacggctgacgcaatctatactgcgaaaaactcaggcaaagcaatttgaggcactcggcctcaattgaggactagatactcacaaaaataatggacaaagaggcggaagtggagacataaacaaaatgcactctgaactagacgaccagatctagcatttggcgactggaaatttggtgctgcgcagcatagggccaagta

SEQ ID NO: 74531 - protein, 98 aa, Zea mays
  misc_feature: Ceres CLONE 1558923
MSSIDCLQTGSAVSTGLALSLDDRRHCGRGAGNSSGDSQLLLLPMLEDDISRDVQRLDADIDRSMRAQVTHSSSLSERLTQSILRKTQAKQFEALGLN

SEQ ID NO: 74532 - DNA, 842 bp, Zea mays
  misc_feature: Ceres CLONE 1558924
  misc_feature: Encodes the peptide sequence at SEQ ID NO. 74533
  misc_feature (466)..(466): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (707)..(707): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (727)..(727): n is a, c, t, g, unknown, or other
  misc_feature (731)..(731): n is a, c, t, g, unknown, or other
  misc_feature (735)..(735): n is a, c, t, g, unknown, or other
  misc_feature (739)..(739): n is a, c, t, g, unknown, or other
  misc_feature (748)..(748): n is a, c, t, g, unknown, or other
  misc_feature (803)..(803): n is a, c, t, g, unknown, or other
  misc_feature (818)..(818): n is a, c, t, g, unknown, or other
tggagctccccgcggtggcggccgctctagaactagtggatcccccgggctgcaggaattcgtctcacccctagaaaaaacctctcagttgcccactcacgtctcttgccgtacgtacgtgcgtccaacacaccatgtgaaaatgggctcggagacggagacggtcaacgtggaaggcatcccgttcccggcggagatcaccgtcggcaaccctctctccctcctaggcacaggcatcacggacatcgagatccacttcctgcagatcaagtacaacgccatcggagtctatctccacaacgccggcggcggcgacagcaccacgctgctgggccacctcggggcctgtaatggcaagacggcggaggagctcctagcggacgccgccttctgggccgcgctggtggcggcccccgtcgagaagctgttccgcgtcctggtcatcaaggagatcaagggctcgcantacggcgtgcagcttgagaagctcgtccgcgaccgcctcgtcgccgccgacctcttttatgaaaaccaaaaaagaggggctcccaaaaagcgccccaattctttccagttcaagtacttcaagcggggctccgtcgttacccctttttcattttcccgggacgggggctcccctttttcccgggacccnnnnccgggggaaaatcactctcccgagnnnnnnngnnngaaggggggacccngnnnggggctcctcaaaacnaacntccnccgnatgatccanaacctggtacctcttcgggaaactcccccttggccctccaaacaccccttcgggntttggcgaacggttncgccgcggctgctcggccggtcgt

SEQ ID NO: 74533 - protein, 233 aa, Zea mays
  misc_feature: Ceres CLONE 1558924
  misc_feature (108)..(108): Xaa is any aa, unknown, or other
  misc_feature (172)..(172): Xaa is any aa, unknown, or other
  misc_feature (181)..(181): Xaa is any aa, unknown, or other
  misc_feature (182)..(182): Xaa is any aa, unknown, or other
  misc_feature (183)..(183): Xaa is any aa, unknown, or other
  misc_feature (184)..(184): Xaa is any aa, unknown, or other
  misc_feature (189)..(189): Xaa is any aa, unknown, or other
  misc_feature (190)..(190): Xaa is any aa, unknown, or other
  misc_feature (197)..(197): Xaa is any aa, unknown, or other
  misc_feature (198)..(198): Xaa is any aa, unknown, or other
  misc_feature (202)..(202): Xaa is any aa, unknown, or other
  misc_feature (221)..(221): Xaa is any aa, unknown, or other
  misc_feature (226)..(226): Xaa is any aa, unknown, or other
MGSETETVNVEGIPFPAEITVGNPLSLLGTGITDIEIHFLQIKYNAIGVYLHNAGGGDSTTLLGHLGACNGKTAEELLADAAFWAALVAAPVEKLFRVLVIKEIKGSXYGVQLEKLVRDRLVAADLFYENQKRGAPKKRPNSFQFKYFKRGSVVTPFSFSRDGGSPFSRDPXPGENHSPEXXXXKGGPXXGLLKTNXXRMIXNLVPLRETPPWPSKHPFGXWRTVXPRLLGRS

SEQ ID NO: 74534 - DNA, 798 bp, Zea mays
  misc_feature: Ceres CLONE 1558926
  misc_feature: Encodes the peptide sequence at SEQ ID NO. 74535
  misc_feature (739)..(739): n is a, c, t, g, unknown, or other
  misc_feature (749)..(749): n is a, c, t, g, unknown, or other
  misc_feature (784)..(784): n is a, c, t, g, unknown, or other
aagctggagctcaccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggaatacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccacctcagagatggatccgcaccaagagcaccaagaggttgtttgtttgttggacggcggcagacacccatctttgtcgattcaaggatcaaaggtatacattggggaagcttggcatgaggcgttngacaactcgnactctggagaaacctattcagtgaagcaaggacanggtgctgggatgct

SEQ ID NO: 74535 - protein, 208 aa, Zea mays
  misc_feature: Ceres CLONE 1558926
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (198)..(198): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEEAGAAVEQFNGYTFQGRPLRVNCGPPPPQRWIRTKSTKRLFVCWTAADTHLCRFKDQRYTLGKLGMRRXTTRTLEKPIQ

SEQ ID NO: 74536 - DNA, 786 bp, Zea mays
  misc_feature: Ceres CLONE 1558930
  misc_feature: Translation starting site: 146
  misc_feature: SWISSPROT Homolog: EC 2.7.11.1 Non-specific serine/threonine protein kinase
  misc_feature (683)..(683): n is a, c, t, g, unknown, or other
ggagctcaccgcggtggcggccgctctagaactagtggatcccccgggctgcaggaattcgtctcacccctagaaaaaactccgccactcccaagtcccaagtcccacatcacactcgagagccatctcccagcacacgagcgcgatggcttccaccaccaccaccttcctcgccatcttgctggtcgtggcagcgtccgcggcgccagcacagtcctgctcaccgcgcgacatccacgcgctgctgagcgtgaaacatgcgctgggaaaacctgcgtcgctgtcgacgtggacgccggcgtcgcccaactgctgcgcgtgggaccacctcctatgcaacgacgcccggcgcgtgaacaacgtcttcatcgaccgcgcggacgacgtgcacagccagatcccgtcggcggtgggcgggctgacggagctcatgtcgctgacgctgttccggctgccggggctgaccggcgccatccaggcctgcctcacggagctgtccaacctcctgttcctcaccatctcccacaccaacgtgtacggcgctcatccctgagtcgctggcgcggctgcacggcctccactccctggacctctgctgcaaccggatgaccggctgcatccccgacgcgttcgccgacctgcacatgcctctgtcgatggacctcctgcacatccagctgacngaccacatcgcggccgtgctggtgcaggagcagttccagtcgctggtcttgtcctacaccagctcacgtgccccatcccgcacgacgacacgcgctaatagat

SEQ ID NO: 74537 - DNA, 827 bp, Zea mays
  misc_feature: Ceres CLONE 1558934
  misc_feature: Encodes the peptide sequence at SEQ ID NO. 74538
  misc_feature (775)..(775): n is a, c, t, g, unknown, or other
  misc_feature (776)..(776): n is a, c, t, g, unknown, or other
ggagctccccgcggtggcggccgctctagaactagtggatcccccgggctgcaggaattcgtctcacccctagaaaaaccggctccatccgtctcctgcactgaccttttcctccacgtctcccgcaactgcaagcaaccactgatccagcccgttctatgtcccggcgaatggtgacgaaccaggacgcggaggcggcagcgccaggggcaggggcggcggtagatccgatgcggctagcatcgcggtggcggcgatcccggccagagtggaactgcgcgtcggcggagctggaggctgagccgtccgagctcaacaccgtcaacagctcgggactcttctccgtcgtctctaccgacaagttatcggtaaaatacctcggcagccatcaccacggccacgacgtcggtgtcgtgcaggccgaccgtcccgcgccgacgcgccgagccgtgtactacttcgagatgggcgtcaggaatgctggatacaaggggcagacatccattgggttcacgagcgagagcttcaagatgaggcgacaaccgggctgggagacaaacagttgtggataccatggtgacgacggccatctttatcggggtcaagggaaaggtgaatcatttgggccaaaattcacatctggtgacataattggtgctggcatcaactacttgtcacaagaatttttcttcacgaaaaatggtactcctggttggagccattccaaaagaaattaaaggcccactatatcctaccattgcagttcatagttacnngtgaaagagttgactgtaaactttggaaaaagaaccattcctgttggacga

SEQ ID NO: 74538 - protein, 188 aa, Zea mays
  misc_feature: Ceres CLONE 1558934
  misc_feature (92)..(187): Pfam Name: SPRY Pfam Description: SPRY domain
  misc_feature: SWISSPROT Homolog: EC 2.7.10.2 Non-specific protein-tyrosine kinase
MVTNQDAEAAAPGAGAAVDPMRLASRWRRSRPEWNCASAELEAEPSELNTVNSSGLFSVVSTDKLSVKYLGSHHHGHDVGVVQADRPAPTRRAVYYFEMGVRNAGYKGQTSIGFTSESFKMRRQPGWETNSCGYHGDDGHLYRGQGKGESFGPKFTSGDIIGAGINYLSQEFFFTKNGTPGWSHSKRN

SEQ ID NO: 74539 - DNA, 787 bp, Zea mays
  misc_feature: Ceres CLONE 1558938
  misc_feature: Encodes the peptide sequence at SEQ ID NO. 74540
ctggagctccccgcggtggcggccgctctagaactagtggatcccccgggctgcaggaattcgtctcacccctagaaaaagactggtttacgcctttacggctcgcccccgtcttttcttctcgtgttctcccctccccgcgtgcgctccctttcgtggcacgactgggcgaccgccgctgtacaccagctgctcagatctcgtcgggccccttcgccggcgaccatcacctgttagggcaatgatgggaggctggggggtttcggatgggtacgagggatcaaagaggacacgaatgatgatggaatcgaatccctacttcgcagtgaacgcagggagtccattggatgtctcaaagacgtctacgattgttgaaccaggcccgccctattttggggccatgggcagcaacactggaggcgccagtggaggcttctgccagcgcttcgacagcagcagcttagctggtgcacgagctagcactggcgtcaaaactttccaggtgtacagctgcgacgtctaccttttgatggcatgacattgatatctgacacgtctctgtgggactggacatagtgcacggcctcctgcttaacgacatcgccgcttcactggtgaagcctattgtggcctttccaaacgctatgccaacctgaatttatgctggaccccacccggagaacccggggccggagggttaggtgaaggggcctcgaataaaaaagccccggattcataaaggcccattatcccaccaagggaggccccgggggggttaatttgaacc

SEQ ID NO: 74540 - protein, 98 aa, Zea mays
  misc_feature: Ceres CLONE 1558938
MMGGWGVSDGYEGSKRTRMMMESNPYFAVNAGSPLDVSKTSTIVEPGPPYFGAMGSNTGGASGGFCQRFDSSSLAGARASTGVKTFQVYSCDVYLLMA

SEQ ID NO: 74541 - DNA, 744 bp, Zea mays
  misc_feature: Ceres CLONE 1558943
  misc_feature: Encodes the peptide sequence at SEQ ID NO. 74542
  misc_feature (42)..(42): n is a, c, t, g, unknown, or other
  misc_feature (541)..(541): n is a, c, t, g, unknown, or other
ctccccgcggtggcggccgctctagaactagtggatcccccngggctgcagggaattcgtctcacccctagaaaaaacagcatctcaagtcttcacactcctcgccatcacataaaaccagtgcaagcagaagcagcgcaatggcgagcagcaccatggccctctcctccacagccttcgccggcaaggcagtgaacgtgccgtcgtctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgccccgcacggcgtcaagttcggcgaagccgtgtgggtcaaggcccggntcgcagatcttcagcgagggtggcctgggactaccttcgcaaaccgagcctgattcacgcgcaagagcatccctcgcatccggggccttgccaggtcggccccatgggccgccattcagggggtaaccggttcccccgggggcccctttgggaaaagggcgtcaaaccccgttttaccccggggggaaagttttgaacccggt

SEQ ID NO: 74542 - protein, 120 aa, Zea mays
  misc_feature: Ceres CLONE 1558943
  misc_feature (33)..(120): Pfam Name: Chloroa_b-bind Pfam Description: Chlorophyll A-B binding protein
  misc_feature (104)..(104): Xaa is any aa, unknown, or other
MRKTAAKAKPAASSGSPWYGPDRVLYLGPLSGAPPSYLTGEFPGDYGWDTAGLSADPETFAKNRELEVIHSRWAMLGALGCVFPELLAPHGVKFGEAVWVKARXADLQRGWPGTTFANRA

SEQ ID NO: 74543 - DNA, 771 bp, Zea mays
  misc_feature: Ceres CLONE 1558944
  misc_feature: Encodes the peptide sequence at SEQ ID NO. 74544
tggagctccccgcggtggcggccgctctagaactagtggatcccccgggctgcaggaattcgtctcacccctagaaaaacttttcatttcccatctctctctgcgccgtcccgtgctccctccgctagttctcccaattccttccccacctcctcggtcgtcgcctcccccagagagcaggagccgcctcgtccctgccggtcccgacccccatcccgtccgcgtccaacgccatgaatcccgagtacgactacctcttcaagctgctcctcatcggcgactccggtgttgggaagtcttgcctgctgctgaggtttgcggatgattcatctggagagctatatcagtactattggagttgattttgtaagttggtttcttgatgagataaaacaaagctgaatccctctgtagtttggcattgcttgcatgccttgctagttactcatgtatgcccttttttgctccctgtctgctagaaaatccgcaccgttgagcaagatgggaagacaataaagctacagatttgggatactgctggccaagaacgctttaggaccatcacaagcagctactaccgtggagctcatggcattattgttgtgtatgatgtaactgacccagagagctttaacaatgtcaagcagtggctgaatgaaattgataggtatgccagtgaaaatgtgaacaagcttttggtgggggaacaagtgtgacctggctgagaacagagtagtttcttacgaggctggcaaggcccttgctgatgac

SEQ ID NO: 74544 - protein, 42 aa, Zea mays
  misc_feature: Ceres CLONE 1558944
MNPEYDYLFKLLLIGDSGVGKSCLLLRFADDSSGELYQYYWS

SEQ ID NO: 74545 - DNA, 973 bp, Zea mays
  misc_feature: Ceres CLONE 1558948
  misc_feature: Encodes the peptide sequence at SEQ ID NO. 74546
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (666)..(666): n is a, c, t, g, unknown, or other
  misc_feature (672)..(672): n is a, c, t, g, unknown, or other
  misc_feature (753)..(753): n is a, c, t, g, unknown, or other
  misc_feature (775)..(775): n is a, c, t, g, unknown, or other
  misc_feature (842)..(842): n is a, c, t, g, unknown, or other
  misc_feature (862)..(862): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggcatgctgggactcccctcggtggcggccgctctagaactagtggatcccccgggctgcaggaattcgtctcacccctagaaaaaagcgcgagtggtggcacccacgcacactcttctccccccagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggacgccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaagcccaaagcgagcacggagtacatctgcgtacagcgagcgaacggcttcaaggctgcatgatcccaccgtccaagtggcataccccagncaaggnaagcggcggtagtttccccccggggccaggttagcctcacgtcctaccccaaaggtaccaatctttgcgtaccggccgtancaggcctaacgttggtccccgntcaatcaatgcccaggccccaacgttcccaaaagaaagacccatgcggcccgaacataccagcctcntcccccgtaggcatgttccntcatccccagggtccgaactaccctgcctccgggcaaggcaaggccctatcggcggtcaaagacccgacctcccctaggggcggggttcctaagaaccggacgccattggc

SEQ ID NO: 74546 - protein, 104 aa, Zea mays
  misc_feature: Ceres CLONE 1558948
MASTSCCLLHQSTARLGASPRLAAAPPRSAQLLVCKARKQDAAADQSDVSRRAALALLAGVTAAAGAKVGPAAAAYGEAANVFGKPKASTEYICVQRANGFKAA

SEQ ID NO: 74547 - DNA, 791 bp, Zea mays
  misc_feature: Ceres CLONE 1558955
  misc_feature: Encodes the peptide sequence at SEQ ID NO. 74548
  misc_feature (720)..(720): n is a, c, t, g, unknown, or other
tcccgcggtggcggccgctctagaactagtggatcccccgggctgcaggaattcgtctcacccctagaaaaatttcctcggagaggagaagccgccgtcgcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcaggcgctcgctcgcaagtacaaccaggacaagatgatctgccgcaaatgctatgcacggctgcaccctagggctgtcaactgccgcaagaagaagtgtggtcacagcaaccagctgagggccaagaagaagatcaagaactgaggtgttgctgctagtcagtttcatggacaatgttgtttggttgttgaaccgtgtttgtttacgaactgtatttttgtttggttgttgaaaccgtggtttgtttaccgaacatattggcccttatgttatgttttaccatggcctggattcctcacccctgctcgccgcgaagcacagctctgtcaccgncggtttgccgtggccgggcgaagatgatgtcccggcggtggggtactccggcatcgacgaccccaaggcct

SEQ ID NO: 74548 - protein, 129 aa, Zea mays; identical to SEQ ID NO: 6241
  misc_feature: Ceres CLONE 1558955
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature: SWISSPROT Homolog: EC 3.1.2.15 Ubiquitin thiolesterase

SEQ ID NO: 74549 - DNA, 782 bp, Zea mays
  misc_feature: Ceres CLONE 1558957
  misc_feature: Encodes the peptide sequence at SEQ ID NO. 74550
  misc_feature (223)..(223): n is a, c, t, g, unknown, or other
  misc_feature (603)..(603): n is a, c, t, g, unknown, or other
ctggagctccccgcggtggcggccgctctagaactagtggatcccccgggctgcaggaattcgtctcacccctagaaaaaacttaggccgtcacaaggagaccctcctcagccgctagtaccagtagtcgtcgcgtttgcagctaggcagatctgagttagccggcggatccgatccgtgcgcgtgcgcagtgtgtgtgtgtgtgtgtgtgtgtgtgtgtgtncggtggagagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaaccttccggcctaccgcaccgccgtgagcccgctgctgcggggcgtcgaggtcggcctcgcgcacggctacctcctcgtggggcccttcgcgctcacgggcccgctccgcagcacgcccgtgcacngccaggccggcgcgctcggcgccgccagcctcgtcgccatcctcagcgtctgcctcaccatgtacggcgtcgcctccttcaacgagggggaccccgtccacgggggccctcgctcacgctcaccggcaggaaaaaagaggccgacaagctgcagacctcccgacggctgggcccagttt

SEQ ID NO: 74550 - protein, 176 aa, Zea mays
  misc_feature: Ceres CLONE 1558957
  misc_feature (44)..(176): Pfam Name: PsaL Pfam Description: Photosystem I reaction centre subunit XI
  misc_feature (117)..(117): Xaa is any aa, unknown, or other
MASQVMKSSLVVHSRPRGLSGAAALTRRPGRFTVKAIQPEKATYQVVQPINGDPFIGSLETPVTSSPLVAWYLSNLPAYRTAVSPLLRGVEVGLAHGYLLVGPFALTGPLRSTPVHXQAGALGAASLVAILSVCLTMYGVASFNEGDPVHGGPRSRSPAGKKRPTSCRPPDGWAQF

SEQ ID NO: 74551 - DNA, 803 bp, Zea mays
  misc_feature: Ceres CLONE 1558960
  misc_feature: Encodes the peptide sequence at SEQ ID NO. 74552
  misc_feature (803)..(803): n is a, c, t, g, unknown, or other
ccccgcggtggcggccgctctagaactagtggatcccccgggctgcaggaattcgtctcacccctagaaaaaacaccttccctcggtcccttccatcttctagccgccgccgccgccgccgctgcccaaaaccctacctaccctcttcttccccctcactctcctttcatctccattctaatggcggcccaacccgtccggcgaagctgctagtgcttgtatctactatcttcatcaggtacttcgccatcctactgaaatattccccgccgccgctgccatggccaccctcaaccctttcgaactcctcggcgccgacgacaacgacgacccgacgcagctgattgcggcggcggcggctgctgctcagaaagccgaggcgaagaagtccgccgtggcgcctgctgggaaggctgcccagcctgcggcgaccaccaagttcccgaccaagcccgctcctccctcgcagacggttcgggatgcacgcggcggtggctcatcagctcgtggaggctttggccgtggtgaacgtggccgtggcagaggtggacggggatatggccagaaccgtggcttcagtggtgacaatggcaatgagttccagggaggttatggtggcggaggctatggggatggtgctgtaactggtggatctgaaggagaaagggagagagagactcgtcccccgtaccgtggcggaggcagacgtggtggttacaggaaatgttcgagttgctgatgactctgagaggccaccacggagaaactatgagcgccacagcgggactggccatggctatgan

SEQ ID NO: 74552 - protein, 152 aa, Zea mays
  misc_feature: Ceres CLONE 1558960
MATLNPFELLGADDNDDPTQLIAAAAAAAQKAEAKKSAVAPAGKAAQPAATTKFPTKPAPPSQTVRDARGGGSSARGGFGRGERGRGRGGRGYGQNRGFSGDNGNEFQGGYGGGGYGDGAVTGGSEGERERETRPPYRGGGRRGGYRKCSSC

SEQ ID NO: 74553 - DNA, 850 bp, Zea mays
  misc_feature: Ceres CLONE 1558961
  misc_feature: Encodes the peptide sequence at SEQ ID NO. 74554
  misc_feature (693)..(693): n is a, c, t, g, unknown, or other
  misc_feature (704)..(704): n is a, c, t, g, unknown, or other
  misc_feature (816)..(816): n is a, c, t, g, unknown, or other
ggagctccccgcggtggcggccgctctagaactagtggatcccccgggctgcaggaattcgtctcacccctagaaaaagtagggcctcttgatcatcagtcgccagaggagctgttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaaggtggtgctggcgccggcgaaccccaaggacgagtaccagcactggatcaaggacatgcggtggagcacgagcatcaaggacgaggaaggttacccggcgttcgcgctggtgaacaaggcgaccggggaggccatcaagcactcgctggggcagtcccacccggtgcgcctggtgccctacaacccggacttcctggacgagtcggtgctgtggacggagagccgcgacgtcggcaacggcttcccgctgcgtccgcatggtcaacaacatctacctcaacttcgatgccctccacggcgacnagtggcacggncggcgtccgtgacggcacccaactcgtggctcctgaaattggtgcgagggcgaccacccagcgctggaagatccagccctactactggaacaacgggatgatatgacatcgngggcccatcgatcgtgcacatgcaatgcatacgt

SEQ ID NO: 74554 - protein, 213 aa, Zea mays
  misc_feature: Ceres CLONE 1558961
  misc_feature (179)..(179): Xaa is any aa, unknown, or other
MDGGYYGGRDQRYSGGYYGGGGIATPGYAPAVPYGMSQVNIEGNGCGRALPPQPTVKVYCRANPNYAMSVRDGKGGAGAGEPQGRVPALDQGHAVEHEHQGRGRLPGVRAGEQGDRGGHQALAGAVPPGAPGALQPGLPGRVGAVDGEPRRRQRLPAASAWSTTSTSTSMPSTATSGTXGVRDGTQLVAPEIGARATTQRWKIQPYYWNNGMI

SEQ ID NO: 74555 - DNA, 765 bp, Zea mays
  misc_feature: Ceres CLONE 1558962
  misc_feature: Encodes the peptide sequence at SEQ ID NO. 74556
  misc_feature (765)..(765): n is a, c, t, g, unknown, or other
acccgcggtggcggccgctctagaactagtggatcccccgggctgcaggaattcgtctcacccctagaaaaaaggccacccaaatccaggtgcatatcccaacctccctccctcccaggccccctccccacctccacctccaggcaccactggtcccacctcctcacctgcgaagatgctgctcgtgagtcaggcagcgaacggctccctctccgcgcggcggctgccgtcgaagccgccggggccgtccaccaccaacccctacccgctcttcgtcatccagattgagaagcccggggatgcggccgccgagtccaagctcgtctcctacacgaagctgggtcttctggccggcggggacgtgttctgccttctgctgttctctgcgattggaaggttcagccatggcctgcccgtcctctacgccgagacgttcaagacggccgaccccttcattgatgggtggctgctgatcgcctaccttcttggcggatttggcgatgatgccaaagggcgcaatggcgtctgaagcgcggttatcaccgcaactaaatcatgggctgttgggataccgttgggacttgctatccgagcagtgacgtctggtcatcttccaccaactccttttatcttggcaaccatgggaagtacaggggtcttgttaactgcatggcgtgctttggtatcacaactgttctgcaaccagcataagcagcacgatgatgtctaccggacgtggcagtcctctttgagctttatgagctn

SEQ ID NO: 74556 - protein, 117 aa, Zea mays
  misc_feature: Ceres CLONE 1558962
MLLVSQAANGSLSARRLPSKPPGPSTTNPYPLFVIQIEKPGDAAAESKLVSYTKLGLLAGGDVFCLLLFSAIGRFSHGLPVLYAETFKTADPFIDGWLLIAYLLGGFGDDAKGRNGV

SEQ ID NO: 74557 - DNA, 800 bp, Zea mays
  misc_feature: Ceres CLONE 1558964
  misc_feature: Encodes the peptide sequence at SEQ ID NO. 74558
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (713)..(713): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnntttttacaagctgggactccccgacggtggcggccgctctagaactagtggatcccccgggctgcaggaattcgtctcacccctagaaaaaagcgcacctcatctcgctccaagcacaccaccactccacagtgcacttcactctacagcaacgacagaaaagtgagcagcaacatcagctgctgccatggaggcgtggagatctctcctcgctagcttcatgctcgccgtgctggccgcacaggccttggtgagccgtggtcgagtccaggacaggccccgtggagcacgcgagccaaggtgacgacatgcagaagcctggactgcgtgccgagggatgcgacccgctgctcgtttacccagggaacgtgcagccggccgacgagcatccacgcccctgtgacgtccatctgcacggaagggctgccaagctgcccccaaacccccgtcccaaacagtcggggcgtcctgccggggttaccgtttccaaaacggccggtcgccaatggggcgggggaaacgcattgccttttttccccggctcccccaagggggcgggatatccccgggattccccggggnnnnnntttctcccccccccccccccccacgaagaaaaaaaacatctcttnttctcccttcccccccccccccccctcccttcctcccccccccccccccccccgttattgtaggggtcggggggggggggctccttt

SEQ ID NO: 74558 - protein, 38 aa, Zea mays
  misc_feature: Ceres CLONE 1558964
MEAWRSLLASFMLAVLAAQALVSRGRVQDRPRGAREPR

SEQ ID NO: 74559 - DNA, 1180 bp, Zea mays
  misc_feature: Ceres CLONE 1558971
  misc_feature: Encodes the peptide sequence at SEQ ID NO. 74560
  misc_feature (1079)..(1079): n is a, c, t, g, unknown, or other
  misc_feature (1122)..(1122): n is a, c, t, g, unknown, or other
tttgtttgtaaaagagaaaggagaaaaggggagagacggcgcccgacgaagacgggagggtacaccacagagagaaagcgggggctccccccggtggcggccgctctataatagtggatccccccggctgcaagaattcgtctcacccctagaaaaagacccgaccaagagaggaaggtcagccagccaaacgccaccgccgccgtgctcgcgccggacgcaactctcagctctctgacgcctcctcctccgtcgattccgacgagagagacgcaaaccaacgaggtacgaaggagcgcaaacatgggagcgggggacggtgaggtcgctgcgagcaaagacaaggccagcggcggcggcgccaagcggacgtcgctggacggcgtgcgggataagaacgtgatgcagcttaagaagattaatacggcgctattccctgtccgctacaatgaaaaatactaccaggacgcaatcagtctccaaggactcctccaaactacagatagtgtgagggatagtttgagttggccgcgatagacttgtcctcctggcagaacgaaagacacgaagagcagatccacagtttatataactgacccttggggtgcgacagggcaaccggaattggagggtgcttggtaattggggaagaaaacctggcttgtaaatcatgtagtgtccaactactcatccatacaataaaagaaattggatctgcgcccgagatggaaagacttgggcttggggttgcatgacccctaagcaaaaccaccactccatcgcctctatttggccttttctttgctcgacctgtgcataaaatatattgtggggagtgtgccacaaggaaactacaccgactcgtgttcgacccttgacgtgttacacagacaacctgaaccacgtgtataaaaccatatcgccaggcaactgacaggcatgagagaaatgaatgataatactttctcaatctgaataaccataaataattcaatagtgttgggccgaagtagatatccgcagtgatacggtaatggagggtagatgggacacactatccaaagcatcatcctctcggncagactcctgtgaatgtgaagaaacgagacttgcatatgtctnccacgcgcctaacggatcttatatcggggtgccgtggaacggttcgaacgacccactg

SEQ ID NO: 74560 - protein, 77 aa, Zea mays
  misc_feature: Ceres CLONE 1558971
MGAGDGEVAASKDKASGGGAKRTSLDGVRDKNVMQLKKINTALFPVRYNEKYYQDAISLQGLLQTTDSVRDSLSWPR

SEQ ID NO: 74561 - DNA, 821 bp, Zea mays
  misc_feature: Ceres CLONE 1558973
  misc_feature: Encodes the peptide sequence at SEQ ID NO. 74562
  misc_feature (537)..(537): n is a, c, t, g, unknown, or other
tggagctccccgcggtggcggccgctctagaactagtggatcccccgggctgcaggaattcgtctcacccctagaaaaattttggttaggaaagaacaaagtagaagaagatgaaagtgatagtgacactgatgtggatgatgaggacattgaagatcttaagagcgcagatgcaaaatctgtagtagttgatgaaggcaattactcaaatggatgcaaaaaaaatgaggagaagcttgatcttggttctgtttctgggtcatcacattcagaaggagagtcttcaggagaaaagtcccaactgacaacaagttcaggagctgaaggtggtgactttgaatctggtgatagtgcagagcttgaggtaggaatgttggatcatcccatttctgttgctgctgcttcagaagaagtgacagcagatgaggataacactgctttagctacttcaaccattataatccagaggtaccacaagttgaagaagtgcggaaagcagacaaggataacactgcttcagctacttcaaacaaaacnatcgagaggtgccacagtagaaacacatggtggcatcagcaactcttattcagaagccgttggaccttgcaaagtacagttcatctgcagaatttgaaggtgcttggctctgagaagctaaaaatagacctgcaatctcgggaattaaatggtggtgggactttaaaaggaacgtggctggccgaacctttccttttgaaaaacaactccctttgaaaagttcccaaaagaacctggtggaaaaacttatggggggaaagcgaaaaaatttcccaatttattaa

SEQ ID NO: 74562 - protein, 210 aa, Zea mays
  misc_feature: Ceres CLONE 1558973
  misc_feature (179)..(179): Xaa is any aa, unknown, or other
GAPRGGGRSRTSGSPGLQEFVSPLEKFWLGKNKVEEDESDSDTDVDDEDIEDLKSADAKSVVVDEGNYSNGCKKNEEKLDLGSVSGSSHSEGESSGEKSQLTTSSGAEGGDFESGDSAELEVGMLDHPISVAAASEEVTADEDNTALATSTIIIQRYHKLKKCGKQTRITLLQLLQTKXSRGATVETHGGISNSYSEAVGPCKVQFICRI

SEQ ID NO: 74563 - DNA, 783 bp, Zea mays
  misc_feature: Ceres CLONE 1558976
  misc_feature: Translation starting site: 171
  misc_feature (587)..(587): n is a, c, t, g, unknown, or other
  misc_feature (588)..(588): n is a, c, t, g, unknown, or other
ccccgcggtggcggccgctctagaactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccaccgtggcgtgcttcctgctccgcttctcgacgggcgggcaggccacgggcaccttcgggctgacgggcgtgtcnngtgtgggaggcgctggtgctggagatcgtgatgaccttcgggctggtgtacacggtgtacgccacgggcggtggacccgaagaagggcagcctgggcaccatcgcccccattggcatcggcttcatcgtggggcaacatcccggggtggggcgggccttccaacggcgcgtcattgacccccggcgtggtcttct

SEQ ID NO: 74564 - DNA, 838 bp, Zea mays
  misc_feature: Ceres CLONE 1558979
  misc_feature: Translation starting site: 119
tggagctccccgcggtggcggccgctctagaactagtggatcccccgggctgcaggaattcgtctcacccctagaaaaaggacgacgcagcgtagcagcagagagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgttctccgccgcgctggcgctgtcgtcggtgctgctgtcctcggccgccacctcccctccgcccgcggccgccgacatcgcggggctgaccccgtgcaaggagtccaaggcgttcgcgaagcgcgagaagaactcgatcaagaagctcaccgcgtcgctgaagaagtacgcgcccgacagcgcccccgcgctcgccatcaacgccaccatcgagaagaccaagcgccggttcgagaactacggcaagttcgggctgctgtgcggcgccgacggcctgccgcacctcatcgtcagcggcgaccagcggcactggggcgagttcgtcaccccgggcctgctcttcctctacatcgccggctggatcggggtgggtcggcaggagctacctcatcgacatcagcggcgagaagtagcccgccatgagggagatcatcatcgacgtcgagctcgccaacccgcctcttccccagggggttcatctgggcccgtcgcccgcttaccgcgagctcatcaacgggggaccttcgtcgtcgacgacaaggacatcggctactactagctgcggctaggtcaacctgcttgcactgggcctata

SEQ ID NO: 74565 - DNA, 905 bp, Zea mays
  misc_feature: Ceres CLONE 1558984
  misc_feature: Encodes the peptide sequence at SEQ ID NO. 74566
ggagctccccgcggtggcggccgctctagaactagtggatcccccgggctgcaggaattcgtctcacccctagaaaaaaccatcacagtacgcacgcacgcacacaccagcccagcagcagaagcgcccctcggccctcgctcccacaacaagctcaagccagccttctctctctgctccaatggcgcgcttccagctcgcagccgtggccatggccatgctcttcgccgcggcggcggcgcaggccccgaccgccaccccgacgccggctcccaaggcgtcccccccgccggcgacgccgccgccgacccccgcgccggtgtctccgcccgtgccgcccccgaccatgcctactccggcgcccgcgcccgacgccaaggccccggacccggcgcccgaggcccccaccccggcgccctaggacgaggctcccactaacgacatgaggtccccaccgatgtaaacagagggcctcgctacgacgcactgcgcggaagctcctgaaccccccagagtcaaggacaactgggagcacccactacgcggagaaggctgtcccccacagcgagggcgcatgaaactccaaagcattaaactggcgctatcgtgatacaaaggccctgcctcaaaaaagacgccgccgcaaccttcgaaatacattgcctcgaagccctacatgcgtaggtttggcaattacaaggtgtttgaaactatgcggggggaagagaacccaaaaaagagggaaaatccaagcctccggccgtgttcggtaatgggtccaaaattttctaaaccgcgaaaaagaaaaatatagcggtggcaataccgagaacgctagaaagtggaacatggaagggggtgtccgggaacccttaaaaaggcaaatggcgctttcgcaggcggga

SEQ ID NO: 74566 - protein, 79 aa, Zea mays
  misc_feature: Ceres CLONE 1558984
MARFQLAAVAMAMLFAAAAAQAPTATPTPAPKASPPPATPPPTPAPVSPPVPPPTMPTPAPAPDAKAPDPAPEAPTPAP

SEQ ID NO: 74567 - DNA, 768 bp, Zea mays
  misc_feature: Ceres CLONE 1558991
  misc_feature: Translation starting site: 186
  misc_feature (141)..(141): n is a, c, t, g, unknown, or other
  misc_feature (155)..(155): n is a, c, t, g, unknown, or other
  misc_feature (166)..(166): n is a, c, t, g, unknown, or other
  misc_feature (174)..(174): n is a, c, t, g, unknown, or other
  misc_feature (175)..(175): n is a, c, t, g, unknown, or other
  misc_feature (359)..(359): n is a, c, t, g, unknown, or other
  misc_feature (401)..(401): n is a, c, t, g, unknown, or other
  misc_feature (455)..(455): n is a, c, t, g, unknown, or other
  misc_feature (467)..(467): n is a, c, t, g, unknown, or other
  misc_feature (479)..(479): n is a, c, t, g, unknown, or other
  misc_feature (482)..(482): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (494)..(494): n is a, c, t, g, unknown, or other
  misc_feature (500)..(500): n is a, c, t, g, unknown, or other
  misc_feature (569)..(569): n is a, c, t, g, unknown, or other
  misc_feature (578)..(578): n is a, c, t, g, unknown, or other
  misc_feature (579)..(579): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (632)..(632): n is a, c, t, g, unknown, or other
  misc_feature (647)..(647): n is a, c, t, g, unknown, or other
  misc_feature (678)..(678): n is a, c, t, g, unknown, or other
  misc_feature (681)..(681): n is a, c, t, g, unknown, or other
  misc_feature (684)..(684): n is a, c, t, g, unknown, or other
  misc_feature (685)..(685): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (730)..(730): n is a, c, t, g, unknown, or other
  misc_feature (734)..(734): n is a, c, t, g, unknown, or other
ctcaccgcggtggcggccgctctagaactagtggatcccccgggctgcaggaattcgtctcacccctagaaaaagctttgctcccgttcccatgctgatttttttaggcggctgctggcctgcctgtctccactggaagcntccggattacgtangaaaaggggcngggcggcnnatgaggatccatgtgcgacgcgtgcgaggccgcggcggccgcggtggtgtgctgcgccgacgaggcggcgctgtgcgcgcgctgcgacgtggagatccacgccgcccacaagctcgccagcaagcaccagcggctcccgctcgggggacgccccgggcgctcccccgccagccttccccggggntggggaaaaaattgtgtccccccaaaaaaaaaaacccccgcncccccggcaaatcctcttctcgtcggcggcggagagaagaaaaagagagggggncccccccccccnctccgttgcggncgncgnnntggtcgnccgcanaaagacgggggagaggagaaaaatcatttctccctcccccccgcgcgtgttttttttttttttaaatanaaaagccgnntccccnnnnnnnnntccccaccccccccccccccccccgagagcggggggggnagggggccgggaggngagggtgactacacgcccccacaccgcgagncgncgnnaccccgggnnnnnnnnnnnnnnnnnnnnnnnnnnnnnnnnnatanaaanatcatcgtctatcccaccctcaacaaaaaaaaaa

SEQ ID NO: 74568 - DNA, 790 bp, Zea mays
  misc_feature: Ceres CLONE 1558992
  misc_feature: Encodes the peptide sequence at SEQ ID NO. 74569
  misc_feature (272)..(272): n is a, c, t, g, unknown, or other
  misc_feature (273)..(273): n is a, c, t, g, unknown, or other
tggagctcaccgcggtggcggccgctctagaactagtggatcccccgggctgcaggaattcgtctcacccctagaaaaaagtctacctcgacagtcgacactcgagagtcgagaccctctcccagcatcaacccgccccgcgctgccctcgtcccgatctccgacccaaatacccgatccaccatggccggaataaggcttacgcccgaggaacccgagatgcccgttggcacgccaccccgcccccagctcccacccttcgtcgcccgcanngcgcgggtgggcggcggaggtctggaaatggcgtcggacgacgagcggtccattgcggcggattcatggtcagtgcggagcgagtacgggagcacgctcgacgatgaccagcgctacgccgacgctgctgaggtgctcgccgcttccgcgtcctccgccaacttcccctccgccgcctccgattacagctctgataaagaagatcaagatcctggtgatgttgaaggatcaatgccggggcttcaaagctattgggatgcttcttaatcggaagatctggcaaatgttcaggaacatgggcacactggagaaatatggcttggcgcagatgtaatggacacagttgctgtttggaccaaaaccttgcgtaacattattgaaggccacattccatctggtcaagacaacatccaaagtgaaggcaatgaaaatttattctccgactaccctgaatcttgatgaggcaaccggatatgggcctcttctgcaagcaatggctgaacgagtctttacaaac

SEQ ID NO: 74569 - protein, 118 aa, Zea mays
  misc_feature: Ceres CLONE 1558992
  misc_feature (30)..(30): Xaa is any aa, unknown, or other
MAGIRLTPEEPEMPVGTPPRPQLPPFVARXARVGGGGLEMASDDERSIAADSWSVRSEYGSTLDDDQRYADAAEVLAASASSANFPSAASDYSSDKEDQDPGDVEGSMPGLQSYWDAS

SEQ ID NO: 74570 - DNA, 810 bp, Zea mays
  misc_feature: Ceres CLONE 1558994
  misc_feature: Encodes the peptide sequence at SEQ ID NO. 74571
ctccccgcggtggcggccgctctagaactagtggatcccccgggctgcaggaattcgtctcacccctagaaaaataacgcaaagttgggtggcttgaattcgttgctccaaattgaaacatccccagcaattcctctcgtatccaaggtcccaactataatcttgggtatggacgtatcacacggatctcctggacattctgatataccgtctgttgctgctgttgttagttctcgtgaatggcctcttatctcaaaatacagagcatgctgtccgcacccaatcaccaaaaatggaaatgattgactcattgtttaagccacgggaaactgatgacgatggtctgattcgggagtgtctgattgacttctacaccagttcaaggaagagaaagcccgaccaagtcatcatcttcagggacggtgttagtgaaagtcagtttaaccaggtgctgaacattgagttgcaacaaatcattgaggcttgcaaatttcttgatgagaaatggaatcccaagttcacattgatcattgcccagaagaatcaccacactaaatttttcattcctggaaagccagataatgttccagccggcactgttgttgacaacaaaatctgtcatccaaagaacttcgatttctacatgtgttcacatgctggaatgattggaactaccaggccaactcactaccacatcctgcatgacgagataggctttcatactgatgacctggcagagctggtgcactcgatctcttacgtgtaccaaacgagcacacagccatatcagttgttgctacgatctgacaa

SEQ ID NO: 74571 - protein, 172 aa, Zea mays
  misc_feature: Ceres CLONE 1558994
  misc_feature (2)..(170): Pfam Name: Piwi Pfam Description: Piwi domain
  misc_feature: The sequence is a functional homolog of SEQ ID NO 2 in the 11/375,241 US patent application
  misc_feature: The sequence is a functional homolog of SEQ ID NO 2562 in the 10/374,780 US patent application
  misc_feature: The sequence is a functional homolog of SEQ ID NO 188 in the 10/666,642 US patent application
MEMIDSLFKPRETDDDGLIRECLIDFYTSSRKRKPDQVIIFRDGVSESQFNQVLNIELQQIIEACKFLDEKWNPKFTLIIAQKNHHTKFFIPGKPDNVPAGTVVDNKICHPKNFDFYMCSHAGMIGTTRPTHYHILHDEIGFHTDDLAELVHSISYVYQTSTQPYQLLLRSD

SEQ ID NO: 74572 - DNA, 819 bp, Zea mays
  misc_feature: Ceres CLONE 1558995
  misc_feature: Encodes the peptide sequence at SEQ ID NO. 74573
ggagctccccgcggtggcggccgctctagaactagtggatcccccgggctgcaggaattcgtctcacccctagaaaaaccccccaggggggcggggcaccacaggtactcttctcctgcttggcctcttgtgccgcaaccgcgagtgcggcctacggtagcctccaaagcagcacatccaaagcagggaccgaatggaatgtgaccggccggaggaggaggggcagcagcggagggagacgatgacgccggtgctcctcaggctgttcggcgtggacgtccaccggggtggcggcagcggggagccggaggagtcgccgatggacctgaggaagagctccagcatgcccgacctcaccatcaacccgctgctgtcgccggaggagaaagagggctgcaaggggtacgcctccgacgacgcggagctggcgtccggccagcagaagcgccgccgtcgcaaggcacaggacaggaagaaaggaattccatggaccgaggaggagcacaggaagttcctggacgggctaaggcagctgggcaagggggaactggaggggcatctccaagggcttcgtcaccaccaggacgggcgacgcaggtggccagccacgccccagaagtacttcctccggcagaccaaccccggtatgaagaaacgccgggcgagcctcttcgacgtcggtatcgcggactacaaggaccaccaggtgccaggccctcagagcatcgtcgctgcccaaaccggcgcctacgcaggagataattcacaccgaccggcggcgacgtccccatacaagaaatatagagccctcggagagat

SEQ ID NO: 74573 - protein, 208 aa, Zea mays
  misc_feature: Ceres CLONE 1558995
MECDRPEEEGQQRRETMTPVLLRLFGVDVHRGGGSGEPEESPMDLRKSSSMPDLTINPLLSPEEKEGCKGYASDDAELASGQQKRRRRKAQDRKKGIPWTEEEHRKFLDGLRQLGKGELEGHLQGLRHHQDGRRRWPATPQKYFLRQTNPGMKKRRASLFDVGIADYKDHQVPGPQSIVAAQTGAYAGDNSHRPAATSPYKKYRALGE

SEQ ID NO: 74574 - DNA, 844 bp, Zea mays
  misc_feature: Ceres CLONE 1558996
  misc_feature: Encodes the peptide sequence at SEQ ID NO. 74575
ggagctccccgcggtggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgcccgcaacggcgtcaagttcggcgaggccgtgtggttcaaggccgggtcccagatcttcagcgagggcgggcttgactacctcggcaacccgagcctgatccacgcgcagagcatcctggccatctgggcgtgccaggtggtgctcatgggcgccgtcgaggggtaccgcatcgccggtggccgcctcagggaaagtgggtcgacccgctgtaccccggcggcagcttcgaccccgctcgggctcgccgaacaacccggaagcgttcgcggagctcaagggtcaggagatcaagacgggccgctccgcaatggtctccaatgttcggcttcttcgtgcaagc

SEQ ID NO: 74575 - protein, 226 aa, Zea mays
  misc_feature: Ceres CLONE 1558996
  misc_feature (58)..(197): Pfam Name: Chloroa_b-bind Pfam Description: Chlorophyll A-B binding protein
MALTSRALVGKPATSTRDVFGEGRITMRKTAGKPKPAASGSPWYGADRVLYLGPLSGQPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVVLMGAVEGYRIAGGRLRESGSTRCTPAAASTPLGLAEQPGSVRGAQGSGDQDGPLRNGLQCSASSCK

SEQ ID NO: 74576 - DNA, 794 bp, Zea mays
  misc_feature: Ceres CLONE 1559001
  misc_feature: Translation starting site: 435
  misc_feature: SWISSPROT Homolog: EC 1.11.1.6 Catalase
ggagctcaccgcggtggcggccgctctagaactagtggatcccccgggctgcaggaattcgtctcacccctagaaaaatagttccactggaagccgacgtgcggcgtgcggtgcatcctgacggaccaggaggctgccctggtcgggggacggaaccccccccacgcgacgcaggacctgtactactccctgtggccagggagcttcccagaccggaccctgtacgtgcaggtgatggagccggacacggaggaacagtacaacttcggacccgctggacgacgccctgacgtggcccgacgacctgctgcccctccgccccgtgtggaggctggtgctagacacgaacgtgtacaacttcttcagcgagaacgagcagctggcgttccccccggggctggtggagccaaggaatctactactgctacgacaagatgctgcattgctcgggtgatgcgctacacccactggcaacactacaggctggggtcccaactaccttgatgctgcccgtctgcgcggcgcgctgctcgcaccactgctaccactacgacggcgccttgaacttcatgccctctgacgaggaggtggactactacccgtcgaggcaccctccgctgctgcatgcggtgccgcccccgccactgccgcccaggcccgccgctgggacgatggataaagcagcggtccttaacccccaactacttcaagctccccgggtgagatgatactgctcctggggactcccgacagacgtgacacgactcctgaagtggatttcaacagaatggctt

SEQ ID NO: 74577 - DNA, 804 bp, Zea mays
  misc_feature: Ceres CLONE 1559004
  misc_feature: Translation starting site: 108
  misc_feature: Pfam Name: YGGT Pfam Description: YGGT family
  misc_feature (410)..(410): n is a, c, t, g, unknown, or other
  misc_feature (663)..(663): n is a, c, t, g, unknown, or other
ctccccgcggtggcggccgctctagaactagtggatcccccgggctgcaggaattcgtctcacccctagaaaaaaaaggccgagcagaggcagaggcagttcctctcatggaggcgtccttgctcgtggctcccaagccttccatgcccaggaccatcttctccgccaggcgagccggtcggagttggaggtgcctcgtcgtcgctgccaccatcaagcaacaactcggcacacggtcagaaagtgtggacgtcgatgcgccggtcgagcacctagcgccgccttcgaaggcgacgacgggagctcgcggcggcctgctcgccgccgtggcgacgacgacgagcagctgcacggcagtgttaccgtgtcacgccttatcaggcgccggagcggtggaatcgggaccgtgngtggtggacgtcgccgctggacaccctgtaccgcgcggcggcggtgctgggcgacctggacccggcgacggctcgggcggtggcgggcgtggcggggccggtgctgtcggcgttcggcttcctgttcatcctgcggatcgtcatgtcgtggtacccgaggctccccgtgacggagttcccgtacggtggtggcgtacgcgccccacggagccgtttcctcgccgtcacgcgcatggtcatcccgccgctcggncggcgtcgatgtccacgcccgtcggtctggttcggccctcgtcagcttcgccagcggagatcctcgtcggggcacaggggccttgctcgtttctcctctcgcagcagcgctagcgaaccacttgcgtttcctgcttccatt

SEQ ID NO: 74578 - DNA, 942 bp, Zea mays
  misc_feature: Ceres CLONE 1559005
  misc_feature: Encodes the peptide sequence at SEQ ID NO. 74579
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (66)..(66): n is a, c, t, g, unknown, or other
  misc_feature (73)..(73): n is a, c, t, g, unknown, or other
  misc_feature (74)..(74): n is a, c, t, g, unknown, or other
tttttttttnnnnnnnnnnnntttggggnnnggnnntgtttnnnnntggnnnnnnnnnnnnaggtntaatttnntttttaaaactggagctccccccggtggcggccgctctagaactagtggatcccccgggctgcaggaattcgtctcacccctagaaaaaatccgacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgcctagatcgtcaacccgccctggctcgacgggctcgctccccggcgtacttcaggattcagacaccgctgtgcgctgggacataggacccgtgctgttccctcaagtcggtgaccgcgggaggccgggagcttgaatccccaccggtcgggtggggggcgtattggccggggccccgttggcatgggggccatttctttcccgttgggggggcaaagggccctttgggaaaggggggcccaaatccccccgttgggcctttcccaaaaggacccccggggcccccggggaaaccccccggaaaaggggggcccattttgggggggggcccccttttttgtttcccttttttggggggggtccccccttttgccctggggggggccaaccgggcaaaaaccttttgccctgggccctgtaaaattgggggcgcttgggggggctctgggaaaaaatccccaacaaaaacccgggttttgcgcccccccgggagaaattttcccttttttttaaacacaccccgcgggagaaacacctcccccccaagggggccccctttggggggaaaaaac

SEQ ID NO: 74579 - protein, 51 aa, Zea mays
  misc_feature: Ceres CLONE 1559005
MALAPTSAAVLKTPFLGARRALAKPAPRRALVIAAAAAAKKSWIPAIKSDA

SEQ ID NO: 74580 - DNA, 703 bp, Zea mays
  misc_feature: Ceres CLONE 1559006
  misc_feature (580)..(580): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
ctccccgcggtggcggccgctctagaactagtggatcccccgggctgcaggaattcgtctcacccctagaaaaaaaccctcacactcccatccaggcgactccaggtgcaaagtctttcgtcttctcttctgcggcgaagaacccccagtcgcccaccagatcacttgttaaaatttgttgacgggtagatggcggtttctttcgcagacctcaactccggatgcagggccttagaagactcatcactacttctgagtcgaagactactcctggctacaagctgctaggatgactgggctgctgcacctcgatttccgggtggcgcccccgctgcaagatatctaacggttccaagcggggttttaaaccccccgtttaaaacccccccctccctttaaaaaggcgtggggccgaaattttttttcccaaggggcacagggggtgcggggggtaaaaattctccgggggtgttttttttcccccccccccccccgaaattttgttttgtttttaaaaaaaaaaggccccccccccttgtttttgagggggggccccccaccccccgggggtggttgtttnccccccctcctttttttggggggggggcccccccccaaatattttttttaaannnnnaaaaccccgctctgcaaaaaaaaaaaaattttttttttctccccccccccaagggggtgtggtttg

SEQ ID NO: 74581 - DNA, 823 bp, Zea mays
  misc_feature: Ceres CLONE 1559007
  misc_feature: Encodes the peptide sequence at SEQ ID NO. 74582
  misc_feature (548)..(548): n is a, c, t, g, unknown, or other
  misc_feature (562)..(562): n is a, c, t, g, unknown, or other
  misc_feature (570)..(570): n is a, c, t, g, unknown, or other
ggagctccccgcggtggcggccgctctagaactagtggatcccccgggctgcaggaattcgtctcacccctagaaaaagcttcactcgcgtccgcccccgccgccgcctttcgtcccagcccctaaaccattctccattcctctcatcagtttagcacaatggcactggctaataagcttggtggtctgctcaagaaagccacaagttcaaatctgtctgtctaccaagcaatcagatgcatgtcatccaagctctttgttggagggatttcttatcaaactgatgatcacagtctcagggacgagtttgccaaatatgggcaagtcattgaagctaggattatcattgaccgtgaatctgggaggtctagaggttttggctttgtaacttacacgtcttctgaggaggcttcagctgccattactgccttggatggaaagactctcgatggacggagcatacgtgttaatcatgctaacgagaagacaggtggctttcgtggcggcggtggctatggtggcgcggcacggggtggagaaaaaaaaangggggggggggggnagggggtnagggggggggggaaggtaaggggggtggtgaaaccgggggggaatacggtggccgggactttggtggcaacgcaacaagggtgcgtcgtgtcaaaaatgaaggaacccctgttaaaaaggtgtccccaccttttaaggggtggaagggggggacgattttatgcctaaaaccaaattttggatttcggaacccacaaatctttgcccaaaaaaaaaaaaaaccgtttttccctaagaaacaatcccctacttt

SEQ ID NO: 74582 - protein, 192 aa, Zea mays
  misc_feature: Ceres CLONE 1559007
  misc_feature (32)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (130)..(130): Xaa is any aa, unknown, or other
  misc_feature (135)..(135): Xaa is any aa, unknown, or other
MALANKLGGLLKKATSSNLSVYQAIRCMSSKLFVGGISYQTDDHSLRDEFAKYGQVIEARIIIDRESGRSRGFGFVTYTSSEEASAAITALDGKTLDGRSIRVNHANEKTGGFRGGGGYGGAARGGEKKXGGGGXGVRGGGKVRGVVKPGGNTVAGTLVATQQGCVVSKMKEPLLKRCPHLLRGGRGGRFYA

SEQ ID NO: 74583 - DNA, 834 bp, Zea mays
  misc_feature: Ceres CLONE 1559009
  misc_feature: Encodes the peptide sequence at SEQ ID NO. 74584
  misc_feature (431)..(431): n is a, c, t, g, unknown, or other
ctggagctccccgcggtggcggccgctctagaactagtggatcccccgggctgcaggaattcgtctcacccctagaaaaacacacacacacacacacacacaaagcgcacttttcaaatcgacaaaggggaaaggttcgcttcttctcgcatcttgctttacttcgagtgccatggccgatccggcggaggagaacgttgtctcgccgccaccgacccctgcggccccagccgtgggcgcctcagactcgcccctgcagcctgttgctgacggcgcctcaacggagaaggtgtctgccccggcgccggaggtaaggtcccggggattcaggcttcttggagaggacacttccgtgcacaaatcccttgggggcggtaaaactgctgacgttctgttatggacagacaagaaaacttctgctgttgtaatangcggcgcaactgtcatctgggtttctgtcgaagtgcttgattaccacctcctgaccctgatatcccatgtactgattggtgtgcttgccaccttattcctgtggtcccaaagcaccacgttcatcaagaagagtccaccggatatcccagtagtgcaagtatctgaggacttggttgtgattgtttcccgggctttaccgaatgacatcacgaaccgcttcctttgttcggtgaaatcccatggggcatgatccgaaaaaatttttggggggtgaacccggggccttggggtctctccccggattggaaaccgctgtgacctcccccatttgaacaaacttggccgcccgagcccccccaccgggcccatttttttaaaaagtcccccgaaaagggggggccc

SEQ ID NO: 74584 - protein, 169 aa, Zea mays
  misc_feature: Ceres CLONE 1559009
  misc_feature (70)..(167): Pfam Name: Reticulon Pfam Description: Reticulon
  misc_feature (87)..(87): Xaa is any aa, unknown, or other
MADPAEENVVSPPPTPAAPAVGASDSPLQPVADGASTEKVSAPAPEVRSRGFRLLGEDTSVHKSLGGGKTADVLLWTDKKTSAVVIXGATVIWVSVEVLDYHLLTLISHVLIGVLATLFLWSQSTTFIKKSPPDIPVVQVSEDLVVIVSRALPNDITNRFLCSVKSHGA

SEQ ID NO: 74585 - DNA, 880 bp, Zea mays
  misc_feature: Ceres CLONE 1559010
  misc_feature: Encodes the peptide sequence at SEQ ID NO. 74586
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaaaactggtagctcaccgcggtggcggccgctctagaacagtggatcccccgggctgcaggaattcgtctcacccctagaaaaaaagacacacaccgctgcttcaagaaaccaccgagagcccaaccgcacaggcaggagagagagcagggagccagggacagtagcgtggggccggtgagcaacgatggaggggaaggatgaggacgtgcacctgggcgccaacaagttctcggagcgtcaacccatcggctcggccgcgcagggcgccggcgccggggacgaccacaaggactacaaggaagaccccacaggcaccgctattcgaagccggagcagctcaagtcctgttccttctaccgcgcgggcatcgcacgaggtcgtagccacctttgctctttctcgacatcaccggtactcactgtccatgggccgtctacaagtccagcctgcaaattgcaccacccgttacgcattccaaagccatccgcatgggccctttccgtaagggatggatcgttagggggctagttctttcttgccaccgccggggacttcctccgggaaaggaaaaaagttaatcccccagccccggttaacccccttccgggggttggtttaccgggggaaaccaggagaaaggcgcgttcccccctggaacccaaaaggaaacctacccttttttaaaacactttttgaaatgggccaaatttccccccctgggggggttgcccccccctctctttggtgtaaaaccccgtggaaaaaaggggggggtgaaaaaccc

SEQ ID NO: 74586 - protein, 106 aa, Zea mays
  misc_feature: Ceres CLONE 1559010
MEGKDEDVHLGANKFSERQPIGSAAQGAGAGDDHKDYKEDPTGTAIRSRSSSSPVPSTARASHEVVATFALSRHHRYSLSMGRLQVQPANCTTRYAFQSHPHGPFP

SEQ ID NO: 74587 - DNA, 804 bp, Zea mays
  misc_feature: Ceres CLONE 1559013
  misc_feature: Encodes the peptide sequence at SEQ ID NO. 74588
ctccccgcggtggcggccgctctagaactagtggatcccccgggctgcaggaattcgtctcacccctagaaaaaatccccgttctcgctacgcccctgtctctccccgccgccaccctgccccggcgccgtagagcacggcgctggcccttgtttccctcccccggccggacctcggaagtatgtctcgggccatcgaatcgacaatgaggcaatctcggcagtttgtgaatctgatcatgaccaatctttacaacggcgccaagtccctgcacttcgtggacctgaagcggcagccactatttaagacaccactgccacctacggcatctacagacggagacagatttgaaacacaagacgctttctctcagacacagccaactgaatccttggtgttggagagacttcgccttccccgtccgagcttccaattcgaaacttccactgcacaagatcgcagctggtacattaactgcttaccgctttccgatcgcgtggtgttctgctcggatcagtgtggacacaactttgtggttgatggtatcgcacgttgtcttgtaaccatgcccagcctccacaaacgtaagatgatgcccctctccatcttcatacccagcactgatgtcgaaggcggtggcagcctcttccttgtggataggtcacccggcatcacggctacaagggggggaatttgagtcccttagtgtaccgcaaagcaagcttcagcaaacacctactacctgggaagggctcaactcctcccacaggcaccgtacccccttttaaccctcctacttccggg

SEQ ID NO: 74588 - protein, 163 aa, Zea mays
  misc_feature: Ceres CLONE 1559013
MRQSRQFVNLIMTNLYNGAKSLHFVDLKRQPLFKTPLPPTASTDGDRFETQDAFSQTQPTESLVLERLRLPRPSFQFETSTAQDRSWYINCLPLSDRVVFCSDQCGHNFVVDGIARCLVTMPSLHKRKMMPLSIFIPSTDVEGGGSLFLVDRSPGITATRGGI

SEQ ID NO: 74589 - DNA, 824 bp, Zea mays
  misc_feature: Ceres CLONE 1559014
  misc_feature: Encodes the peptide sequence at SEQ ID NO. 74590
  misc_feature (601)..(601): n is a, c, t, g, unknown, or other
acccgcggtggcggccgctctagaactagtggatcccccgggctgcaggaattcgtctcacccctagaaaaatcctcacctcccttccattgcagtcttccaccttgcttcgcggaggcagctgaagcaatctggagcaagcagagtagaggccggctcctcccaccccgcaggcaggcttggacgccccccaggcgaggagtagcgcgtcctcctcccctgatttccagatcaggccgctctaccccaaccccgccacctcgacatcctgcgccgacaagctcttccacggaggggtgctcctcccgcttcccatactcccaccgaatcccgagtccactaacaaacgcagacgcgtcacccaatacgtgcgcctccctcatccggagccagaatcgcaccctccgcaagcgtcactgctagcaaccgatgcggctcctacggactctatgacgttacaggcgccgtccactggtagcggaagacgagggtcgaatcgctggaccgagctctttctcaacaaacgggctcccggcagcgacgacatggaccggacaagacaaggacaaccgaaggatgggccctgtcgcgggaaacaggnaaacgggcacccgggaggaccgggctccgaaactaaaaatccacatttgccccttcttccacgaacccgttttggccgggggaagggacctgcttcaatcaagcccgggtccggcccccccagggaaggaaaacaaacccgccccttggtcccccaaggaaactcccctggggtaagaggaggtgtccccccttgtttccagggggtgttgggcggagaaaaa

SEQ ID NO: 74590 - protein, 125 aa, Zea mays
  misc_feature: Ceres CLONE 1559014
  misc_feature (51)..(51): Xaa is any aa, unknown, or other
MTLQAPSTGSGRRGSNRWTELFLNKRAPGSDDMDRTRQGQPKDGPCRGKQXNGHPGGPGSETKNPHLPLLPRTRFGRGKGPASIKPGSGPPREGKQTRPLVPQGNSPGVRGGVPPCFQGVLGGEK

SEQ ID NO: 74591 - DNA, 798 bp, Zea mays
  misc_feature: Ceres CLONE 1559017
  misc_feature: Translation starting site: 282
ctccccgcggtggcggccgctctagaactagtggatcccccgggctgcaggaattcgtctcacccctagaaaaactcttttttcacccttgccctctcgccgccgcggccgtgcccaacgatcgagctcctaccctgcaccgagctctgcccgggcccccgcacatgaacttcgaccagcaccccaccctcctacatcgtgcctgaccaacctggcattccctgacaaccataatcttcgtgccttttatgacccatcgatctcccactacgtcagtggtgatgctctgggtgaggagtgttaagggttatgtcttcgacatcatgggcggatgtgacatacaaggcttcccaatgaaacttcgagttctgacttctggtcttgtccgccttctgctccacagacgctctcccctgcttgctctggttatggcaggcctaatggtgcatcgcagcgaggaacctctgtccgtggttgtattgtacagacaacacctatctgttatctacttggtgattgttaagaagggcgaaaacaatccgcctggcttagctgacactgaaaagccaaggatgaggggtcccccaaaggcctcccagatcatgcaactgtgcaagcttgccatgatgacaacttgcacaagtacctgaacgcgtacctcaggacattatctacttagaatggcaatatagtgagcaacgcgcctaacatccagaggctgtgtagacccccttgaccctcccaaatgaaccttgcgtctattgctgacattaacgagtacgatctcgtaggaagaat

SEQ ID NO: 74592 - DNA, 798 bp, Zea mays
  misc_feature: Ceres CLONE 1559018
  misc_feature: Encodes the peptide sequence at SEQ ID NO. 74593
ctaccgcggtggcggccgctctagaactagtggatcccccgggctgcaggaattcgtctcacccctagaaaaaaagaaccaacgtgctcgatctccatctcgaccgtcgctcaccgggaagctacgctacgacgaagcatggcgtccgtcaccgcccgcgccccggtcgcggccctgcgcccgtcggcgtctctcaagtcgtcgtcgtcgtcggcggcggccttccttggccactctagccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgggctgatcaacgcgccgcagtggtacgacgccggcaagtcggagtacttcgcgtcgtcgtcgacgctgttcgtgatcgagttcatcctgtttcactacgtggagatccggcggtggcaggacatcaagaaccccggcagcgtcaaccaggaccccatcttcaagagctacagcctgccgccgcacgagtgcggctaccccggcagcgtcttcaacccgctcaacttcgcgcccacgctcgaggccaaggagaaggagctcgccaacgggaggctggcccatgctggcgttcctggccttcct

SEQ ID NO: 74593 - protein, 220 aa, Zea mays
  misc_feature: Ceres CLONE 1559018
  misc_feature (62)..(215): Pfam Name: Chloroa_b-bind Pfam Description: Chlorophyll A-B binding protein
MASVTARAPVAALRPSASLKSSSSSAAAFLGHSSRLGRTATASPTRRSLKAEAKGEWLPGLPSPAYLDGSLPGDNGFDPLGLAEDPENLRWYVQAELVNGRWAMLGVAGMLIPEVLTKAGLINAPQWYDAGKSEYFASSSTLFVIEFILFHYVEIRRWQDIKNPGSVNQDPIFKSYSLPPHECGYPGSVFNPLNFAPTLEAKEKELANGRLAHAGVPGLP

SEQ ID NO: 74594 - DNA, 768 bp, Zea mays
  misc_feature: Ceres CLONE 1559019
  misc_feature: Encodes the peptide sequence at SEQ ID NO. 74595
  misc_feature (515)..(515): n is a, c, t, g, unknown, or other
ctccccgcggtggcggccgctctagaactagtggatcccccgggctgcaggaattcgtctcacccctagaaaaaggtacaggacgatgccgttcatcatccgctgcaaaccaccaggcaccagctccgcgcgcagaggccggaggactacgaccgacgagggcgaccaacaccaaggctccgaagtccgaggaggcaggaagcgggaggacgtccggaatgggcgctgctcgtgactccgcggcggcgggccagaagcacggcaccggcacgcgatgcgagctctgcgggggcgcgagcggccgtgcacatgggccgcggactctgcgttcctctgcctgcgctgcgacgccaatgtgcacggcaccaacttcctggcgtccaggcacgtgaggaggagcctgatgacccgccggggcaccgaccccgagacctcgtcagccgcgtccagccgatcctcctgcgtgtccgcgggctactccccgagtcggtcacaggcagcgtgtacagcccccnaggacgcgacggcgacggctccgaatcttgcgcgtcgtctccacgctgattcgggaccgaatcgtccggctaccctaaggggaaaccgggggggggcgggacatcaagaaaccccggaaggggtaaccaggaaccccctcttttaaaaactacagcccttgccgcccgccaaaagggggggttacccccggggggggtttttaaacccgttttaaatttgcgggcccccccctcaggggccccagaaaaaaag

SEQ ID NO: 74595 - protein, 128 aa, Zea mays
  misc_feature: Ceres CLONE 1559019
  misc_feature (81)..(81): Xaa is any aa, unknown, or other
MRALRGRERPCTWAADSAFLCLRCDANVHGTNFLASRHVRRSLMTRRGTDPETSSAASSRSSCVSAGYSPSRSQAACTAPXDATATAPNLARRLHADSGPNRPATLRGNRGGAGHQETPEGVTRNPLF

SEQ ID NO: 74596 - DNA, 826 bp, Zea mays
  misc_feature: Ceres CLONE 1559020
  misc_feature: Encodes the peptide sequence at SEQ ID NO. 74597
  misc_feature (797)..(797): n is a, c, t, g, unknown, or other
agctccccgcggtggcggccgctctagaactagtggatcccccgggctgcaggaattcgtctcacccctagaaaaaacgaattccccattcccttcccccatcgcatcgagagccaggccagccagccacctctgctaggtctccatggccgccgcgctcaggtccccggcctcggccaaggtctcgagccccgccgccgcctccaaggtgcgccaggcgtccagagtcgcggtgggcgggttccggcagcatccgcggagccgtgtcggccccgtggccgtgcgggcgtcgctgttctcgcccaagcccgcggcggccaaggacgcgcggccgaccaaggtgcaggagctgtacgtgtacgagatgaacgagcgggaccgcgagagccccgcgtacctgcgcctcagcgccaagcagacggagaacgcgctgggcgacctggtccccttcacaaacaaggtttacaacggcagcctggacaagcggctgggcatcaccgccggcatctgcgtgctcatccagcacgtccccgaccgcaacggcgaccggtacgaggccatctacagcttctacttcggcgactacggccacatctcggtgcagggcgcgtacctgacctacgaggagtcgtacctggccgtcacgggcgggctccggcgtcttcgagggcgcctacggccaggtcaagctccaccagatcgtcttccccttcaagatcttctacaccttctacctccggggcatcccggacctgcccagggacctgctctgcacgccccgtcccgcccctccccancggtcgagcccacgcccgccgccagggcc

SEQ ID NO: 74597 - protein, 227 aa, Zea mays
  misc_feature: Ceres CLONE 1559020
  misc_feature (59)..(227): Pfam Name: Allene_ox_cyc Pfam Description: Allene oxide cyclase
  misc_feature: SWISSPROT Homolog: EC 5.3.99.6 Allene-oxide cyclase
  misc_feature (218)..(218): Xaa is any aa, unknown, or other
MAAALRSPASAKVSSPAAASKVRQASRVAVGGFRQHPRSRVGPVAVRASLFSPKPAAAKDARPTKVQELYVYEMNERDRESPAYLRLSAKQTENALGDLVPFTNKVYNGSLDKRLGITAGICVLIQHVPDRNGDRYEAIYSFYFGDYGHISVQGAYLTYEESYLAVTGGLRRLRGRLRPGQAPPDRLPLQDLLHLLPPGHPGPAQGPALHAPSRPSPXVEPTPAARA

SEQ ID NO: 74598 - DNA, 778 bp, Zea mays
  misc_feature: Ceres CLONE 1559023
  misc_feature: Translation starting site: 273
  misc_feature (678)..(678): n is a, c, t, g, unknown, or other
ctcaccgcggtggcggccgctctagaactagtggatcccccgggctgcaggaattcgtctcacccctagaaaaagctgttcttgctgagttgttgtggacaaaaagagcacaaaagtgggtagggcaagccaaccacactcgcagccagcctgcctgctcgcccgcccgccattcttgccgattcgagtcgacgtcacgcctccggcgcccccttcggttgtcacctcgggggtcgcggattggtggagtggaggatttgagcggcgcggccatggatacaacctctagggccgccaagatcccgtcgctccaccagacggagatcaactgggataacctcgacaagaccaagctctacgtggtgggcgcaggcatgttcagcggggtcaccgtggcgctgtaccctgtatcggtggtcaagacccggatgcaggttgcctctggggatgccatggggaggaacgcgctggctaccttcaagaacatccttaaggtggacggcgtgccagggctgtacccgggggtttcctactgttataattggggctgtaccaactaggattatcttcatcacggcgcttgagacaaccaaagcagcctctctcaagcttgttgagcccttcaagctgtcagagccggtgcaggccgcctttgccaatggccttggcggtctgtcngcatccacatggtcgcaggctatttttgtccaaattgatgtatcagccagaattgatggttcaagggaatccctggtatgccaatacaagagggggagtg

SEQ ID NO: 74599 - DNA, 786 bp, Zea mays
  misc_feature: Ceres CLONE 1559025
  misc_feature: Encodes the peptide sequence at SEQ ID NO. 74600
  misc_feature (751)..(751): n is a, c, t, g, unknown, or other
ggagctcaccgcggtggcggccgctctagaactagtggatcccccgggctgcaggaattcgtctcacccctagaaaaaatcgccgggatccagatcgttcttcctcttgcccgccgattcgttccaccaccgcgaaagccacacagagagcaggagagacaatccagagagatcggcgccatgaacgacctcatgactaagtccttcatgagctacgtcgacctgaagaaggcggcgatgaaggacctggaggcggggggcgacgggatcgagctcccggagtcgggcgccggcggcgtcacggacgagcgcctgcgcggattcttccaggaggccgaggcggtgaaggcggagatggcggccatccgcgacgcgctcgaccgcctgcacgccgccaacgaggagggcaagtcgctgcaccaggtcgacgccctccgcgcgcaccgcggccgcgtcaacgccgacatcgtcgccgtgctccgccgcgcccgcgacatccgcgccaggctggagtccctggaccgcgccaacgcgcgcaggggaggctctccccggggtgcgcgagggcacgccgctgggacgcacgcgcaccggccgtaccttgggggctccggaagaagctcagggaccttatggtcgaatttccaggcctttcggaaccgaataaaggtccaaaaaaaaaggaaccgggggagggggccttttaacccctccccgggggagggccccccaagggggaggggggtttgangccccttttcctccaaaggggggggcggaagagcc

SEQ ID NO: 74600 - protein, 189 aa, Zea mays
  misc_feature: Ceres CLONE 1559025
  misc_feature (44)..(141): Pfam Name: Syntaxin Pfam Description: Syntaxin
MNDLMTKSFMSYVDLKKAAMKDLEAGGDGIELPESGAGGVTDERLRGFFQEAEAVKAEMAAIRDALDRLHAANEEGKSLHQVDALRAHRGRVNADIVAVLRRARDIRARLESLDRANARRGGSPRGARGHAAGTHAHRPYLGGSGRSSGTLWSNFQAFRNRIKVQKKRNRGRGPFNPSPGEGPPRGRGV

SEQ ID NO: 74601 - DNA, 831 bp, Zea mays
  misc_feature: Ceres CLONE 1559027
  misc_feature: Encodes the peptide sequence at SEQ ID NO. 74602
  misc_feature (817)..(817): n is a, c, t, g, unknown, or other
ctccccgcggtggcggccgctctagaactagtggatcccccgggctgcaggaattcgtctcacccctagaaaaaacaaacagcgccgcgctccgcattgagctagggttttagaagtcttcctccggtcctcaccgttatccctccaaaaggaagcgcccgctagggttttagccgccgcctccttccctctcctcctccacgtctcctcaacagcacgctgacacccggaaccttcccgcagcgacgccatgtgggctcttccccgagctggcaaccccctcaggttccgtgcccaaaaagttgcaagtgcccatgtctgtgcgagtcttgaggtgctgctagctgctgatgcgaagaatgtagaagagcaccatgaggcagactgccagaaaatgtgctgctgtcataaaccaaggtcaccagcctttcaattgtcatttacatctggccagtttgcttgcagtaggggttactcctctcagccaagtgcaaattatggtgacaaagctgatgagtgataggacggatattctgatctcgaggttccaccagcagctgtacaaaacgatgacgggttggcatctgaagatagctctgatgaggatgctgctgacgaatttggcttgcctgatgtggatgctgatgcaaaagctgataacgagcacactagaagatcatctgattctacttctctcaagacattatctgaatctattctcctcaagactgtgttagaagctccgaagcatcaagtcacttcagcacttgagaaatgggcataggatggcaatgcattttgatatggaggaactctnatatgttcgttctt

SEQ ID NO: 74602 - protein, 89 aa, Zea mays
  misc_feature: Ceres CLONE 1559027
MWALPRAGNPLRFRAQKVASAHVCASLEVLLAADAKNVEEHHEADCQKMCCCHKPRSPAFQLSFTSGQFACSRGYSSQPSANYGDKADE

SEQ ID NO: 74603 - DNA, 808 bp, Zea mays
  misc_feature: Ceres CLONE 1559030
  misc_feature: Encodes the peptide sequence at SEQ ID NO. 74604
ctcaccgcggtggcggccgctctagaactagtggatcccccgggctgcaggaattcgtctcacccctagaaaaaaggtcccataccacacgcgtacgcggcattctcctcggcgcggggtgccgagacgcgtacgcggcattctgcttgggtgcgggggttcctctcgagtctcggctacgacgaaaacgaaaataccgagtcgagtcagcgatgaatccattcgccaaaaaaaccaacaccgcgagaggtgatgcggagcaacgagcgggacctgacgaatgctacgcgagggatcgagagggacattgcgtctttacagcaggaggagaagaaactcgttgctgaaattaaaaggacagcaaaaactggcaatgaggcagcaacgaaaattctagcccgtcaggtgatcacgttaaggcagcagatttctaatttgcaaggtagccgagctcacattcgggggattgcgacacatactcaggcaaagcgtgccaacacttcaatggctactggtttacaaagtgcgagcaaagcaatgggagctttgaataagcaaatggaacctaccgagccgatgataataatgcaggaattccaaaagcagtcagcacgaatggatatgacagatagaatgatgtctgattcgatggacgatgtcttagacgatgaacaggccgaggaagaaactgcacgaacttgctatcaggttctggaatgagatggtggtagacattggcatcacagttggtcctaagctccaaaaggacaaattgcttgggaagaaggtcaggttgatgaaaagtttc

SEQ ID NO: 74604 - protein, 155 aa, Zea mays
  misc_feature: Ceres CLONE 1559030
  misc_feature (3)..(156): Pfam Name: Snf7 Pfam Description: Snf7
MRSNERDLTNATRGIERDIASLQQEEKKLVAEIKRTAKTGNEAATKILARQVITLRQQISNLQGSRAHIRGIATHTQAKRANTSMATGLQSASKAMGALNKQMEPTEPMIIMQEFQKQSARMDMTDRMMSDSMDDVLDDEQAEEETARTCYQVLE

SEQ ID NO: 74605 - DNA, 711 bp, Zea mays
  misc_feature: Ceres CLONE 1559031
  misc_feature: Encodes the peptide sequence at SEQ ID NO. 74606
ctcaccgcggtggcggccgctctagaactagtggatcccccgggctgcaggaattcgtctcacccctagaaaaaacctcccccgtgccaccacctctaaaatcccccagcggcccaaccgaacccgcctagggattcctaccgagggaggccgcacgcagccatggatttcctgcaggggcaaagcgtcgagaccacagtggccgtcgccgtcgctgtcgccgccgtcgccgcaggcggcgccttcctcctccttcgatccaggaagcccaagggctgcttggatcctgagaacttcaggaagttcaaacttgttgaaaagaagcaaataagtcataatgttgcccaggttccaaagttcgctcttcccaactcccaatttctggtattggggcccttcccaaatcgggtcaacatatcaagctgcagaggaccaagacgcttcaggtggaagaaagtaatccaggccttatacccccctaccaaatttgggaattccggaaccttgggaaaatttttggaaacccttgtgccattaaaaaaaaaatgtttttccccccccaaggggggaaaaaaaattttccccccccctaattttttttttcccccccaaaaaaaaaaaaaaaaaaaaaagggggggggaagaaaatattttttatttcccccccccccgcggggggggggggcggacccctttgtgggggggggggcc

SEQ ID NO: 74606 - protein, 183 aa, Zea mays
  misc_feature: Ceres CLONE 1559031
MDFLQGQSVETTVAVAVAVAAVAAGGAFLLLRSRKPKGCLDPENFRKFKLVEKKQISHNVAQVPKFALPNSQFLVLGPFPNRVNISSCRGPRRFRWKKVIQALYPPTKFGNSGTLGKFLETLVPLKKKCFSPPKGGKKIFPPPNFFFPPQKKKKKKKGGGRKYFLFPPPPRGGGADPFVGGGA

SEQ ID NO: 74607 - DNA, 874 bp, Zea mays
  misc_feature: Ceres CLONE 1559033
  misc_feature: Encodes the peptide sequence at SEQ ID NO. 74608
  misc_feature (549)..(549): n is a, c, t, g, unknown, or other
ccccgcggtggcggccgctctagaactagtggatcccccgggctgcaggaattcgtctcacccctagaaaaaaaccaccgctgctgcgatctcgccgtctccttcctccacgccgtctcggtctccctcccatggccggctacccgcctcccggctccggctacccctacggtcccggcgggggctacggcgccccgccgccgccctacggctcctcgcccgcgccctccgccccgccgtacggcgagaagccgcccaaggaaggcaagacctcgacctcctccgcgcccccctactacggagcgcctcccccatcctacggagcgccgcccccctcccagccctactgcgactggtgctggggcggcggcgggtacgggtactgcgcctcacagccagcgccctacagcggcgccccgcagaagcagcacccgtacgggggcgggccccctgcagggttcggcagccccgtcgagtccctagtgcactccgtgttcccggccggcacgaaccccaagatagggaccgcttcccgggggcctgaccccnatcggaacggtttgaaacaacaaaaatgacctccaacgccctccttccggaaaaaaacagaaggttgaaaaaacgggacccgggcccttgcttcagttcccctttaaaccaacaccaaagttcccccaagatgggagcccaaggattttgctctcccgggtttacccacccccccaaaactggggaaaaaaaatttggagaaaggttataaaccgggtaaaaaaggggggcggaacctcacctttgtaaaaaaaagcgggaggtggccttttctcccgctccaaaaaaaatgtgttgtttcccacaaatttccccccaaaattag

SEQ ID NO: 74608 - protein, 148 aa, Zea mays
  misc_feature: Ceres CLONE 1559033
  misc_feature (140)..(140): Xaa is any aa, unknown, or other
MAGYPPPGSGYPYGPGGGYGAPPPPYGSSPAPSAPPYGEKPPKEGKTSTSSAPPYYGAPPPSYGAPPPSQPYCDWCWGGGGYGYCASQPAPYSGAPQKQHPYGGGPPAGFGSPVESLVHSVFPAGTNPKIGTASRGPDPXRNGLKQQK

SEQ ID NO: 74609 - DNA, 789 bp, Zea mays
  misc_feature: Ceres CLONE 1559037
  misc_feature: Translation starting site: 83
  misc_feature (487)..(487): n is a, c, t, g, unknown, or other
ctccccgcggtggcggccgctctagaactagtggatcccccgggctgcaggaattcgtctcacccctagaaaaatattagaaatgcaagacagccaatacgaaatgctagaaaatcggccgcgcttaagggatgtcctcagcgtcgaggaacatgtgctaaggtgtatactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctaaatatggggccaaaaagccaaaaaaataagtgatttcgtttttagcccttataataagaaaacggatttcttgaacctgctttcacngctcatgtcaacgtcaaggtacctgcagaaaaaaaagaaccccaaaaatcccaattccaaattttttcggaaatcgaatttaatttaaacatgggtgggtttaaccgtatttttggaagaacggaaaaaaaaacccttgggctttaacaaaattcccctatccgagcccgggaaaaaaaatttcccccaaaaggaaaggaaacccaattccccccttttggggttttttccccccaggcaatttacgcgtggaaagaaacctcccccaattattggggggggaaaaaaaccccaaaaccttt

SEQ ID NO: 74610 - DNA, 811 bp, Zea mays
  misc_feature: Ceres CLONE 1559038
  misc_feature: Encodes the peptide sequence at SEQ ID NO. 74611
  misc_feature (499)..(499): n is a, c, t, g, unknown, or other
ctccccgcggtggcggccgctctagaactagtggatcccccgggctgcaggaattcgtctcacccctagaaaaaatcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccgcaaggcgcaggtggaggagttctacgtcatcacgtggacgtcccccaaggagcaggtgttcgagatgcccaccggcggcgccgccatcatgcgggagggccccaaccntctgaaagctgcgcgcaaggagcagtgcctggcgctcggcacccagttgcgctccaagtacaagatcacctaccagtttctaccgcgtccttccccaaacggcgaaggtgcagtaacttccaccccaaaaggaagggcgtcctaccccgggaaaaaaggccaaccccccgcaaaggaaaagggccttccggccaaaaaaattttcccccaaaaaattgggggaaagaaaagtgtaaaaccccccattgagaaagttaaaaagttttacacccggggaaaagggcgccacaccctttttagaaaaaaaaaaaa

SEQ ID NO: 74611 - protein, 221 aa, Zea mays
  misc_feature: Ceres CLONE 1559038
  misc_feature (62)..(210): Pfam Name: PsaD Pfam Description: PsaD
  misc_feature (118)..(118): Xaa is any aa, unknown, or other
MAMATQASAATRHLLAAAWAPAAKPRQLSSQLALPSSSSRGPAPLRASTEEAVEAPKGFVAPQLDPSTPSPIFGGSTGGLLRKAQVEEFYVITWTSPKEQVFEMPTGGAAIMREGPNXLKAARKEQCLALGTQLRSKYKITYQFLPRPSPNGEGAVTSTPKGRASYPGKKGQPPAKEKGLPAKKIFPQKIGGKKSVKPPIEKVKKFYTRGKGRHTLFRKKK

SEQ ID NO: 74612 - DNA, 846 bp, Zea mays
  misc_feature: Ceres CLONE 1559039
  misc_feature: Encodes the peptide sequence at SEQ ID NO. 74613
  misc_feature (688)..(688): n is a, c, t, g, unknown, or other
  misc_feature (761)..(761): n is a, c, t, g, unknown, or other
  misc_feature (778)..(778): n is a, c, t, g, unknown, or other
ggagctccccgcggtggcggccgctctagaactagtggatcccccgggctgcaggaattcgtctcacccctagaaaaactcttcgcttctaactccgctgggccaccagctttgaccgccgcctcccttcccctccgctactgctcctccccaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcaggtggaggatcccatgttgatccatttgacatcttctcatcattttttggaccctcttttggaggaggtggtggaagcagcaggggaagaaggcaaaggaggggagcaagatgtagttcacccacttaaagtttcctctggaagatctttacaatggcacctcaaagaagctctctctttcgcgcaatgtcatcntgctccaagtgcaagggcaaggggctcgaagtctggtgccctcaatgaggtgcccctggttgccagggctcanggcatgaaaagtcactnattcgtcagcctgggccccttccattgatacagcaggatgcagcagcctttgcaatgaggtgcaaggg

SEQ ID NO: 74613 - protein, 89 aa, Zea mays
  misc_feature: Ceres CLONE 1559039
  misc_feature (13)..(71): Pfam Name: DnaJ Pfam Description: DnaJ domain
MFGRAPKKSDNTKYYEILGVPKSASQDDLKKAYRKAAIKNHPDKGGDPEKFKELAQAYEVLSDPEKREIYDQYGEDALKEGMGRWRIPC

SEQ ID NO: 74614 - DNA, 783 bp, Zea mays
  misc_feature: Ceres CLONE 1559040
  misc_feature: Translation starting site: 652
ctggagctcaccgcggtggcggccgctctagaactagtggatcccccgggctgcaggaattcgtctcacccctagaaaaaacaaggagaccctcctcagccgctagtaccagtagtcgtcgcgtttgcagctaggcagatctgagttagccggcggatccgatccgtgcgcgtgcgcagtgtgtgtgtgtgtgtgtgtgtgtgtgctgtgtcggtggagagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtacagcccatcaacggcgaccccttcatcggcagcctggagacgccggtcacctcgagcccgctcgtggcgtggtacctctccaaccttccggcctaccgcaccgccgtgagcccgctgctgcggggcgtcgaggtcggcctcgcgcacggctacctcctcgtggggcccttcgcgctcacgggcccgctccgcagcacgcccgtggcacggccaggccggcgcgctcggcgccgccggcctcgtcgccatcctcagcgtctgcctcacaatgtacggcgtcgcctccttcaacgagggggacccgtccacggcggcctcgctcacgctcaccgggaggaagaaggaggccgacaagctgcagacctccgaacgctgggccaagttcaccgggggattcttc

SEQ ID NO: 74615 - DNA, 710 bp, Zea mays
  misc_feature: Ceres CLONE 1559041
  misc_feature: Encodes the peptide sequence at SEQ ID NO. 74616
  misc_feature (427)..(427): n is a, c, t, g, unknown, or other
ctccccgcggtggcggccgctctagaactagtggatcccccgggctgcaggaattcgtctcacccctagaaaaaccggctccggcgctcggcggtcggccaggttcgggagatcacttcgtcgcggcgaggagggagggggtcgccgttagcgcgcggcacttggatgagaagggcagcggtggaggaggatgcggaaggcgtacaggtgactccatcaaggtgctcgaagctgacatccagcacgccaacaccctggcctccgagtttccccgggactatgatggtgcgtgcctgcagatgcggctgtcgtacagtcccgcagctcatatattcctcttcctggtgcagtggacggactgcagcctcgcaggggctcttggtctgctgagaatcctcatatacaaggtttatgtggatggcacaancaccatgtcgactcatgagaggaaagccagcatcaaagattctatgctgtgatatttccttcttgctgcactgcaaagggggatcactgatgttcaggaacaaaaaccaaaaggctttgcctggggaatcccgaaagaaaattgagatgggccggacccctttctaattttattttaaaggaaaaaaaaaattgggggaatttctcccgggagaaaaaaacccaaaatttttggttggcccaaaggggccccttggttttgtgtgtttcaaaagttttcccct

SEQ ID NO: 74616 - protein, 158 aa, Zea mays
  misc_feature: Ceres CLONE 1559041
  misc_feature (142)..(142): Xaa is any aa, unknown, or other
PRGGGRSRTSGSPGLQEFVSPLEKPAPALGGRPGSGDHFVAARREGVAVSARHLDEKGSGGGGCGRRTGDSIKVLEADIQHANTLASEFPRDYDGACLQMRLSYSPAAHIFLFLVQWTDCSLAGALGLLRILIYKVYVDGTXTMSTHERKASIKDSML

SEQ ID NO: 74617 - DNA, 824 bp, Zea mays
  misc_feature: Ceres CLONE 1559043
  misc_feature: Encodes the peptide sequence at SEQ ID NO. 74618
  misc_feature (596)..(596): n is a, c, t, g, unknown, or other
  misc_feature (696)..(696): n is a, c, t, g, unknown, or other
ctccccgcggtggcggccgctctagaactagtggatcccccgggctgcaggaattcgtctcacccctagaaaaaaccagcctcaaattaagcagccaacaagacctgtctatagctgcctcgctagccaagcctgactgctacctagcaacgaccagctgggactgggagggggagtccatcgagctcgccccaggctgacgatccgctcgatctcggggacccaagggttgatcgatagacgacgcatggcgaaggtccacaacgtgctgctgtcgtcgtcgtcgccggctgagggagccgccgcagcggcggcgggcggcgagggcgaggcgacgtcgctgacggtgtggcgcaagtcgctgctgttcaactgccgggggtacacggtgttcgacgccaggggcgacctggcgtaccgcgccgacagctacgacgccgaggccgaggtcgtgctcatggaccccgccggccgcccggccttcaccgtgcgccgcaggcgcctcagcctgtccggcgagcagtggctcatctacgcgggcgaggagacgcgccggcccgcgtacgccgtcaagcgcggcggctgcggcgggaagntctgtggcgcgcgtcacgccgtgcgccgccgtgcccgccgcagctggggccgccgcgttgcccgcgtacgaagtggagggggtcctacgcgcgccgccgnctgccttggtgtacgacgcccacctagcgcgcgccgttcgcggtagtgcagcccaaaggaagctgtccggctcggacgtgtttccgcctcctgttgcagcccgggggtccgacatgtcgcttcgccat

SEQ ID NO: 74618 - protein, 164 aa, Zea mays
  misc_feature: Ceres CLONE 1559043
  misc_feature (17)..(154): Pfam Name: DUF567 Pfam Description: Protein of unknown function (DUF567)
  misc_feature (117)..(117): Xaa is any aa, unknown, or other
  misc_feature (150)..(150): Xaa is any aa, unknown, or other
MAKVHNVLLSSSSPAEGAAAAAAGGEGEATSLTVWRKSLLFNCRGYTVFDARGDLAYRADSYDAEAEVVLMDPAGRPAFTVRRRRLSLSGEQWLIYAGEETRRPAYAVKRGGCGGKXCGARHAVRRRARRSWGRRVARVRSGGGPTRAAXCLGVRRPPSARRSR

SEQ ID NO: 74619 - DNA, 851 bp, Zea mays
  misc_feature: Ceres CLONE 1559045
  misc_feature: Encodes the peptide sequence at SEQ ID NO. 74620
  misc_feature (665)..(665): n is a, c, t, g, unknown, or other
  misc_feature (719)..(719): n is a, c, t, g, unknown, or other
ggagctccccgcggtggcggccgctctagaactagtggatcccccgggctgcaggaattcgtctcacccctagaaaaaagcctcgcaagagaaagcaaagcaaaggcaggagggaaagaaagaaatccttttcctacacctaaagagaccaccaaaccctgcgagcccaaaaaaaagccatggagtacaagagatcatcgcatgcggaagaggaagaagaggatgaggaggaagaagaagacgacgagaacgaagaagaagaggaggatgaggaggaggccagaggccttcgctacaccacggcggcggtggcacccgtaggcgctccacagcagctgcagccaccgctgcctccaccaggcttcccgccggctcaccgccaacaaccgcaggctggcgcagctccatctccatcgtagggaaagcggagatggagagggacagagccgcgggagcgcaccccgatgtccggcgccaccaccaagatccagccaagaatggcattctcagcggtggcgccgcaccaacgtcagctccctctactctctacctcttgcccgatggtggaagcggcccagctgtggaggtaccagaagtgcctgctgaaccacgcggagcgccttggcgagcatgtgctctacagctgcagcaagttcatccatccnagggggcgacgggggcgacttgctagactgcggccgctgcggctgccaccgcanctgcacaaacgcgatgcggtccactggccgcagagtggcaattataacccctcagcggatgaaaatacgtgatccaactgctgggcccaataattcaatgggccttctgcttgctagttgtctgccacaaat

SEQ ID NO: 74620 - protein, 79 aa, Zea mays
  misc_feature: Ceres CLONE 1559045
MEYKRSSHAEEEEEDEEEEEDDENEEEEEDEEEARGLRYTTAAVAPVGAPQQLQPPLPPPGFPPAHRQQPQAGAAPSPS

SEQ ID NO: 74621 - DNA, 804 bp, Zea mays
  misc_feature: Ceres CLONE 1559046
  misc_feature: Encodes the peptide sequence at SEQ ID NO. 74622
ctccccgcggtggcggccgctctagaactagtggatcccccgggctgcaggaattcgtctcacccctagaaaaagtcgtctctgcccacttcccagtccccaatcgagttctcttcctggccggagatggcggccgccaccggctacagcgacgccccataccgacgagcaactgctggcgtactctgagctgcccatacatggccgcgacatggtcggaggtgttcgccgtgcgcatcccgagccatcggccggagagagacccgccgccccgtggcatcatctctttctacggcggccactgcatgcagcgatttcatttacagctggaactcactggaagaggaagaagacacctcgaagcaaacctgcgacagccagggtaacctcgtgctaactgggccatcaatggccacctcggcagaaagtacaattgccttcaccttctacctccatgatggcagcccgcaagccggagaagccgctgaggactacgaggacatcgagaggataatctgctactgcatcggcgacgacttctccaactacaacagggccatagtcgagactgtccaaatgggctatggcctcactgaagtgatctatgccgtgctgaacaacagcgtccaaagccgggtcactgtcaaacttgctccgcctgccggtgtccaaagccggataagaagacgccaccgccattctgggggaggatcgttgcatcgcagcaagctgttccacatctgcatgcgtgctcttcatacaaggaggtgaccattgcagtggagcgtggcaaccggggggggc

SEQ ID NO: 74622 - protein, 120 aa, Zea mays
  misc_feature: Ceres CLONE 1559046
  misc_feature: SWISSPROT Homolog: EC 3.2.2.22 rRNA N-glycosylase
MATSAESTIAFTFYLHDGSPQAGEAAEDYEDIERIICYCIGDDFSNYNRAIVETVQMGYGLTEVIYAVLNNSVQSRVTVKLAPPAGVQSRIRRRHRHSGGGSLHRSKLFHICMRALHTRR

SEQ ID NO: 74623 - DNA, 816 bp, Zea mays
  misc_feature: Ceres CLONE 1559048
  misc_feature: Encodes the peptide sequence at SEQ ID NO. 74624
ggagctcaccgcggtggcggccgctctagaactagtggatcccccgggctgcaggaattcgtctcacccctagaaaaatcgccgggatccagatcgttcttcctcttgcccgccgattcgttccaccaccgcgaaagccacacttagagcaggagagacaatccagagagatcggcgccttgagaggacctcatgactaattccgtcatgagctacgtcgacctgaagaaagcggctatgaaggacctggaggcggggggcgacagaatctatctcccggagtctggcgccggttgcctcacggacgagcgcctgcgcggattcttccaagatgccgaggcggtgaaggctgatatggcggccatccgcgacgcgctcaaccgcctgcacgccgccaacgaggagggcaagtcgctgcaccaggtcgacgccctccgcgcgcaccgcggccgcgtcaactcctacatcgtcgccgtgctccgccgcgcccacgacatccgcgccatgctggagtgcctggaccgcaccaacgccgcgcagcggacgctctccgcggggtgccgcgagggcacgcctctggtacgcttgcgctccgacgacagctcggggcatctgaaagagctcgaggacatcatgctcaactccacgctctaaaacagggggaggattggccaagtacaaagtacaccttgcagaggaatctcctacccgcctcacggggtatgtcccctagggacgcaaggttttgggaaccttttggttttcccatgggaaaaattttgagttaacccctggaaaaccttacatttgggggga

SEQ ID NO: 74624 - protein, 153 aa, Zea mays
  misc_feature: Ceres CLONE 1559048
  misc_feature (40)..(148): Pfam Name: Syntaxin Pfam Description: Syntaxin
MTNSVMSYVDLKKAAMKDLEAGGDRIYLPESGAGCLTDERLRGFFQDAEAVKADMAAIRDALNRLHAANEEGKSLHQVDALRAHRGRVNSYIVAVLRRAHDIRAMLECLDRTNAAQRTLSAGCREGTPLVRLRSDDSSGHLKELEDIMLNSTL

SEQ ID NO: 74625 - DNA, 854 bp, Zea mays
  misc_feature: Ceres CLONE 1559051
  misc_feature: Encodes the peptide sequence at SEQ ID NO. 74626
  misc_feature (764)..(764): n is a, c, t, g, unknown, or other
  misc_feature (781)..(781): n is a, c, t, g, unknown, or other
ctggagctcaccgcggtggcggccgctctagaactagtggatcccccgggctgcaggaattcgtctcacccctagaaaaaatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcatcggagtacgggaccgagggcgcggagcagcaggacggggagttctccgaggacctcaagctgttcgtcggtaacctgccgttcagcgtcgacagtgagcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccacctagagatggatccgcaccaagagcaccaagggtggtgggtggggtggccgcagcagcagcagcctttgtcgattcatgcaagcaaggtatacggtggggaaaccttggcatggggacgttgaccactcggactctggagaaaccgtatcagtgagncaagggacagtgctggnatgctaaaggtcatcctaggacacgcatagcggcaggtcaaagggggggtttggttttcgtcacctaatggat

SEQ ID NO: 74626 - protein, 207 aa, Zea mays
  misc_feature: Ceres CLONE 1559051
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAALFSTSLSPRFLALSSPKPAAPAASAFLPFTLPLRSVSAPAPARRVFEPVAVAVSSEYGTEGAEQQDGEFSEDLKLFVGNLPFSVDSEQLAGLFEQAGSVEMVEVVYDRMTGRSRGFGFVTMSSAEEAGAAVEQFNGYTFQGRPLRVNCGPPPPRDGSAPRAPRVVGGVAAAAAAFVDSCKQGIRWGNLGMGTLTTRTLEKPYQ

SEQ ID NO: 74627 - DNA, 1106 bp, Zea mays
  misc_feature: Ceres CLONE 1559054
  misc_feature: Encodes the peptide sequence at SEQ ID NO. 74628
acacctgacacctcccgccgcccgtcggcgattcgcaatggccttcgccggcaacgccgacgactcggcggaggactattccgcggaggccaccgtggtgcgcttcgacccgccgctccctctcctccgggcgccagtcccctcgccagcatctagcggcgagggccccgtcctcgccttccgcgacgtcgcgagctggcgagccgcctgggaggccgccgaggccagcctcgtctcccagtgcgaggccggtgcaaggtcagggtgctcagtcagcgcatcacgcaagtgcaagccaccctggtggaaacgcttacttgtagttgtagctgctgctcctccgacggactacgaggagaggtcgagatgcgaggagcgcgagatggccgcctgcctggaggcggcgagggaggcctgcgctaagttcgcgaaggcaaaatgcgcggggccattccaggacgcaaggatcgcccacgagggcgtcctagcgaacacgggtttcgatgtgtggggggccgctgctgacaagagttcctcaacggcggcggcggcgtgtgccctgaacgtccagcgtgtgtagcccaggtcctggcgcgacaaactacagaagggagcgatgtatgtgcttggcagattgtgcaaccaaaaggtgatagcggctctggacagtgaccgcccgaaggcgcgctggaacagtgtccagacatggcgtgagtggagtcgggaatttggaatcggacgcggcaatcatcaaatggcggaacacgcgagcgaggccccccggtgtttgtttgcagttgtgctacactgaagggtagttagtttctgggtgctggaaatctgtagggagggagaaggcacggagcggaggccttgtccgctgagagagcatgatcggtggacatggagcgtggaacaagacaacccctgctgcttttgcggttgttttgttttagatcattgtgcgaatcagggtaacaagactgaacatgtgtgatgttttctcactagtaaggtttggaggtttgtaccttggataggaactcgttgctgaattctccttccatttgtagaggtcagaatatgttcaaaaaaaaaaaaaaaaa

SEQ ID NO: 74628 - protein, 180 aa, Zea mays
  misc_feature: Ceres CLONE 1559054
MAFAGNADDSAEDYSAEATVVRFDPPLPLLRAPVPSPASSGEGPVLAFRDVASWRAAWEAAEASLVSQCEAGARSGCSVSASRKCKPPWWKRLLVVVAAAPPTDYEERSRCEEREMAACLEAAREACAKFAKAKCAGPFQDARIAHEGVLANTGFDVWGAAADKSSSTAAAACALNVQRV

SEQ ID NO: 74629 - DNA, 798 bp, Zea mays
  misc_feature: Ceres CLONE 1559055
  misc_feature: Encodes the peptide sequence at SEQ ID NO. 74630
ctccccgcggtggcggccgctctagaatagtggatcccccgggctgcaggaattcgtctcacccctagaaaaagagaaactgcggtcgttcttcactggagccagcttggtcggttcgtttacgaccaaagcgccccgcaaaatctcgacgccgaccgccatggcatccgccgaggcgacgcgtccgctgctcgttgctatatctctcgccgtagccgcctgctgcctcgcgcaactggcggtgggggacacgaacggcgtctacgagccgtgcagtgacgcacggatccagcgcggggacggcttcaccttcggggtggtcttcgcgggatacaacgccttcttctccggcaacacacagctctccccctgcgaccggcgacctcaacctcgctgcctccgggcagctcgccgtcttccgacccaaggtcgacgagatctccctcctcaccatcaacaccactaccggattcaagccagcttcagctggtggattcatggtagcattgtgccggcaggaagtatgcagctagatctatgccgatatttgtatccaacacctcagtcacagtgtccagcttcacactgggacttgagttcaacaaaggcagactccaaaacttgcactggaagaatgacggctgtggcgcttgctccggcaagtcgaacttcgtctgcctcggcgaacagacatgcgccatcagggacgcagagctgcaagagccgaaggcccgtctcactgcagcgtcggcatccagctggcttttctctggcacggacaaacacccagtcagttct

SEQ ID NO: 74630 - protein, 87 aa, Zea mays
  misc_feature: Ceres CLONE 1559055
MPIFVSNTSVTVSSFTLGLEFNKGRLQNLHWKNDGCGACSGKSNFVCLGEQTCAIRDAELQEPKARLTAASASSWLFSGTDKHPVSS

SEQ ID NO: 74631 - DNA, 817 bp, Zea mays
  misc_feature: Ceres CLONE 1559056
  misc_feature: Translation starting site: 535
  misc_feature: SWISSPROT Homolog: EC 1.1.1.184 Carbonyl reductase (NADPH)
  misc_feature (721)..(721): n is a, c, t, g, unknown, or other
  misc_feature (784)..(784): n is a, c, t, g, unknown, or other
ctcaccgcggtggcggccgctctagaactagtggatcccccgggctgcaggaattcgtctcacccctagaaaaaaagtgtccccctccctacccgctgtctgcggctggccacccccatagcccccgagctctgtgtgcgatggactactcgggcaccaaggagtcgcctcctgccggggcttggtggtcgagggagacggtggccgtggtgaccggcgcgaaccgcggcatcggccacgcgctcgccgcccgcctggccgagcacggcctcaccgtggtgctcaccgcgcgggacggcgagccgcggggaggccgccgcggcgccgctcctcgcgcgcgggctcgccgtcgtcttccgcaggctcgacgtctccgaccccgcctccgtcgccgagttcgccgcgtggatccgcgacgccctcggcggcctcgacatcctggtgaacaacgcagccgtgtcgtttaacgagatcgacaccaactccgtggagcacgccgaggctgtcctcaggaccaacttctacggggccaagatgctcaccgaagcgctcctgccgctgttccggcagtcgtcggcgaccagcaggatcctcaacgtcagctcccagcttggccttctcaacaaggtgagcgacccgtcgctgagggcgctgctgctggacgaggacgggctgacggaggcggggatagaggcgatgggtgtcgcggttcctggcgcangtgaaagacgggacgtggggccgggcaggggtgggcccaaggtgtggacggactactcggtcntcaagctggcccctgacgcctactcgcggctgc

SEQ ID NO: 74632 - DNA, 790 bp, Zea mays
  misc_feature: Ceres CLONE 1559060
  misc_feature: Encodes the peptide sequence at SEQ ID NO. 74633
ctccccgcggtggcggccgctctagaactagtggatcccccgggctgcaggaattcgtctcacccctagaaaaactggacgacccaagcaagcaagcaagcagcgagtacatacatactaggcagccagggagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcgtacaagcccctgggcagcgactagaccgcgcccgccggtcgccccccgtcggctagctatagctcctgcgcgagctagtagctagctagtggcatgcgtcgtctctgtcgttcggttttgctccgaggtcaccgtaacccttgctttgatgggtttctccctttct

SEQ ID NO: 74633 - protein, 170 aa, Zea mays
  misc_feature: Ceres CLONE 1559060
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSTASLPIARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPLGSD

SEQ ID NO: 74634 - DNA, 816 bp, Zea mays
  misc_feature: Ceres CLONE 1559064
  misc_feature: Translation starting site: 240
  misc_feature (745)..(745): n is a, c, t, g, unknown, or other
  misc_feature (798)..(798): n is a, c, t, g, unknown, or other
  misc_feature (805)..(805): n is a, c, t, g, unknown, or other
ctctccgcggtggcggccgctctagaactagtggatcccccgggctgcaggaattcgtctcacccctagaaaaaatgctccctgctcgctcctagtccctcccgggctcccggcagcggcggcgcaccttatggcgacttgagctctctgggcgacgtcctcgggacgggcagactgtaattgaaatgaaaaggataggtagatctagctaattcgacaacagagcaaggtgcgctcctatggaagtggaagaagcaggaggcgaagtggagaacgccggcaaggacgaggcggaggcggagtaccattcgcgcgatttcgaatgggaggacctcaaggaagaggtggaatctggacctgtcttctcctaccacctctccccctttctcgaccccgccgccagtaccacctcgccgccgcagccctcgtcggaggcctggagaagcttccaccgtcgccatgcgtccggaaaattctttaaggaaaggagatatttgcttaaggaatttcctgaactttgtagcagcaaagatcatgccaaggttttagaagtggggtgtgggggaatggaagcactgctgtttccattctacggtctagtgaaaggatcactgtctttgcttgtgactgtagtaaagacactcttgagaaggcatatgaaattatatccaatacaaaagggattaatatcaagggataggttccacccctttttttaatggatgtttctaaagaaactttcccnagattggttatttttgcaaagcctggtcaaactttcgctggggaaaagctgcntgcatcntttactttgat

SEQ ID NO: 74635 - DNA, 813 bp, Zea mays
  misc_feature: Ceres CLONE 1559065
  misc_feature (614)..(614): n is a, c, t, g, unknown, or other
tcaccgcggtggcggccgctctagaactagtggatcccccgggctgcaggaattcgtctcacccctagaaaaatgctccctgctcgctcctagtccctcccgggctcccggcagcggcggcgcaccttatggcgacttgagctctctgggcgacgtcctcgggacgggcagactgtaattgaaatgaaaaggataggtagatctagctaattccacaacaaagggaggtgcgctcctatggaagtggaacaagcatgaggcgaaccggagaactcctgggaggactaggcggaagaggagtaccattctcgcgatttcgaatgggacgacctccaagaagaggtggaatctggacatgtcttcccctaccagctctccccctttctcgaccccgccggcagaaacacctcttcggccgcagccctcgtcggaggcctggagaagcttccaccgtcgccatgcgtgcggaaaattctttgaggaaaggagatatttgcttaaagaattgcctgaactttgtagcagcagggatcatgcctaggttttataagtgggacctccggaatggaagcactgctgtttccattcgagggtctacagaaaggatcagtaanctttgcccgtgactgtaccaaatacactgttgacaaggcatatgacattctatcctgatgctaagggattgatatcaaggataacttccacccctcccttaatcgatgtggctaaataaacttgtcacagattggttagttttgcatttcctgtcagacttcccctggaaaagctactggcatctataccccatccaag

SEQ ID NO: 74636 - DNA, 1316 bp, Zea mays
  misc_feature: Ceres CLONE 1559066
  misc_feature: Encodes the peptide sequence at SEQ ID NO. 74637
  misc_feature (1081)..(1081): n is a, c, t, g, unknown, or other
  misc_feature (1225)..(1225): n is a, c, t, g, unknown, or other
  misc_feature (1305)..(1305): n is a, c, t, g, unknown, or other
taattaaatataattttttgagttagttgatgattgttggtgtagggagggatataataatgataataaaaaagaaagaccggggctccccccgggggcggccgctctagaactagtggatcccccgggctgcaggaattcgtctcacccctagaaaaaagtagtgcgcccgctgctgcacttattgaacgggtaccaactcgtactacttcgtgccgacgcgtaccgcctacttcggctgggccgacaaccacctcgccgtctcgctcgactacgcgctcttccagggcggacgcacccgctacgtcgacccaggcaccgggctcacgtacaccaacctgctcgacgaaatgctcgacgctgtggttatcgcgatggtcaagcttggatacaggcacgtcaagctggccatcgaggagacaggatggcccaactgctacgactacaaccagataaaaggcaacgtccacaacgcccccccattccacaacccaccaaccgtcagtggggtgggatgtggtgaaaaccgcggaggacgcacagttagggctaggaaaatcaaaaaaagcacaagtagaacaagatgtactctgcgtataacctaacgagtaaaacactatcgcgcaatgggtgtatgtggcaaacgggaacgcggagcagtgggggagtgagctgaagtaagcaacaggctcaagattgatcaacgagccgctactgctccgcgtgtcactcgcgtgcgtggacacatttccgtgcgtgaaggagccgccgtcctgccccgcctaaccctcggggttggtcgtcacaaatttgagagtcttgctccctacgcaacaaccacaatatattgtaactgcgaaagtgctactcatcacatctccacatgttaaacctcagacatgtctgataccaccgaccagctattctaactactatgatcagataggtgatcaagaatgattcgtctgtgtgtccaggtgtataaacattatccgtggtggttgttgtgttgggtaaaagaaaaatgaagttcatctgctactccaaggtttcagtaacatctctctctagaatcgatatntaattactcattgccagtccgtctgatgaggcgatggaattattatttgacgatcccctcaaactacaacacggacggtagaataagctttgatatctgcctgccgacaccatgagcaatatatgagtgtcaactgtgactatntaatatgcacgatgtcagactaccgcgctgatgggcagtaactttactcgggtcttatgctgtcagttggtgcacgtgancgtaggttggt

SEQ ID NO: 74637 - protein, 84 aa, Zea mays
  misc_feature: Ceres CLONE 1559066
  misc_feature: SWISSPROT Homolog: EC 3.2.1.39 Glucan endo-1,3-beta-D-glucosidase
MLDAVVIAMVKLGYRHVKLAIEETGWPNCYDYNQIKGNVHNAPPFHNPPTVSGVGCGENRGGRTVRARKIKKSTSRTRCTLRIT

SEQ ID NO: 74638 - DNA, 822 bp, Zea mays
  misc_feature: Ceres CLONE 1559068
  misc_feature: Encodes the peptide sequence at SEQ ID NO. 74639
tcaccgcggtggcggccgctctagaactagtggatcccccgggctgcaggaattcgtctcacccctagaaaaatctcctctccttttcttccgctgttccgcatcgcatcgcatcgcctcgccgccagcgcaactccagccctggccgggatctctttcacccccccctctctctccgccgcttcgctcccccgtctcggggcctgcctcggatgctcccggcctcgcatccgctgctctacgcctgcgtcttccgcgacacccacctcgtcgccgagctcgaccacgcccactcccactcccagagcaccgccacctcagccgaccccgtagctgccgacgccccctcccacgaccctgccgacgacctcccggcgctcgccgccgcgctcgtcgccgccgctccgccgcaccaccgccacctcacgcacaccgccgccgggcgtgcgcacgcgctgctcctgtccccgccgctcgcactcgacgccgtctcgcaggcgccccacctcccggcatcgcagctcctgctcttcctccgccgcctgctatgcctccacgaggcccggatgcgggacgagatggcgcgcctatcgctgcgtttgccactcccgccgggcgacgacacgcgcgatgcgaacgaggtcgccaccgcggaggcccacacggtaggatgacgccgcgcggaaggacgctgacctagccgcgcggaccacgcccaagaaggaccgagcctcgcaccgggcgcgggccggacccacctggacgagtaggcggcagctctggatggtcatccttgcagatctcctcctctcacaatcctct

SEQ ID NO: 74639 - protein, 153 aa, Zea mays
  misc_feature: Ceres CLONE 1559068
MLPASHPLLYACVFRDTHLVAELDHAHSHSQSTATSADPVAADAPSHDPADDLPALAAALVAAAPPHHRHLTHTAAGRAHALLLSPPLALDAVSQAPHLPASQLLLFLRRLLCLHEARMRDEMARLSLRLPLPPGDDTRDANEVATAEAHTVG

SEQ ID NO: 74640 - DNA, 824 bp, Zea mays
  misc_feature: Ceres CLONE 1559071
  misc_feature: Encodes the peptide sequence at SEQ ID NO. 74641
  misc_feature (757)..(757): n is a, c, t, g, unknown, or other
ggagctcaccgcggtggcggccgctctagaactagtggatcccccgggctgcaggaattcgtctcacccctagaaaaagcggcttcggcctccggcctcagtggctcagccaaccacgacgccgccgtgcgcgccagcctccgtgggacacggctgccggcttcggtccgctgtcggctctcgcccctcaggcctcagccacgccgcacgcggccggcatggcggcgcccgcctccacggctccacgccgcggccccagccacgctacacgcggccacgccgcacgccagcacgctcagccgcgtgcccgcctgccgcctgctcggctcctcccctgctcttgctcggctgctccgtggtgcctgatccatggcggagaaggaggcggcggctacgtggggtggcgacgacaagctcattctgcgcggccttcagttccatggcttccacggtgtcctgcaggaggagaagacgttgggacagaagttcgtggttgacatcgacgcctggatagacctcgccgctgccggcgagtccgactgcattgctgacaccgtcagctacaccgatatctacagcattgcaaaggatgttgtcgagggcacgccacgcaacctctttggagtcggtagctcactcgatcgcagaaggccacgctgctcaagttccctcagatactcgcagtcccgagtgaagggtggccaagcctccacgtcgcggttggcgaggcgtttctggactttacctggggcgtggnaggataacggagggcacagaaagaaaagaatgagatgctgttacccaatgttggtgggaagggggaa

SEQ ID NO: 74641 - protein, 151 aa, Zea mays
  misc_feature: Ceres CLONE 1559071
  misc_feature (16)..(107): Pfam Name: FolB Pfam Description: Dihydroneopterin aldolase
  misc_feature: SWISSPROT Homolog: EC 4.1.2.25 Dihydroneopterin aldolase
  misc_feature (130)..(130): Xaa is any aa, unknown, or other
MAEKEAAATWGGDDKLILRGLQFHGFHGVLQEEKTLGQKFVVDIDAWIDLAAAGESDCIADTVSYTDIYSIAKDVVEGTPRNLFGVGSSLDRRRPRCSSSLRYSQSRVKGGQASTSRLARRFWTLPGAWXDNGGHRKKRMRCCYPMLVGRG

SEQ ID NO: 74642 - DNA, 817 bp, Zea mays
  misc_feature: Ceres CLONE 1559079
  misc_feature: Encodes the peptide sequence at SEQ ID NO. 74643
  misc_feature (528)..(528): n is a, c, t, g, unknown, or other
  misc_feature (529)..(529): n is a, c, t, g, unknown, or other
  misc_feature (566)..(566): n is a, c, t, g, unknown, or other
ctcaccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacnngcggtggcggcggcctaccgtggcggcggcggctacnggtggtgggtggcggcggctaccgcggtggcaacccgtggcggcggctacggcaactccgacgggaactggaggaactgagcggtgggggcccgcgcggccaagttatcctgttcgctaccgtgatgtttaccctagtccagagggtttatcttcgtttcgtgtcgtggtttgttgttgccccatctgtgttttttgattgccagggtcgctctggtgtcagtttgttaatgctgtggttcatccctcggc

SEQ ID NO: 74643 - protein, 196 aa, Zea mays
  misc_feature: Ceres CLONE 1559079
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (119)..(119): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYXRWRRPTVAAAATGGGWRRLPRWQPVAAATATPTGTGGTERWGPARPSYPVRYRDVYPSPEGLSSFRVVVCCCPICVF

SEQ ID NO: 74644 - DNA, 1255 bp, Zea mays
  misc_feature: Ceres CLONE 1559081
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (22)..(22): n is a, c, t, g, unknown, or other
  misc_feature (30)..(30): n is a, c, t, g, unknown, or other
  misc_feature (71)..(71): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (1255)..(1255): n is a, c, t, g, unknown, or other
nnnnngttttttttgggggtcncacagcgngcgaggggtctcttttctctagcttggggctgggacggagnttnnnnaagtggagctccccgcggtggcggccgctctagaactagtggatcccccgggctgcaggaattcgtctcacccctagaaaaaccctagaaaaaacgacccaagcaagctagctcgatctactactactactactagctggtacacatactagccatcctgccagccagccagcttgccatggcgcccaccgtgatgatggcctcgtcggcaacaagcgtcgccgccttcgacggggtcacgtccgccgccagcctcccggtcgtcggcgggagcgcggagagaaataaaaaaaaaaacaagcaaagaaaaaatccagacccatcgaagcaccggcctctggaggcgaagacttgcgctagttgctgcgcccaccaaccacaggagcggcggagcgctagaccaccccggaacaacccaccccccccccccatcggcgggggggaggaatcgcgggacgcccgagatggataaaagaaaggctgactggcctgaaaggaggccgatgccactcaagcccagaggaaacctgcattgggggtggagccggagcttcgaattatgtggtgagctgtgccccagagggaggaaagcctcttatacccctagatcacggagacccccccgcaccaaggaggaaacgccgggagggcagccctagcggagcaggcatgagccgtaaccgggcgagcacacaagaaagagcgaggacgccaccaaggaagcccaagcaaatgcgccacacaagagaacgcgcgtacatacttcgtgttagaaaagatcatgatagtaaggacgagatagaacccaccacaggagaggaagccgatcctattagtgagtcgccacaactactccttgtggccggtccgatgccgatgctgcgcatcgcgagggtagggtgggtgtagaggagactcaaaaccactctctacataatcgtgtgacgagatgtgagacgcgcagagagggctagagcatgcgaccaatcacacatgcagtccccaactcactatcctcacgtgcgttgagagttcactatgcagcgcccctcttcgctgtacgtaatcggtacaaggccctaacgccccgccgctagggtactgtgacgcgagaagtactttcgaggaccacgattatatctacctacctaccgcgtccaagaggtggcgcgcccgtn

SEQ ID NO: 74645 - DNA, 797 bp, Zea mays
  misc_feature: Ceres CLONE 1559082
  misc_feature: Encodes the peptide sequence at SEQ ID NO. 74646
  misc_feature (754)..(754): n is a, c, t, g, unknown, or other
  misc_feature (755)..(755): n is a, c, t, g, unknown, or other
tggagctccccgcggtggcggccgctctagaatagtggatcccccgggctgcaggaattcgtctcacccctaaaaaaatccccagcccgcgcactgcccccggtctctctctctcaacacaccgataagcccagtccaccggatctcccgtagtccagagactgagttgaaggaaggaagccatgatgatgatgggcgaaggcgtgagcatgccgccgtggtcccaccacgtccctgtgagcggcgtcgacgaaggcgacgagatgacgccgtacctgctcgcggcgctgcgccagtacctgccgtgcaacgacgccggcgccgaggccgaggaggatgaggcggcggccgccatggcggcgggcgtggacggctacggctgcgacgagttccgcatgtacgagttcaaggtccggcggtgcgcgcgcgcgcgcagccacgactggaccgagtgccccttcgcgcacccgggggagaaggcgcggcgccgcgacccgcgcaagtaccactactccggcgccgcctgcccggacttccgcaagggcgggtgcaagcgcggcgacggctgcgacatggcgcacggcgtcttcgagtgctggctccacccggcgcgctaccgcacccagccctgcaaggacggcacggcctgccgccgccgggtctgcttcttcgcgcacaccgcggaccagctgcgcgtgctcccgcccacgcctcagcagcagtccagccccagggggcgccgcctgctcttccnncgctcgccgagtcctacgacggctccccgctccgggcgccag

SEQ ID NO: 74646 - protein, 205 aa, Zea mays
  misc_feature: Ceres CLONE 1559082
  misc_feature: The sequence is a functional homolog of SEQ ID NO 1138 in the 11/479,226 US patent application
  misc_feature: The sequence is a functional homolog of SEQ ID NO 500 in the 10/412,699 US patent application
  misc_feature (191)..(191): Xaa is any aa, unknown, or other
MMMMGEGVSMPPWSHHVPVSGVDEGDEMTPYLLAALRQYLPCNDAGAEAEEDEAAAAMAAGVDGYGCDEFRMYEFKVRRCARARSHDWTECPFAHPGEKARRRDPRKYHYSGAACPDFRKGGCKRGDGCDMAHGVFECWLHPARYRTQPCKDGTACRRRVCFFAHTADQLRVLPPTPQQQSSPRGRRLLFXRSPSPTTAPRSGRQ

SEQ ID NO: 74647 - DNA, 765 bp, Zea mays
  misc_feature: Ceres CLONE 1559083
  misc_feature: Encodes the peptide sequence at SEQ ID NO. 74648
  misc_feature (467)..(467): n is a, c, t, g, unknown, or other
ggagctcaccgcggtggcggccgctctagaactagtggatcccccgggctgcaggaattcgtctcacccctagaaaaaatcccacgctgccctcggcgctgcgcctggacccggcacctacctcccccctccccacctcgccgccggcgggtggagtcgggctggagcagccgctctcctctgttacccccctaaccccctataaagaaaaagaaaaaaaaacagagagagagagcgagcgaaccggcggctcggcagccatggggcacggcgtcagctgcgcccgcaccggcgacgagcacgactacttccgcgcggcgcaggtcggggacctcgaggccctggacgcgctcctcgacgccgacccctctctcgcccgccgcgccacgctctacgaccgcctctccgcgctgcacatcgccgccgcgaatggccgcctcgaggtgctgtcaatggtcttggatcancgggtgccgccagacgtggtgaatcggcacaagcagacgccgctgatgctcgcggcgatgcacggcaaagactgactgcgtgctgaaactcctgcaggccggcggccaatatccccatgttcgattcccagcacgggggggacctgcctggcaccaggggttcctaattttgggccaactttgggtggcttggaaggccaatccttcacgggggggcccgggaaacaacgcccgggggcccaaacccatgggggggttccccccccgggttcttcccaaaacgggaggggagaaaacc

SEQ ID NO: 74648 - protein, 93 aa, Zea mays
  misc_feature: Ceres CLONE 1559083
  misc_feature (69)..(69): Xaa is any aa, unknown, or other
MGHGVSCARTGDEHDYFRAAQVGDLEALDALLDADPSLARRATLYDRLSALHIAAANGRLEVLSMVLDXRVPPDVVNRHKQTPLMLAAMHGKD

SEQ ID NO: 74649 - DNA, 807 bp, Zea mays
  misc_feature: Ceres CLONE 1559085
  misc_feature: Encodes the peptide sequence at SEQ ID NO. 74650
  misc_feature (807)..(807): n is a, c, t, g, unknown, or other
ctccccgcggtggcggccgctctagaactagtggatcccccgggctgcaggaattcgtctcacccctagaaaaactcgcaggcgcggcgaccggcttcaaccccaactcttcttcttcttcctcgcaaacttcgaacgggacgagaaggaagcggacgcgagaggagactaaccgacctcggatccatcgacgcgtgaagatgtcttcgcccgccgagtactacaaatcacttccacctataagcaaggcatatgggacattgtgtttctttaccaccgtgctagttcagctccagattttgcacccattatttctttacttagattaccccttggtgttcaagaagtttgagatatggaggctattgacaagtttctttttcctggcaccattttccatgaaatttggtattcgccttctgatgatagcaaggtatggtgtcatgttggaaaagggtgcatttgataagcggactgcagatttcttatggatgatgatatttggtgccatctcactattggtgttgtctattattcccctattcaattcttttttcttaggaatacctatggtcagcatgctcctttatgtctggagccgagagaatccaaatgctcagataaatatatacggcctcgtccaattgaggtcgttttatctcccatgggctatgctcttattggatggtgatatttgggtcatcataaatgcctggacttctgggtatcatggatgggacatctctactacttcccttgccggggtggcacccatcctgccaacggggaagaactaactccagaatn

SEQ ID NO: 74650 - protein, 198 aa, Zea mays
  misc_feature: Ceres CLONE 1559085
  misc_feature (11)..(185): Pfam Name: DER1 Pfam Description: Der1-like family
MSSPAEYYKSLPPISKAYGTLCFFTTVLVQLQILHPLFLYLDYPLVFKKFEIWRLLTSFFFLAPFSMKFGIRLLMIARYGVMLEKGAFDKRTADFLWMMIFGAISLLVLSIIPLFNSFFLGIPMVSMLLYVWSRENPNAQINIYGLVQLRSFYLPWAMLLLDGDIWVIINAWTSGYHGWDISTTSLAGVAPILPTGKN

SEQ ID NO: 74651 - DNA, 796 bp, Zea mays
  misc_feature: Ceres CLONE 1559086
  misc_feature: Encodes the peptide sequence at SEQ ID NO. 74652
  misc_feature (485)..(485): n is a, c, t, g, unknown, or other
  misc_feature (546)..(546): n is a, c, t, g, unknown, or other
ctcaccgcggtggcggccgctctagaactagtggatcccccgggctgcaggaattcgtctcacccctagaaaaaaatccagcaatacccgagtacccaacgcgctagctagttctattgccgcaccccagatctccaggagggactcgttctttcagctaactacactgcacgcaatggccaccacggcgaccgaggcggcgccggcgcaggagcagcaggccaacggcaacggcgagcagaagacgcggcactccgaggtcggccacaagagcctgctcaagagcgacgacctctaccagtacatcctggacacgagcgtgtacccgcgggagccggagagcatgaaggagctccgcgaggtcaccgccaagcacccatggaacctgatgacgacctccgccgacgaggggcagttcctgaacatgctcatcaagctcatcggcgccaagaagaccatggagatcggcgtgtacaccggctacntcctcctcgccacggggctcgccctccccgaagacggcacgatcttgggcatggacatcanccgcgagaactacgagctgggcctgccctgcatcgagaaaggcggcgtcgcccacaaaatcgacttccgcgaggccccgcgctccccgtcctcggagacctcattggggagagaaaaccacgggtcgttcaaattcgtcttcgtggaagcccgaaaaggaaaattcctcaactcccaaaaaagggtgcttaaaacctgggaaaactgggggcccttcttcgggtaaaaaaaacccgttggggaaaccgcc

SEQ ID NO: 74652 - protein, 198 aa, Zea mays
  misc_feature: Ceres CLONE 1559086
  misc_feature (45)..(189): Pfam Name: Methyltransf_3 Pfam Description: O-methyltransferase
  misc_feature: SWISSPROT Homolog: EC 2.1.1.104 Caffeoyl-CoA O-methyltransferase
  misc_feature (104)..(104): Xaa is any aa, unknown, or other
  misc_feature (124)..(124): Xaa is any aa, unknown, or other
MATTATEAAPAQEQQANGNGEQKTRHSEVGHKSLLKSDDLYQYILDTSVYPREPESMKELREVTAKHPWNLMTTSADEGQFLNMLIKLIGAKKTMEIGVYTGYXLLATGLALPEDGTILGMDIXRENYELGLPCIEKGGVAHKIDFREAPRSPSSETSLGRENHGSFKFVFVEARKGKFLNSQKRVLKTWENWGPFFG

SEQ ID NO: 74653 - DNA, 816 bp, Zea mays
  misc_feature: Ceres CLONE 1559090
  misc_feature: Translation starting site: 92
  misc_feature: Pfam Name: Radical_SAM Pfam Description: Radical SAM superfamily
  misc_feature (618)..(618): n is a, c, t, g, unknown, or other
ccccgcggtggcggccgctctagaactagtggatcccccgggctgcaggaattcgtctcacccctagaaaaacgattacggccacaagggcatgaacacacttctatcactcgaggaaacttatgctgatatcaccccagtaaggatctctgacaattcaattacggcatttgtgtcaatcatgagaggttgcaataatatgtgctcattctgcatagttcccttcactagaggtagggaaaggtctcgcccagtgtcttctattgtccgtgaggttggtgagctatggaaagttggtgtgaaggaggtaatgcttcttggtcagaatgtaaacagctataatgacacttctgaagtagaagagttggagcctggcaaaaattggcaactcagtgaaggattttccagcatgtgcaaggtgaagaatatggggctgcgttttgctgatctcctggatcgattatctttggaataccctgagatgcggttcaggtttacctcaccacacccaaaggatttcccagatgagctactgtatttgatgcgggataggtataacatctgcaatcttattcacttaccagcacaaacaggcagtacagcggcgctggaacgaantgcggaggggttacactcgagaagcatacttagaacttgtccacaaaattcgtgatgtcattcctgatgttgggctaagcagtgatttcataactggcttttgtggagagacagaagacgagcacgccgagacccttagcctttgtgagggctgttggatacgacatggcctacatgtttgcatacagcatgaagaaa

SEQ ID NO: 74654 - DNA, 847 bp, Zea mays
  misc_feature: Ceres CLONE 1559092
  misc_feature: Encodes the peptide sequence at SEQ ID NO. 74655
  misc_feature (505)..(505): n is a, c, t, g, unknown, or other
  misc_feature (630)..(630): n is a, c, t, g, unknown, or other
ggagctcaccgcggtggcggccgctctagaactagtggatcccccgggctgcaggaattcgtctcacccctagaaaaaaagaagaacatcgccattgcagcaagtctgtatgatctgtgacagctgtcgatagaattatcacacacattcgttattcgttgaactaaaaccatggcgaggccgtccgaccaaagcggcgtccacgtcctcctgctcccattccccacgcagggccacatcaacccgctgctccagttcggcaagcggctcgccggccgcgctggcgtccggtgcacgctcgcggcgacccgcttcgtcgtcagctcgacgaagccgaccccgagctcggtccacgtcgccgtgatctccgacggctgcgacgagggcggccccgccgaaggtgggagggatgggcgcgcgctacttcgagcgcctcgaggcggccgggtccgagacgctggacgaggtcctccggtcggagtcggcgctggggcggccggtgcancgtggtggtgtacgacgcgttcgcaccctgaggcgcagcgcgtggcgcggcggcgcggcgccgcgtgcgcggcgttcctcacgcagacgtgcgccgtgggacatcgtgtacgcgcacgcgtgggnccgggcggggtgccggtgccgcccctgccgctgcgccccgaagaggcgcgggggcctggctcttggctgggctgtcgaccccagctcgagggggcgaaccatgccgacgttcttgggcgacaccaggtttcccacgtgcttccgggagctgctgattgacccagttcctggggctggacaccgccgaacacgtggctcgtccactcgttctacgacc

SEQ ID NO: 74655 - protein, 205 aa, Zea mays
  misc_feature: Ceres CLONE 1559092
  misc_feature (11)..(73): SWISSPROT Homolog: EC 2.4.1.121 Indole-3-acetate beta-glucosyltransferase
  misc_feature (5)..(36): SWISSPROT Homolog: EC 2.4.2.40 Zeatin O-beta-D-xylosyltransferase
  misc_feature (112)..(112): Xaa is any aa, unknown, or other
MARPSDQSGVHVLLLPFPTQGHINPLLQFGKRLAGRAGVRCTLAATRFVVSSTKPTPSSVHVAVISDGCDEGGPAEGGRDGRALLRAPRGGRVRDAGRGPPVGVGAGAAGAXWWCTTRSHPEAQRVARRRGAACAAFLTQTCAVGHRVRARVGPGGVPVPPLPLRPEEARGPGSWLGCRPQLEGANHADVLGRHQVSHVLPGAAD

SEQ ID NO: 74656 - DNA, 852 bp, Zea mays
  misc_feature: Ceres CLONE 1559093
  misc_feature: SWISSPROT Homolog: EC 1.11.1.15 Peroxiredoxin
  misc_feature (802)..(802): n is a, c, t, g, unknown, or other
aagctggagctccccgcggtggcggccgctctagaactagtggatcccccgggctgcaggaattcgtctcacccctagaaaaaagcaccaaccccggcaaaggcggaaacccatcgcaactaatccccaaccccaaacctccaatccacccatcccctcctcatccacatccgaggaggacatggactgctccttagccaccgcgaccgtcgtctcttccgcccccaccccggccgccaggcccctcaacgctgccccgcagtccgtctctgtttcccgctccgcggtcgcgcaccgccggcaggccgctccgccacctctcctccagatccgcccaggacatcaaacctcatctcccgcgccggcggcgtcaactactagccgctcgacgagaacaaggcccccgacttcggaagccgatggcgcgcgctcgaccaacaattcatcaacggcaagctctctgaatacatcggaaaaaaacaccccgttctattcttctaccccttggactgcagcatttgtctgcccaaccaacattactgccctcagtgacagatatgaggaattcgagacagtgaacactgaggttcttggtgcactctaacgacagcgtggtcacccaccttgcatgactgcagacacacacgaagtctggtgggcttggcgatcttaaatacccacttagctctgatgtcacccaatcaatggcataggccattcagtgttctgatccctgaactagcgtatctctctgaacagaccgttcatcatcgacaattgacgggatgattcaacacactancatctataagctgacacttgctaccagggtggacgagaccctgtagaccc

SEQ ID NO: 74657 - DNA, 758 bp, Zea mays
  misc_feature: Ceres CLONE 1559094
  misc_feature: Encodes the peptide sequence at SEQ ID NO. 74658
  misc_feature (421)..(421): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (503)..(503): n is a, c, t, g, unknown, or other
  misc_feature (504)..(504): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (523)..(523): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (549)..(549): n is a, c, t, g, unknown, or other
  misc_feature (550)..(550): n is a, c, t, g, unknown, or other
  misc_feature (554)..(554): n is a, c, t, g, unknown, or other
  misc_feature (556)..(556): n is a, c, t, g, unknown, or other
  misc_feature (557)..(557): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (583)..(583): n is a, c, t, g, unknown, or other
  misc_feature (584)..(584): n is a, c, t, g, unknown, or other
  misc_feature (626)..(626): n is a, c, t, g, unknown, or other
  misc_feature (660)..(660): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (675)..(675): n is a, c, t, g, unknown, or other
  misc_feature (687)..(687): n is a, c, t, g, unknown, or other
  misc_feature (690)..(690): n is a, c, t, g, unknown, or other
  misc_feature (691)..(691): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (702)..(702): n is a, c, t, g, unknown, or other
  misc_feature (703)..(703): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (713)..(713): n is a, c, t, g, unknown, or other
  misc_feature (716)..(716): n is a, c, t, g, unknown, or other
  misc_feature (727)..(727): n is a, c, t, g, unknown, or other
tggagctcaccgcggtggcggccgctctagaactagtggatcccccgggctgcaggaattcgtctcacccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgtggcaagcccaaggtggcggcgtccggcagcccctggtacggccccgaccgcgtcaagtacctcggtccccttcgccgaagctcaagggtgaacggaagctctaagaaacgggcccgcccctttgggccccattggggttttttttcccccctttgtttttcccccggggcttttttttntnnnnnnnnnnnnnnnnnnnnnnnnnnnnnnntnnnnnnnnnnncnnnnnnngnnnnggnnnnngnnncgnnnnnnnnnngnngtnnnnngggnnnnnnccnccnnnncggcccccgcccccnnngcnngggngnngggggggggggggggnnnncggtttnngggcgggtgggggggggtgggggtggtggggggcgggggggnggggggcggccgcgcgtgcggctgtgcgccggtngccccccccnnnncnccccgccgcccntcnnccccccnnncnntnnncgtttnttntcgccccttcnttttcccgtttgtgggtggggtgggcggtgt

SEQ ID NO: 74658 - protein, 68 aa, Zea mays
  misc_feature: Ceres CLONE 1559094
MAASTMAISSTAMAGTPIKVGSFGEGRITMRKTVWQAQGGGVRQPLVRPRPRQVPRSPSPKLKGERKL

SEQ ID NO: 74659 - DNA, 811 bp, Zea mays
  misc_feature: Ceres CLONE 1559096
  misc_feature: Encodes the peptide sequence at SEQ ID NO. 74660
  misc_feature (809)..(809): n is a, c, t, g, unknown, or other
agctccccgcggtggcggccgctctagaactagtggatcccccgggctgcaggaattcgtctcacccctagaaaaaatatccgcatccgctgcctccgcctctcgagtctcgtccacccgtcgtcctcctagctcctctactcgccagtcgccatgggcaagattaagatcggaatcaacggcttcggaaggatcggcaagctcgtggccagggtcgccctccagagcgaggatgtcgagctcgtccccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcgcccatgtttgttgttggtgtcgatgaggacaagtacacctcggatgctaacattgtttccaatgctagctgcaccacaaactgccttgctccccttgctaatgtcattcatgacaacttcggcattgattgagggtgtgatgacaactgttcatgccatcactgccacccagaaaactgttgacggaccctcaatcaaggactggagtagtggcaggactgccaactttaccatcattctagcagcaccggtgctgaccaagctgntt

SEQ ID NO: 74660 - protein, 173 aa, Zea mays
  misc_feature: Ceres CLONE 1559096
  misc_feature (4)..(154): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGKLVARVALQSEDVELVPVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVDEDKYTSDANIVSNASCTTNCLAPLANVIHDNFGID

SEQ ID NO: 74661 - DNA, 837 bp, Zea mays
  misc_feature: Ceres CLONE 1559098
  misc_feature: Encodes the peptide sequence at SEQ ID NO. 74662
  misc_feature (427)..(427): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
tggagctccccgcggtggcggccgctctagaactagtggatcccccgggctgcaggaattcgtctcacccctagaaaaagtaagatgcttgaatgtttgcggttggaatcctgctctttgataaatgagaagggactaaaacgaattgcaacttgttgccccaatcttaaggagatagacctcactgactgcggagtggatgatgcagcattggagcacttggctaaatgctctgaattgagagtattgaaattaggcctatgctcaagtatttctgacaaaggcattgcgtttattagttcaaattgtggaaagcttgtggagcttgatctctaccggtgcagctctattaccgatgatgggttggcagctttagcaaatggatgcaagaggatcaagttactgaacttgtgttactgcaacaagnatcactgatagtggtttgggtcacttaggctccctggaggagctcacaaaccttgaactgaggtgcttggtccgcataacaggcattgggatctcctcagttgcaatcggatgcaagaacctgatagagctggacttgaaacgatgctattcggttgatgacgctggcctgtgggctcttgctcgttatgctttgaaccttagacagcttacgatatcgtactgcccagtcacggggctggggcctgtggnnnactgctgagctccctgcggtgccctcaggaacattaagatggtgcacttcctcatgggtatcccctagaaagggttccaagatcccatttgcaaagcaaccctgcggggaaggctgaaaaaacctaaaaaaatgctctgtggggcccgaaaaaaccc

SEQ ID NO: 74662 - protein, 116 aa, Zea mays
  misc_feature: Ceres CLONE 1559098
  misc_feature: SWISSPROT Homolog: EC 1.14.11.27 [Histone H3]-lysine-36 demethylase
  misc_feature (115)..(115): Xaa is any aa, unknown, or other
MLECLRLESCSLINEKGLKRIATCCPNLKEIDLTDCGVDDAALEHLAKCSELRVLKLGLCSSISDKGIAFISSNCGKLVELDLYRCSSITDDGLAALANGCKRIKLLNLCYCNKXH

SEQ ID NO: 74663 - DNA, 778 bp, Zea mays
  misc_feature: Ceres CLONE 1559100
  misc_feature: Translation starting site: 123
ggagctcaccgcggtggcggccgctctagaactagtggatcccccgggctgcaggaattcgtctcacccctagaaaaaaagccggacgacgcagcgtagcagcagagagccagagaccagagatggccgccctcgccgccgcctccacggccgccttcgccgcgaagccgcgcgcgcgcctctccgtggcctgctccgccgccaccggcgacagcagcagcgtgtcgcttgcgtcctccgtgaagacgttctccgccgcgctggcgctgtcgtcggtgctgctgtcctcggccgccacctcccctccgcccgcggccgccgacatcgcggggctgaccccgtgcaaggagtccaaggcgttcgcgaagcgcgagaagaactcgatcaagaagctcaccgcgtcgctgaagaagtacgcgcccgacagcgcccccgcgctcgccatcaacgccaccatcgagaagaccaagcgccggttcgagaactacggcaagttcgggctgctgtgcggcgccgacggcctgccgcacctcatcgtcagcggcgaccagcggcactggggcgagttcgtcaccccgggcctgctcttcctctacatcgccggctgggatacgggtgggtcggcaggagctacctcatcgccatcagcggcgagaagaagcccgcccttgagggagatcatcatcgacgtcgagctcgccacccggcctcatccccagggggtttcatctgggcccgtcgcccgcctaccgcgagctcattcacggggggacctcgt

SEQ ID NO: 74664 - DNA, 730 bp, Zea mays
  misc_feature: Ceres CLONE 1559101
  misc_feature: Encodes the peptide sequence at SEQ ID NO. 74665
  misc_feature (478)..(478): n is a, c, t, g, unknown, or other
ggagctcaccgcggtggcggccgctctagaactagtggatcccccgggctgcaggaattcgtctcacccctagaaaaaagccgcatcccttctttcattcgccgccgccgcctgctctctgctgccgtcgccatggggcagaaggcctgcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcgggtccgggttcaccccattcatgtccttcgtatcaacaagaatgcttccgtgtgctgggggctgataggctaccaaactggnaatgagggggggcctttgaaaacctccggggactggggtaaggtgggaattgggcaggccccccctttgtgttcaaagcagggaaaaaatgggtccattcccccggaaaaccttctctctccccccccaaatttcaagttttcccctggccgccacaaaatttttttgaaaaccacaaaggggggggtctcccaaaaaaaaaaccccccgcgcaacacccctttataaataaaaagggggggggggggaatt

SEQ ID NO: 74665 - protein, 153 aa, Zea mays
  misc_feature: Ceres CLONE 1559101
MKRKGVDEFPYCVHLVSWEKENVSSEALEAARIACNKYMTKSAGKDAFHLRVRVHPIHVLRINKNASVCWGLIGYQTGNEGGPLKTSGDWGKVGIGQAPPLCSKQGKNGSIPPENLLSPPPNFKFSPGRHKIFLKTTKGGVSQKKNPPRNTPL

SEQ ID NO: 74666 - DNA, 819 bp, Zea mays
  misc_feature: Ceres CLONE 1559102
  misc_feature: Translation starting site: 152
  misc_feature (588)..(588): n is a, c, t, g, unknown, or other
  misc_feature (672)..(672): n is a, c, t, g, unknown, or other
  misc_feature (737)..(737): n is a, c, t, g, unknown, or other
ggagctccccgcggtggcggccgctctagaactagtggatcccccgggctgcaggaattcgtctcacccctagaaaaagacgcgacccgacacacaaatatctccaccccctgttccggcgacgactacgatttgggaggaaggtaagcgaatgggtgaggaggcggtcgacgactacgagctccacatggtgtgctacggcggcggcggcgaggacgagcgcgtgatggagtgggagtcaggtctcccgggcgccgacgagctgaccccgctgtcgcagccgctggtgccggcgggtctggcagcggcgttccgcatcccgccggaggccgggcggacgctgctggacgtgcaccgcgcgtcggctgccacggtgtcccggctgcgtcgcgcgccgccgccgtcgtcgtcgggcagcggagggagctcctccttcgcgcccttccatccggcggcgaggggggacgaaggggcggactcgtcggcggcgggcggcggggcggcggcgacgacgaacggcaacaataacatgagcagcagcagcaagcggcccccggctggtgtggacgccgcagctgcacaagcggnttcgtggacgtggtggcgcacctggggatgaagaacgcggtgcccaagaccatcatgcagctgatgaacgtggaagggctgacngcgggagaacgtggccagccacctgcagaagtaccgcctctacgtcaagcggatgcagggcctcntcgacgagggccccgtcgccgtccgaccacatcttcgcatccccgccggtgccgcaaagctgggtgcatgaagtggccatgt

SEQ ID NO: 74667 - DNA, 728 bp, Zea mays
  misc_feature: Ceres CLONE 1559104
  misc_feature: Encodes the peptide sequence at SEQ ID NO. 74668
ggagctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggatgggacaccgccgggctgtccgccgaccccgagaccttcgccaagaaccgcgagctggaggtgatccactcccgctgggccatgctcagcgcgctcggctgcgtcttccccgagctgatcatccgccacggcgttaagttggcaaggccctcttgttcaagggcggatccaagattttcacgatggccggctgaacttcctgggaaaccccaacctgatcacacccccaaaaaattcccccccaatttggggcctgcccaaggttgggcctcttggggggcccccccaaaaggccaaacccaaattgccgggggggggccccttctggaaaagagcctcctaaacacccctgttgtaaaccccgggggggggt

SEQ ID NO: 74668 - protein, 199 aa, Zea mays
  misc_feature: Ceres CLONE 1559104
  misc_feature (61)..(188): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLSALGCVFPELIIRHGVKLARPSCSRADPRFSRWPAELPGKPQPDHTPKKFPPNLGPAQGWASWGAPPKGQTQIAGGGPLLEKSLLNTPVVNPGGG

SEQ ID NO: 74669 - DNA, 825 bp, Zea mays
  misc_feature: Ceres CLONE 1559105
  misc_feature: Encodes the peptide sequence at SEQ ID NO. 74670
tggagctccccgcggtggcggccgctctagaactagtggatcccccgggctgcaggaattcgtctcacccctagaaaaaactcgcttcgtccgcgttcggatcgccctcaggtcaaccaccactcctcccctctgttcctctcagcatctcgcgcttcagatctcgcccaccgatctggaactggaattccctcccgatctgtatctcacgcacgcttgctcgcgttcgtggctttgctcccacctctctctctagcagagtaacagtctagcagagcaagcatgtcgtcgtcggcggagaacgaccccacggcgtcggtgaccgagcgcggaggcaaggacaagcacgaggacggcggcgacaacgagcagggcggcggcggcttcatcgacaaggtgaaggacttcatctacgacatcggcgagaagatcgaggaggccgtcgggttcggcaagcccacggccgacgtgtgcggcatccacatcccgcacatcagcctccgccgcgccgacctcgtcgtggacgtgctcatcaagaacccgaacccggtcccgatcccgctcgtggacatcgactacctcatcgacagcgaccgccgcaagctggtgtcaggcctcagctcggacgccggcaccatccacgcgcacggccaggagaccgtctagatccacgtcgtctctcgtcttcaacgacatcaagagcacctacatggacatccaggcgggcagcatcatcccttacctcgatccgcatggtgactctcgttgacaccccattcatcgcctgcgtcagatcccgatctgaaaggacggggagatcccatc

SEQ ID NO: 74670 - protein, 127 aa, Zea mays
  misc_feature: Ceres CLONE 1559105
  misc_feature (33)..(128): Pfam Name: LEA_2 Pfam Description: Late embryogenesis abundant protein
MSSSAENDPTASVTERGGKDKHEDGGDNEQGGGGFIDKVKDFIYDIGEKIEEAVGFGKPTADVCGIHIPHISLRRADLVVDVLIKNPNPVPIPLVDIDYLIDSDRRKLVSGLSSDAGTIHAHGQETV

SEQ ID NO: 74671 - DNA, 770 bp, Zea mays
  misc_feature: Ceres CLONE 1559106
  misc_feature: Encodes the peptide sequence at SEQ ID NO. 74672
ggagctcaccgcggtggcggccgctctagactagtggatcccccgggctgcaggaattcgtctcacccctagaaaaaaacctcatcttctctccttttgctcggaaagcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacaggcgcacgctggccgactacaacattcagaaggagagcaccctccacttggtgttgcgtctcaggggcggcatgcacatatttgtgaagactctgactggcaagactatcacccttgtacgtcgagtcttctgataccatcgacaatgtcaacgtcaagatccaggacaaggagggcatccctcccggaccacagcttggaggatggccgtacccctcgccgactacaaaa

SEQ ID NO: 74672 - protein, 172 aa, Zea mays
  misc_feature: Ceres CLONE 1559106
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDRRTLADYNIQKESTLHLVLRLRGGMHIFVKTLTGKTITLVRRVF

SEQ ID NO: 74673 - DNA, 790 bp, Zea mays
  misc_feature: Ceres CLONE 1559107
  misc_feature: Translation starting site: 109
  misc_feature (513)..(513): n is a, c, t, g, unknown, or other
tacccgcggtggcggccgctctagaactagtggatcccccgggctgcaggaattcgtctcacccccgagaccccaagcaccagcgcggcggcggcggcggcggcgaccatggctgtcgggaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaattgaggtccctagtgaagaagtggcagacattaatcgaagcccatgttgatgtcaagacaaccgacaactacatgttngcgtttgttctgcatcggcttcaccaagaggcgcccaaaccaggtcaagagaacctgctatgctcaggcatcccagatccgtcagatccgccgtaagaatggttgagattatgatcaacccaggcttctacatgtgaccctgaaagaactttgtttcgaattccattcccgaaattatttgggtaaggaaaatttgaaaaaattttccctccagaaatttttcccccatttaaaaaaagtttttttttcccccaagggggggaaaaaaaattcccac

SEQ ID NO: 74674 - DNA, 804 bp, Zea mays
  misc_feature: Ceres CLONE 1559108
  misc_feature: SWISSPROT Homolog: EC 4.2.1.52 Dihydrodipicolinate synthase
  misc_feature (14)..(14): n is a, c, t, g, unknown, or other
  misc_feature (15)..(15): n is a, c, t, g, unknown, or other
  misc_feature (30)..(30): n is a, c, t, g, unknown, or other
  misc_feature (31)..(31): n is a, c, t, g, unknown, or other
  misc_feature (38)..(38): n is a, c, t, g, unknown, or other
  misc_feature (696)..(696): n is a, c, t, g, unknown, or other
  misc_feature (744)..(744): n is a, c, t, g, unknown, or other
tggagctccaccgnncggtgggcgggccgnnctctagnaactagtggatcccccgggctgcaggaattcgtctcacccctagaaaaagtctactgatagtcctgtcctgtttcactctcgccagccaaagacgaccacgccctccgtgctccagccattccccatgatttcgccgacgaatctcctcccggcgcggtagatcacccctgtctcatatggcggcgcagcgacggctagcccctcttctcccctcgtggccgcgacgacacggctactcccttcagccctcaatctgtgactggtacaggatatgtttcctttgcagccatccctctaaatgactaccgttccatggccagccctgaattgaaaaaccgggatccaacctatgattccccgagggcgtaaccattccaagtgggtttaaacccccctatttccaaagtgggagggcccatcttgaaaacataggtctcctccttaaaacccccaataaagggggtgggcccaaaggttttatttttgggggaaacacccggggggggggcccccccttgggcgggggggaaaaaattttttttctctctttgtggccccccggggaaaaagtttctttgtttttttatttattaggggggggggggccccacccggggggagaaccctctctcccggagggagccgcccccccccccnaaaaaaaaaaaaagattttttttttggtggggggaggaaaaaaaaggncccctccccccccaatatttctttccttaccctgagaaaaaacacccccccctcctgagg

SEQ ID NO: 74675 - DNA, 930 bp, Zea mays
  misc_feature: Ceres CLONE 1559114
  misc_feature: Encodes the peptide sequence at SEQ ID NO. 74676
ctccccgcggtggcggccgctccagaactagtggatcccccgggctgctggaattcgtctcacccctagaaaaaagtgagagggaagtaactgccgcatctcaagtctcaaccctcgcctccaatcgcgccgctcccgaggagagccaggaggaggtgacggcggcgccgcgaggaaggagggatcgatcgaggatggtggacgtctcgcgcgtgcagaaggagctcaccgagtgcaaccgcgaccgggaggtatcgggcgtctccatcgcgctccacgacggcgccaacatctcccacctcaccggcaccatcgccgggcccgccgacagcccctacgagggcggcacgttcgtcatcgatatccgcctgcccggtggatatccctttgagcctccgaagatgcagttcatcacctaagtatggcaccctaacatcagcagccaaaatggagcaatttgcttggacattctgaaagatcagtggagcccagcccttaccttgaagactgctctccctttcccttcaagctctgcttttcttctccctgcactgatgatcctcaggatgctgttgttgccccacagtacctgcgtgactatccaacatttgccgctacgggctcgtactggaaagaggccttgcgaaagtgcatcaccggggctggaaaaaaggggcaaaccctgggttaaatgggttccccaaagatcaggggaaaatggcctgaaaaagggggattggaaacaaaacaggcgccccaaaaacctcgcccgggcccgggggaaccattgtttggggccaattattgagaggggtatttttaaaggcccgctatggcccccgcccaccctttttttgtgggccccccttgccccgggagctggggggaaaccccaggaaaacacgcctcttttaaaccctggggggtggg

SEQ ID NO: 74676 - protein, 74 aa, Zea mays
  misc_feature: Ceres CLONE 1559114
  misc_feature: SWISSPROT Homolog: EC 6.3.2.19 Ubiquitin--protein ligase
MVDVSRVQKELTECNRDREVSGVSIALHDGANISHLTGTIAGPADSPYEGGTFVIDIRLPGGYPFEPPKMQFIT

SEQ ID NO: 74677 - DNA, 941 bp, Zea mays
  misc_feature: Ceres CLONE 1559115
  misc_feature: Encodes the peptide sequence at SEQ ID NO. 74678
  misc_feature (778)..(778): n is a, c, t, g, unknown, or other
ctggagctccccgcggtggcggccgctctagaactagtggatcccccgggctgcaggaattcgtctcacccctagaaaaaacggagccttccggataggatttgtctcccctccactgcgcctctccgtttccgccatggctccggccgccgccttcctgtcggcgtgcgccgctggttccattccccgtgcgcccttcctgatcccgaggcctcttcttctcccaattccgctctcccctgcgcgctgggaccgctcccgcagctgcagcctctttggcgtaggcgccaacactcgccgcgcgccaacccttcgacggaacgcctccacggagacggtggttccctacgtgccgggctctggcaagtacatagcgccggactacctcgtgaagaaggtgtcagccgaggaggtgcaggagctggtgagggggcagaggaaggtgccgctcatcgttgacttctacgcgacctggtgcgggccctgtgttcagatggcgcaggacatcgagatgcttgcagttgagtatgaggacaatgccctgtttgtgaaggtggacacagatgatgaatatgaatttgcaaaagacatgcaggtaagagggcttccgaccctttacttcttcagtccagaccaaaacaaagatgccatacgcaccgaggggctaattcctatggatatgatcagaaacatcattgacaacgagttatgacagctgatagatcactgtattaggaacataagcaatgttttatctttgtagcaaaaaatttttggncatgagctaaacattaccgctaagtgctaggttgtgtgcttggagttttcttttccccaatgggagggttcatcggtgcaaacccttccgcgtgttccgtgtccggttgtttatctcacaaaaccaaggtttggccggcctttgccggttagccctgtgtacc

SEQ ID NO: 74678 - protein, 191 aa, Zea mays
  misc_feature: Ceres CLONE 1559115
  misc_feature (84)..(190): Pfam Name: Thioredoxin Pfam Description: Thioredoxin
  misc_feature: SWISSPROT Homolog: EC 1.8.1.8 Protein-disulfide reductase
MAPAAAFLSACAAGSIPRAPFLIPRPLLLPIPLSPARWDRSRSCSLFGVGANTRRAPTLRRNASTETVVPYVPGSGKYIAPDYLVKKVSAEEVQELVRGQRKVPLIVDFYATWCGPCVQMAQDIEMLAVEYEDNALFVKVDTDDEYEFAKDMQVRGLPTLYFFSPDQNKDAIRTEGLIPMDMIRNIIDNEL

SEQ ID NO: 74679 - DNA, 956 bp, Zea mays
  misc_feature: Ceres CLONE 1559116
  misc_feature: Translation starting site: 168
ctccccgcggtggcggccgctctagaactagtggatcccccgggctgcaggaattcgtctcacccctagaaaaaaccaccggcgagccacatcgagaacacgatcgagcacacaagcacgaagactcgtttaggagaaaccacaaaccaccaagccgtgcaagcatcatggagtacggtcagcaggggcagcgcggccacggcgccacgggccatgtcgaccagtacggcaacccagtcggcggcgtcgagcacggcaccggcggcatgaggcacggcacgggaaccaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaagggagaaagaagggaaatcaaggagaagatccaagagaagcctgcccggaaggccacaaggacgaccaggcacgcccacggcgacgaccgggcggcgccctatggggcaggcagggacacacccgggcagcggcctacggggcagcaggggacacacccggcgggcgccttacgcccacccggggaaccgagggggcaccgggggaagaaggaaagggctttatgggaccaaaattccagggaaaaagccgtcccccggaaacagactttgaacgggggcccttaataccctgggctgtgccttgtggctggggccttgggcccggttaaaaagccgttatccctttcagggggtccccttagaataaggtaagaataaccccccgtgtgaataaagtggtccccctcacccctttgatattttggttacaaggggaaccagggaacaagtttctctggtactcttgtggggggggggagaatatgttcaccgcgttgtaataaccggcgacaaa

SEQ ID NO: 74680 - DNA, 923 bp, Zea mays
  misc_feature: Ceres CLONE 1559117
  misc_feature: Encodes the peptide sequence at SEQ ID NO. 74681
  misc_feature (731)..(731): n is a, c, t, g, unknown, or other
aaagctggagctccccgcggtggcggccgctctagaactagtggatcccccgggctgcaggaattcgtctcacccctagaaaaaacacaagcgctaaaaccctctccaccgtccacctcagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaaggttgttatctctgccccaagcaaagatgcgcccatgtttgttgttggtgtcaatgaggacaagtacacctccgatgttaacattgtttccaatgctagctgcaccacaaactgccgtgctccccttgcgtacgtcattcatgacaactctggcattattgagggcttgatgancactgttcatgccatcactgcaacccagaagactgttgatggaccctcagccaagactggatgagtggcagggctgccagctttatcatattcccagcagcaccggtgctgccaaggctgtccggaaagttcttccggaatggaatggaagctcactggcatgtccttccgggtttccccggggaatgggta

SEQ ID NO: 74681 - protein, 198 aa, Zea mays
  misc_feature: Ceres CLONE 1559117
  misc_feature (4)..(154): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (178)..(178): Xaa is any aa, unknown, or other
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCRAPLAYVIHDNSGIIEGLMXTVHAITATQKTVDGPSAKTG

SEQ ID NO: 74682 - DNA, 923 bp, Zea mays
  misc_feature: Ceres CLONE 1559118
  misc_feature (752)..(752): n is a, c, t, g, unknown, or other
caaagctggagctccccgcggtggcggccgctctagaactagtggatcccccgggctgcaggaattcgtctcacccctagaaaaagtacttcgctgaagagagcccactagatccaaaagatacacaaggactatcagattctgctcctctgctgaacggttctagagatgctgcccatgcatcaaatgaaccaaataatgaaagatttcctaatggccatgtgggtttaaacaatgtgtcggctaacaacaacactgaggaatttacaaatgtgaattccaacacagagaaaggaggagtcttcaatgatgggccaggagcagttttggttaacattttgaccagaatgaggcatctacctcctgggatgcattcagtgcttctagttatggccctaacatggttgtcatggtttccctttttcctttttgacactgactggatgggacgcgaagtttaccatggggatccaaatggagatttgagtgagaggaaagcttatgacaatggtgtccgagaaggtgcatttggtttgctattgaattcagttgtccttggcgttggttcattccttgttgatccactatgccggatgattggtgcaagattagtttgggccattagcaacttcacggtgtttatttgcatgatggctacaacgatattaagttggatctcttctgatctgtactcaagcaaacttcatcacatcatcggggcaaataaaacagtcaagatcacgggcatgggntggggtttctctctctcggattgccactctcccgtagtatgaaaaccagagtcagcacatggtctttatggcttaaattggaaagctgcttatgcttttgctgtcaagcattgcagatcacttacagcgttcccgtttctgtgactgctgagctgactgcccggtaacgat

SEQ ID NO: 74683 - DNA, 950 bp, Zea mays
  misc_feature: Ceres CLONE 1559119
  misc_feature: Encodes the peptide sequence at SEQ ID NO. 74684
  misc_feature (799)..(799): n is a, c, t, g, unknown, or other
  misc_feature (923)..(923): n is a, c, t, g, unknown, or other
ctggagctccccgcggtggcggccgctctagaactagtggatcccccgggctgcaggaattcgtctcacccctagaaaaagtcccgtctctgcgagcaagttctgtcttcgtccatccatccgtccccgtctcactgcctgtggcccgtgggtagcggttgtcgatcagcttacccacgccggcgtgttctccctgacatggtcggccggatggagcggcagaccgcgtcgtcgtcagcgtcatgctcccccgccgccgccgccaccacctcctcctcgtcctgcggcggcaagaagcggcctgatatcctcaacatgatccggaatgcatcctgtcttaattcgtcgtctgctgataccggcaagggaaggagtaaattgtcgaccaacaaagttacacatggattccacctggtggaaggcaagtccggccatgacatggaagactaccatgtggcagagtacaagtatgtgaagaatcatgagcttggtctctttgccatttttgatggccatttaggagataaggtgccaagttacttgaaagctaacctttttagcaacataatgaaagagcctctcttctggtctagccctcaagaagcaataaagaatgcatactgctctacaaacaagtatattctagaaaatacaaacaacttgggaccaggtggttcgacagcagttactgctattgtagttgatggtaaggacatgtggatagcaaatgtagcgactctagagctgttgtgtgtgaaagagctctgctaagcagctcactgtttgacatgagccccantgaaactatgaagacagaggattgaaaagcccggtgctttgtgacaaatttttctgggaatgtccctccggtgaatggtcaactcgctgtgcctaggcattttgtgaccaaagcctcaaggcancttgagcctgtgacccgaaattatcag

SEQ ID NO: 74684 - protein, 190 aa, Zea mays
  misc_feature: Ceres CLONE 1559119
  misc_feature: SWISSPROT Homolog: EC 3.1.3.16 Phosphoprotein phosphatase
MVGRMERQTASSSASCSPAAAATTSSSSCGGKKRPDILNMIRNASCLNSSSADTGKGRSKLSTNKVTHGFHLVEGKSGHDMEDYHVAEYKYVKNHELGLFAIFDGHLGDKVPSYLKANLFSNIMKEPLFWSSPQEAIKNAYCSTNKYILENTNNLGPGGSTAVTAIVVDGKDMWIANVATLELLCVKELC

SEQ ID NO: 74685 - DNA, 930 bp, Zea mays
  misc_feature: Ceres CLONE 1559120
  misc_feature: Encodes the peptide sequence at SEQ ID NO. 74686
  misc_feature (506)..(506): n is a, c, t, g, unknown, or other
atagctggagctccccgcggtggcggccgctctagaactagtggatcccccgggctgcaggaattcgtctcacccctagaaaaagtcctggtgtcctgcccacctctcctctgatcctctccgccatttctgtgcgcatctggagctgttgttctaaacccccaaaccctccgtcctaacctctgcgccaccggcgtcaccaccgccggagccgcagccatgaacgccttcaggttcctcggggacatgacccacctcttctcggtcctcgtcctcctcctcaagatctacgccaccaagtcctgctcaggggtgtcgaggaagacgcaggagctgtacatgttggtgttcgtggcgaggtacctggacctcttcacggattatgtctcgctctacaactcggtgatgaaggtggtgttcatcaccagctcggcggccatcgtgtggtgcatgcgccgccacccgcaggtacgaaggacgtacgacaaggagcatgacaccttccngcacacggtgctcgtcgccgccgcattcctgctcgcgctgatattcacgagcgggtcacctttcgcgagatatgctgggcattttcatctatttggaggcaggggctatctccaacattaggtgtgcttcagaaaaccaaaaaggggaaaacttaacgggacatatggtttcttcctgggggcccacgggcgttttaattcaaaaccggatttaccgtatttcccggagggcctcccacaaatgggcccctggcttgggggttggggaaaaaaccccggggcaaaatcccttcaatatttcccaatttggaaaaaaatggaaaacccgggtgcccgctaagaaaccctctttttcccaaaaagcggccccccccgcccccctttttaaaatatttttatatttgggcgggagaaacacctataa

SEQ ID NO: 74686 - protein, 135 aa, Zea mays
  misc_feature: Ceres CLONE 1559120
  misc_feature (1)..(131): Pfam Name: ER_lumen_recept Pfam Description: ER lumen protein retaining receptor
  misc_feature (96)..(96): Xaa is any aa, unknown, or other
MNAFRFLGDMTHLFSVLVLLLKIYATKSCSGVSRKTQELYMLVFVARYLDLFTDYVSLYNSVMKVVFITSSAAIVWCMRRHPQVRRTYDKEHDTFXHTVLVAAAFLLALIFTSGSPFARYAGHFHLFGGRGYLQH

SEQ ID NO: 74687 - DNA, 965 bp, Zea mays
  misc_feature: Ceres CLONE 1559121
  misc_feature: Encodes the peptide sequence at SEQ ID NO. 74688
  misc_feature (850)..(850): n is a, c, t, g, unknown, or other
ctggagctccccgcggtggcggccgctctagaatagtggatcccccgggctgcaggaattcgtctcacccctagaaaaaggcgccgtggtccccggggcggcgcccgtctccgtgcccagagtgcgaggcggcggcagcggccatgcgccagccggcgttccactggtgcgtgcacgacgcggtggtctccgctgtgttccgctcccacgtgggtcccatcgagcgccctccgaagaagaccccctctccgcctccgcttctgcctctgccgccgagccctggtcgcctcctcggcatgcccgtctacgagttcatcgaccagcacctgctcttccgtcgtcgtcgcctgccccactctagcagcaactgtacgtagacaaaaacaagcgggactgctggagtggatgggatggggatgaattgtagaatgggcacgcctggtgcacgtgttggttatttgttctgcatgcaaacaggaaggacaagattgcctgtacctatactatgccagcgaggtgcccattctcactcagaatgcttgccgtatttcgaagacactgagcctcctatattccacagacattcgacgattctgcattgtgaggaatctggcaacttaggccaagctataatctcaatgatacagccatccatggttttcccaacacatcatttcttttgaattcaatccatgtttatacttgtatcatgcgaccaaggcactgttaaaccactgtgcggctttctatactgatgtctcaggtatgaatgactccgtcaatgtcaagtcaactgcaggagagacatagtacatcccttgcacgatattgacgtaaaaagatgctgaanctgaaaatggcccgttctaggtggctcgccgccagatacatacttcacctgatacttatcctgcttgccgacgccattgttatttgaaggcgccgtacgtcctttccaagatgat

SEQ ID NO: 74688 - protein, 77 aa, Zea mays
  misc_feature: Ceres CLONE 1559121
MRQPAFHWCVHDAVVSAVFRSHVGPIERPPKKTPSPPPLLPLPPSPGRLLGMPVYEFIDQHLLFRRRRLPHSSSNCT

SEQ ID NO: 74689 - DNA, 975 bp, Zea mays
  misc_feature: Ceres CLONE 1559122
  misc_feature: Encodes the peptide sequence at SEQ ID NO. 74690
  misc_feature (315)..(315): n is a, c, t, g, unknown, or other
aaagctggagctccccgcggtggcggccgctctagaactagtggatcccccgggctgcaggaattcgtctcacccctagaaaaagcgtgaggggcacgtgaccgaccgcaagacaggttcgagtgctgacgttgccactgatatttttgaccgttcacggacggtagcgctagcgccaacctccggctccaatggcatccctccggctcgtggcaacgctagcgccctccggtcctccgccgccacctcgacgtaagcagcggagaccgtcctccgcagtccgtctgacaggtgggatgggcctggcggcagctngctgccgtggcggcggccgcggccgcctcaccaccggcgctcgccgcgctgtccgagccggcgaacgcgctctcgctgcccacctgggccgtccacgtctccagcgtcgccgagtgggtgacggcgatgtggctgggtttgggactaccgcgaagagacggggctcaaagggttggaaggcctctcctggggggatggttcccacttctaggtgggaacaaatgggtgcttgcacctgggcatttctttctaccaatccagagactccttggaagttcttggtagccccttcaaggtgctctggacaagggggttgggaaacttaaacaatgggggcataagcctgccatacccgcattatctcaaagccttcccccaggaagggccccaaaaacttcccaaggccggccaaaaattgaatctttaacacccggttttggcaagggaatcccccaacccccatttttaaaaaataacctttgctgaaagcccgtaaccattttttgggaaaaaaaaccctatgcccggcgcggtgggtttcacttgggaaaaaatttgattgtggggggggtttaaaaaaaacaaaagtgggggcccccccaaaacccccggaaaataaaaccgcgaaccggggaaaaaaaaaaaaaaaaaaaaaaaaat

SEQ ID NO: 74690 - protein, 52 aa, Zea mays
  misc_feature: Ceres CLONE 1559122
MWLGLGLPRRDGAQRVGRPLLGGWFPLLGGNKWVLAPGHFFLPIQRLLGSSW

SEQ ID NO: 74691 - DNA, 938 bp, Zea mays
  misc_feature: Ceres CLONE 1559123
  misc_feature: Translation starting site: 488
  misc_feature (456)..(456): n is a, c, t, g, unknown, or other
  misc_feature (791)..(791): n is a, c, t, g, unknown, or other
  misc_feature (811)..(811): n is a, c, t, g, unknown, or other
  misc_feature (933)..(933): n is a, c, t, g, unknown, or other
ctagctggagctccccgcggtggcggccgctctagaactagtggatcccccgggctgcaggaattcgtctcacccctagaaaaactgactgatctcgtgatctgcctctccagtgtgctctgtagcccgcgcagatcagtgatgccttcggcggcgatgacggtagcggcgggtctggcgaccgggccgggcagccgtgtgactcggttcgccaagtcgacggcggcgtcggtgacgcccgtgaggccgggcaagacgcacgcgctgtcgcccctggacaacgccatggagcggcacacggtgcacgtggtggtctacctccgcggcgcgccgggcctggacagggagcagctcaaggagtcgctctccgaggtgctgtcgctctacccggccatgaccggccggctcacgcgcggcgaaggcagcgcggacgccgagcctgcgcaccggggttgnggtcgtgaagtgcaacgacgccggcgtgcgcatggtggatgccagggcggccgtcacgctcgacgagtggctcgccacggcgaccggcgacgaggagatggacctcctctattacgagcccatggggcccgagccttacatctggtctccgttctacgtccagctgacagagttcaccgacaagtcgtacgcgctggggctgagctgcatccacatccacaacgaccccaccgctgccgctctcttcttccacgcctgggcagccgcccaccgccggaccaccagcacgtacccgcccttccttcaaccgccgggcgttggcggtctccccgaanctcgccgccccctgcaccgnctctgtctcgcgagtaaagcagcgccgcctccccaccagcaagatgcccgcgccgccatggtcttccggcacgttcacttcccggggctccgcggtgcgcccgctgctcctctccctggagncgggc

SEQ ID NO: 74692 - DNA, 1009 bp, Zea mays
  misc_feature: Ceres CLONE 1559125
  misc_feature: Encodes the peptide sequence at SEQ ID NO. 74693
  misc_feature (208)..(208): n is a, c, t, g, unknown, or other
  misc_feature (211)..(211): n is a, c, t, g, unknown, or other
  misc_feature (318)..(318): n is a, c, t, g, unknown, or other
  misc_feature (327)..(327): n is a, c, t, g, unknown, or other
  misc_feature (339)..(339): n is a, c, t, g, unknown, or other
  misc_feature (348)..(348): n is a, c, t, g, unknown, or other
  misc_feature (376)..(376): n is a, c, t, g, unknown, or other
  misc_feature (389)..(389): n is a, c, t, g, unknown, or other
  misc_feature (633)..(633): n is a, c, t, g, unknown, or other
  misc_feature (691)..(691): n is a, c, t, g, unknown, or other
  misc_feature (790)..(790): n is a, c, t, g, unknown, or other
  misc_feature (994)..(994): n is a, c, t, g, unknown, or other
caaagctggagctcaccgcggtggcggccgctctagaactagtggatcccccgggctgcaggaattcgtctcacccctagaaaaagaacctgaggtggagagatcgcacgcgccctctgccgcttgttcgttcctcgcgctcgccaccaggcaccaccacacacatcccaatctcgcgaggcaagcagaggggtctgcggcggcggcngcngccgcgcttccggctccccttcccattggcctccacgatggcgctccgcctcaacgacgtcgcgctctgcctctccccgccgctcggcggccgccgccgccgccgcngcggcggcngggtcgtccccntcgcctccntggcgccggccgtctccgccggggtcgngaataacaagccntttgctcctcctagggagggacaggtccagcctacacttcccggggccaccccacagaagggaaacgttcaagtcccttcccagattgagcgccaagataatatctttggcgcaaggcaagccagcctcagaaggggtggcagccaccagagggcgctcccacaaccccggatcgtaaaagaagttcaaggctagagctaaataaacctcaaaaaaccgcgccaaggggaaaccgccgcacggnaggctctacctggttcgggttggcagaaacgtcaaaccggggggaggccacgccggcngttattagacattagccttaagcgccgccagcgggggtccgaagaaggatagctctcccaaggccccaccggggagggcccgccccaaaccaaagaganaggtacggggtgaaggaaagagggcgcggggctccggtagccccagagtaaagggccgctactggggaaaagtgtttttggaaccggatacggcgaaacagggtgggtaagcaccgtaccgtcaagagggagtagggatggccccaaagaaaacctgtgtgattgtgtggggtgtagcacaccaccccgaagtggtagcggaantatacggccttgggt

SEQ ID NO: 74693 - protein, 111 aa, Zea mays
  misc_feature: Ceres CLONE 1559125
  misc_feature (24)..(24): Xaa is any aa, unknown, or other
  misc_feature (27)..(27): Xaa is any aa, unknown, or other
  misc_feature (31)..(31): Xaa is any aa, unknown, or other
  misc_feature (34)..(34): Xaa is any aa, unknown, or other
  misc_feature (43)..(43): Xaa is any aa, unknown, or other
MALRLNDVALCLSPPLGGRRRRRXGGXVVPXASXAPAVSAGVXNNKPFAPPREGQVQPTLPGATPQKGNVQVPSQIERQDNIFGARQASLRRGGSHQRALPQPRIVKEVQG

SEQ ID NO: 74694 - DNA, 934 bp, Zea mays
  misc_feature: Ceres CLONE 1559128
  misc_feature: Translation starting site: 200
  misc_feature: Pfam Name: Isochorismatase Pfam Description: Isochorismatase family
  misc_feature (709)..(709): n is a, c, t, g, unknown, or other
ctggagctccccgcggtggcggccgctctagaactagtggatcccccgggctgcaggaattcgtctcacccctagaaaaaagtgtgcacgcgtgaccgcgaaaagttgtttcgacctcctcggctgctgctttccgctgacctcgccgtgccattgagatgtcatagaacctgccgagccggtcgcaggcgcgaggagaatggggacggaggccgacgccgcagccgtggattcgcttcggtcgcagatcccgttccagaccgacggggagctcatcctcccgccgcgcgatgtggggctcgtcctcgtcgacctctgcaacggcttctgcaccgtcggcgccgggaacctcgctcctgttgcgccaaataagcagataagtaaaatgggtggaagaggccgctaggctctctaagctgttctgtgatagaaacctgccgatctttgcattcctggatacccattatccagataagccggagccaccgtatcctcctcactgtatcattgggtactgggggaggagaacttcgttccagaacctggagtgggttggaaaaggagccaaatgtgactataaagaggaaaagttgtattgacggttacatcagctgcatagaggaggacggggtctagtgtttttgtttgacggggtgggaaaatatcagatcaaaactgtcttggtactcgggatatgcacggacatctngtgttttggattttgcaagctcaactctggctgctcgaaatattgaccgagtgctccattacgagatgtcgtgattatttcggagggtgtgcacatatgacctttcggttggatcgcatgaattcaaagacctctgccctcctcagacctgatgctctatggacctaatgcccaagaagggtcaagttttttaaagggggttatgaactgataaaaactcccccc

SEQ ID NO: 74695 - DNA, 933 bp, Zea mays
  misc_feature: Ceres CLONE 1559129
  misc_feature: Encodes the peptide sequence at SEQ ID NO. 74696
  misc_feature (848)..(848): n is a, c, t, g, unknown, or other
ctggagctccccgcggtggcggccgctctagaactagtggatcccccgggctgcaggaattcgtctcacccctagaaaaaatcttgtcttgatcctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacacctcgcccctcgacgtcatcgccatcaacgacaccggcggtgtcaagcaggcgtcccacctgctcaagtacgactccacgctcggcatcttcgacgccgacgtctagcccgtcggcgacaacgccatctccgtcgacggcaaggtcatcaaggtcgtgtccgaccgcaaccccagcaacctgccgtgtggcgagctcagcatcgacctcgtcatcgagggcaccggcgtcttcgtcgaccgcgagggcgcggggaagcacatccaggcgggggccaagaaggtgctcatcacgggcgcccggcaagggcgacatccccacctacgtcgtcggcgttcaatgccgaccagtacaaccccgacaagcccatattcagaaacgcctcctgcaccacaactggcctcgcgcatttcgtcaaggggctcgaccaaaagttcggcatcatcaaaggcaccatgagacccancccactctttaaaccggggacaagagggttgggggacccgaaccacccgtgaacttgggccggacccgttccgaaccgtgttaaa

SEQ ID NO: 74696 - protein, 126 aa, Zea mays
  misc_feature: Ceres CLONE 1559129
  misc_feature (68)..(127): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MASSMLSATTVPLQQGGGLSEFSGLRSSASLPMRRNATSDDFMSAVSFRTHAVGTSGGSRRAPTEAKLKVAINGFGRIGRNFLRCWHGRGDTSPLDVIAINDTGGVKQASHLLKYDSTLGIFDADV

SEQ ID NO: 74697 - DNA, 964 bp, Zea mays
  misc_feature: Ceres CLONE 1559137
  misc_feature: Encodes the peptide sequence at SEQ ID NO. 74698
  misc_feature (742)..(742): n is a, c, t, g, unknown, or other
  misc_feature (752)..(752): n is a, c, t, g, unknown, or other
  misc_feature (899)..(899): n is a, c, t, g, unknown, or other
ctggagctccccgcggtggcggccgctctagaactagtggatcccccgggctgcaggaattcgtctcacccctagaaaaacctagaaaaaaacactgaatccaaacgaagtagttgcaattgttggtcttagtggaagtggcaagagcactataatcaatttactacttagattatacgaacctacaaatgggcaaatactaattgatggtgtcccgctcactgagcttgatatcagatggttcagggaaagaattggtttcgtcggacaggaaccacgcttattccgaatggatatcagctctaatattaaatatggttgcccaagagaagtcagtcatgaagaagtgatatgggctgcgaagcaggcctatgctcatgacttcataatggctttgcctgatggttataacaccatcattgatgatgctcttctcagtggaggtcagaaacaacgtgttgctattgccagggcccttctgagggacccatctatcttactgcttgatgaagccactagtgcgcttgatgctgagagtgaacattatgtcaagagcgtcatcacaaaagttagtcgagattcaaaggctaaaagaactgtggtaatcatagcacacaggctatctacaattcaaacagctgatagaattattgtgatggaaaatgtatatttgggggaaggatggtaaacacattgatcttattggagagggtggtctatattcaagattagccaggcgacnatatgacgantctcagtagccctggatcacagaatgtggtttagtgcacgccttctttttaatgggatggcagaagtgagagcggtctgtcattagtgattctttgcagaactgacctggacccagactcgattaactggcatggtttcccatgaanccagaacgggttgtgatgatcaaataaaccaaacggttccccacgagacgaccatttagctccaa

SEQ ID NO: 74698 - protein, 132 aa, Zea mays
  misc_feature: Ceres CLONE 1559137
  misc_feature (2)..(126): Pfam Name: ABC_tran Pfam Description: ABC transporter
  misc_feature: SWISSPROT Homolog: EC 3.6.3.44 Xenobiotic-transporting ATPase
MDISSNIKYGCPREVSHEEVIWAAKQAYAHDFIMALPDGYNTIIDDALLSGGQKQRVAIARALLRDPSILLLDEATSALDAESEHYVKSVITKVSRDSKAKRTVVIIAHRLSTIQTADRIIVMENVYLGEGW

SEQ ID NO: 74699 - DNA, 903 bp, Zea mays
  misc_feature: Ceres CLONE 1559138
  misc_feature (604)..(604): n is a, c, t, g, unknown, or other
ggagctccccgcggtggcggccgctctagaactagtggatcccccgggctgcaggaattcgtctcacccctagaaaaaacaccaacctcagcacaccaaggagagtacgtggaggagcagccatggcttcgtacggtggccgccgcggcgagcacattcctgggcacccgcctggcggtacccggtcgcctacagatcgggctcgtcatggcccggttcgggttctggttgggcggctaggcgaagcctgctccgaagaaggtggcgaacacatcgacctcctctgaccggccgctgtggtgtccccggcgccatggcgcccgactacctggacggctcgctggtcggcgactacaggttcgacccggtgggtctcgggtagcccgtggagtacctgcagtccgagttcgactctctggaccggaacctggccaagactgaggccggcggcatcatctgcacccggttcaactcctccgaagtcaagtggaccccgttgcagccctacagagaggtgttcggcctccagcggttccgccagtgcgagctcatcgacggccgctggggcatgctcgccccctcggcgcacctctcgtcgagtggntgaccggtgtcacctgacatgacgcccgcaaggaggaactggtggactggtcctcctacctgggcaaccgctgcagtgcgcatagcgaccatcactggatcgagatgctcgtgatcagatactccagttcccgcgggagcgctactctacccggagagaagctgtccgcggcggctcctacttcgaccgctcagtctggaggcgacttattagaggactgctgcagctcgctaaatccacagcccgctcggctgttcgctttgtcggtttgccggaagaccccaccccggcagggccct

SEQ ID NO: 74700 - DNA, 978 bp, Zea mays
  misc_feature: Ceres CLONE 1559139
  misc_feature: Encodes the peptide sequence at SEQ ID NO. 74701
  misc_feature (818)..(818): n is a, c, t, g, unknown, or other
  misc_feature (822)..(822): n is a, c, t, g, unknown, or other
  misc_feature (835)..(835): n is a, c, t, g, unknown, or other
  misc_feature (894)..(894): n is a, c, t, g, unknown, or other
ctggagctccccgcggtggcggccgctctagaactagtggatcccccgggctgcaggaattcgtctcacccctagaaaaatagcttcattctcactccagtctccaggctccaccacgcacagacaacgagctctgcccccacaggccagcaggcagatagatcctcaccattttctctttcactcgcatcggatctctcccataatacactctcggggtctcggttgccaggaatcactggagccgagcgagcgtgtataaaagggcttggtccttggtcctccgaagcctgaaccttgaagcgccccgtagtgcagtgcagcagtgtgctacctcctcagtcctctcactccatcgcaaacgctagtcttcctctaaagctcggagcgagtctcagaagcgatggcggcgtccaagaggctgctgctggcggcgctgtgcgtggtggcggcggcgctgctcgccgtgcggtcggagtcccacggcctggaggacttcgcaagcagcgacgcgacgccggagatgcagaccttcttcaagcccgaggccgcggcgctcccggaggccctggacgcgtcctccatgcccgccgccaccatggccgcgaagccggaagccacgtcgatcccgaccaccaccggcaccacgaccggctgctggcggcggcgggcacctccgccgcggcagggcactactactgcgtcgtcgccgccgcgccaggtccgtgtccgtggccgccggcgtggcctgcggcgtgcttgcccgggacgatgtcggcatcgcggcccccgtgggcgtacttggtgcgcggcagggnccancaggatagtgcanctccggcggctcctccccctgagaacgaccccacgcccgggccccttggaaaggcgctntccccattaagatttgggttagcccggccccaaccccgccatttgtgggcgtttggggggaaggggtgaatcctttttccgcgg

SEQ ID NO: 74701 - protein, 166 aa, Zea mays
  misc_feature: Ceres CLONE 1559139
  misc_feature (139)..(139): Xaa is any aa, unknown, or other
  misc_feature (140)..(140): Xaa is any aa, unknown, or other
  misc_feature (144)..(144): Xaa is any aa, unknown, or other
  misc_feature (164)..(164): Xaa is any aa, unknown, or other
MAASKRLLLAALCVVAAALLAVRSESHGLEDFASSDATPEMQTFFKPEAAALPEALDASSMPAATMAAKPEATSIPTTTGTTTGCWRRRAPPPRQGTTTASSPPRQVRVRGRRRGLRRACPGRCRHRGPRGRTWCAAGXXRIVXLRRLLPLRTTPRPGPLERRXPH

SEQ ID NO: 74702 - DNA, 907 bp, Zea mays
  misc_feature: Ceres CLONE 1559144
  misc_feature: Encodes the peptide sequence at SEQ ID NO. 74703
  misc_feature (602)..(602): n is a, c, t, g, unknown, or other
  misc_feature (661)..(661): n is a, c, t, g, unknown, or other
  misc_feature (664)..(664): n is a, c, t, g, unknown, or other
ctccccgcggtggcggccgctctagaactagtggatcccccgggctgcaggaattcgtctcacccctagaaaaacaagctctcctcccctcttcctaccattagcagtagctacagccagaacaccagcagacagcagcatcagcagggaggaacacgatgagcggcgccggtccggatctgcagctgccaccggggttccggttccacccgacggacgaggagctggtgatgcactacctctgccgccgctgcgccggcctgcccatcgccgtccccatcatcgccgagatcgacctctacaagttcgacccatggcagctcccaaggatggcgctgtacggcgagaaggagtggtacttcttctccccgcgggaccgcaagtacccgaacgggtccaggcccaaccgcgccgccggggctgggtactggaaggccaccggcgctgacaagcccgtgggcacgcccaagccgctggccatcaagaaggcgctcgtcttctacgccggcaaggcgcccaagggcgagaagaccaactggatcatgcacgagtaccgcctcgccgacgtcgaccgctcggcgcgcaagaagacagcctcaggntggatgactgggtcctgtgccgcatctactacaagaaggggcggcgggctggatatgcngcngcgccggctgccggcgcgaacaacagcctgtgtcgccaacggcggcggtgactccccgcggaacaaaaaccgttcgtggcgccggcggcggcctgcccccggcgttcccggaacttgcgcgtactaagaccggcgtcgagattcatgcccggctgcccgcggaatactcaagtggccggaacaagggctgtccccgaacaactgggttggcaccggaagggcaaaacatccccaaaatcggag

SEQ ID NO: 74703 - protein, 210 aa, Zea mays
  misc_feature: Ceres CLONE 1559144
  misc_feature (10)..(135): Pfam Name: NAM Pfam Description: No apical meristem (NAM) protein
  misc_feature (168)..(168): Xaa is any aa, unknown, or other
  misc_feature (169)..(169): Xaa is any aa, unknown, or other
MSGAGPDLQLPPGFRFHPTDEELVMHYLCRRCAGLPIAVPIIAEIDLYKFDPWQLPRMALYGEKEWYFFSPRDRKYPNGSRPNRAAGAGYWKATGADKPVGTPKPLAIKKALVFYAGKAPKGEKTNWIMHEYRLADVDRSARKKTASGWMTGSCAASTTRRGGGLDMXXRRLPARTTACVANGGGDSPRNKNRSWRRRRPAPGVPGTCAY

SEQ ID NO: 74704 - DNA, 1013 bp, Zea mays
  misc_feature: Ceres CLONE 1559146
  misc_feature: Encodes the peptide sequence at SEQ ID NO. 74705
  misc_feature (445)..(445): n is a, c, t, g, unknown, or other
  misc_feature (828)..(828): n is a, c, t, g, unknown, or other
ggagctccccgcggtggcggccgctctagaactagtggatcccccgggctgcaggaattcgtctcacccctagaaaaaatccctgatccctccaactcccaccccaatacatcctgccgacgccatcagccggcgggacgcacactcgaggtcgaccttcgaaccctagtccttggccgagccgccttgcgggatcgtccccgccgcgcggcagctctgcctcgacccttttagtctccgtccgacaccgcttggatcagagatggaatcaccacccctcacagctgaagcaattgcttttaccgagaaaaagatggacatgactttggaggatataatcaagatgtcaaagaaaaagaatcctggaggcaagaacccccctatgcagccgatcagaaagcgtgcattccagaatgcctacactgataacgggaatggcaaggcntcacggtttttggaatctagatcaaccatgagaccaggtgttcctgcccagagaaagtcaaatcctggtgggaagtcagtttgctgcctaaaaaccagcttgaaaaaaagggctgctgctatgccaatgccccaggggggctggccttttggaaaaaacgccaagggcaagtgccttttttggcaaaaggaggcccataagggaatccttttccaaaatccaaggggcaggggtttcccaaaaaaccttccccccccagggggaatggtttccccccttttcccgagataaaggcccaccgctaaggaaccccccccacgggcggggggttccccggccccggggggtggtttttcccccaaggcccccctttttttttaaancctgaaaggcggggggatataattggggggcgggctgtttcccccaccctttgagatttttgtggggggcccccccccccttctctctctgggattaaaaaaaggagggggagggtgggaaaacaattttttgtttttttccgcgagggaagaaaaaaattttcttttggaagaaaaagaatcta

SEQ ID NO: 74705 - protein, 157 aa, Zea mays
  misc_feature: Ceres CLONE 1559146
MESPPLTAEAIAFTEKKMDMTLEDIIKMSKKKNPGGKNPPMQPIRKRAFQNAYTDNGNGKASRFLESRSTMRPGVPAQRKSNPGGKSVCCLKTSLKKRAAAMPMPQGGWPFGKNAKGKCLFWQKEAHKGILFQNPRGRGFPKNLPPPGGMVSPLFPR

SEQ ID NO: 74706 - DNA, 962 bp, Zea mays
  misc_feature: Ceres CLONE 1559149
  misc_feature: Translation starting site: 155
  misc_feature (770)..(770): n is a, c, t, g, unknown, or other
  misc_feature (781)..(781): n is a, c, t, g, unknown, or other
  misc_feature (782)..(782): n is a, c, t, g, unknown, or other
  misc_feature (834)..(834): n is a, c, t, g, unknown, or other
  misc_feature (861)..(861): n is a, c, t, g, unknown, or other
  misc_feature (896)..(896): n is a, c, t, g, unknown, or other
ggagctccccgcggtggcggccgctctagaactagtggatcccccgggctgcaggaattcgtctcacccctagaaaaattgcgccgccgctggcccagcgcggccgccgtgctccttctccactcgtgcttcccaagctgcttcgccggaagcaatgcgagggccctgccccggtggaggcgtctcggcgtcttttgccccgagcttcaacggctcccgcgccatgatctggccggcaacagtaaattgcacgagacggatccgcatttcattcatccaaacagccaaaacggggccgttccgcgcaggcgacagggctacgggaggaatttgctatgctagccaggcggttgaattgctgcccactttgtaccctgaaatcgtggtccgagacgcacggctcgaggactgctgggaagtggctgacactcactgcagctcgttctttcctggttacaagttcccgttggaccttgttctccggattgatcgttacattgctctcctctctggattttcagttccacccggctgcatgaggacttgccttgtggccgtcaattctaattctgtaaatagtagtttcaacatcgagtgtggagatgctacagatgccaactttgagaaaacaatctcagtagaggctccgtagctggcattcttacacttgatacagtggcagactatcttccgagaaggggaccccctgaacagaggtagacaggtattgcgtatatagcatacgtcgcgttgcggaagggagagcgacngtaatgtatcnncgaagatgttggtcctaagagcagaagctccggcaaagagctggggatgccngtcgattgcactgactgcgacgtaacnacgttggcgcgctaccctgttcagaacccaagctncaagtgcatacgaggccggaaagagcttaatgcccgaacccagatagctaaaggagcggattcacc

SEQ ID NO: 74707 - DNA, 910 bp, Zea mays
  misc_feature: Ceres CLONE 1559150
  misc_feature: Encodes the peptide sequence at SEQ ID NO. 74708
tggagctccccgcggtggcggccgctctagaactagtggatcccccgggctgcaggaattcgtctcacccctagaaaaagctctgctaagtgccaagtgccaacgccctctctcgcaccgttccacggaacggaatcatccaccaccgggcaccggcagtcacagcgcacctcactgaaattggaacagagaacatggcggccgccgcgcccgcgtgccacgtccatatcgaggccctgcagacggcgctgccaacgcgcgcggtgagccccgggggcgggcgcgccccgtggccgtggccgcgcccgcgctcgtcgctggcgccgcgctgcagcgccgagcccgcgttgtgctctactaccgcgcagccgccgacgcgtcggcgccgtggagcccggaggaggctctcctggcgaaggagtcgctgagcgaggccgtggccgaccacccggagatggcaggccgcctccggcgccgcgcggacgggctgtgggaggtgaagctcaacgacacgggcgtcaggctcgtgctggccaccgtggaggccgcggtcgacgacttcgtcggcgccggcgtcagcgagcaggaccgcaagcgcatgtaagccgctctcgcgccgtggaccgacgtggacgccgacggtcccgatatgtgcgccctctgcttcgttcagctgacacggttcagggcgacaggggatacgccgtcggcgtgagctgcagcctgatgctgtgcgacccgctgtcgctggcgcggttcctgctgtcgggggcccgcacccacgcggccatcaagccccgaacaggcccgcacccatcccaagatgcggtaagcaggctacttccggcgcccatcacctggcccgccgcattagtccgtcccgctcgagcccttcccagccaacgggtgt

SEQ ID NO: 74708 - protein, 49 aa, Zea mays
  misc_feature: Ceres CLONE 1559150
MAGRLRRRADGLWEVKLNDTGVRLVLATVEAAVDDFVGAGVSEQDRKRM

SEQ ID NO: 74709 - DNA, 987 bp, Zea mays
  misc_feature: Ceres CLONE 1559152
  misc_feature: Encodes the peptide sequence at SEQ ID NO. 74710
  misc_feature (400)..(400): n is a, c, t, g, unknown, or other
  misc_feature (465)..(465): n is a, c, t, g, unknown, or other
  misc_feature (524)..(524): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (939)..(939): n is a, c, t, g, unknown, or other
  misc_feature (940)..(940): n is a, c, t, g, unknown, or other
  misc_feature (947)..(947): n is a, c, t, g, unknown, or other
  misc_feature (948)..(948): n is a, c, t, g, unknown, or other
  misc_feature (950)..(950): n is a, c, t, g, unknown, or other
  misc_feature (967)..(967): n is a, c, t, g, unknown, or other
tggagctccccgcggtggcggccgctctagaactagtggatcccccgggctgcaggaattcgtctcacccctagaaaaagtctcccacaacacgctccactaaccctagcgacagcctcgggtcgtcgtttgatccccgcggggagctctagttccgccaagcgtgcgtaccggcgtccggatccgggaccgaagatgacggagtccctggtgcggaacaagccggggatggccagcatcaaggagatgccggtggtgcaggacgggccgccgccgggcggtttcgcgcccgtgcgcttcgcccgccggatccccacctcggggcccagcgccaccgccatcttcctcaccaccttcggtgctttcgcatatggcatgtaccaggtcgggcaggggaacnagggtccgccgggcgctcaaaagaagagaaattgctgctcgcagtgctatactgccgatgctccnagcagaagaggatgaaagatttgtcaaagagtggaagaaattggcttgaggaagaagcnaggatcctggaagaccttccaagggtggtaggtccggcaaaaccttgtccaacccgtgggaaaggatgcccccgggttaccggtgaactcccccccttaggtttggtaaagggccctgtttccaggccttaaatgccttcttggcccgggggcccgggaaaaaacctccttttttctttaaggagacccgtggtttaaaaccccggtttttgtgtgtccctgaaaaacggggggggttaaattttgggactttaaacaccccctttttcttttgttttaaaaggggttttttcggcaattttgccccccccccccgggggggttccccccgggagaaacctcccaaaaaaaaaccccttttttttttgaaaaaatgttatttttttttnnnaaaaaaaaataaaatatattagtnntttttgnngnaggggaattttagttancaagaaaagagcagccccca

SEQ ID NO: 74710 - protein, 94 aa, Zea mays
  misc_feature: Ceres CLONE 1559152
  misc_feature (69)..(69): Xaa is any aa, unknown, or other
MTESLVRNKPGMASIKEMPVVQDGPPPGGFAPVRFARRIPTSGPSATAIFLTTFGAFAYGMYQVGQGNXGPPGAQKKRNCCSQCYTADAPSRRG

SEQ ID NO: 74711 - DNA, 958 bp, Zea mays
  misc_feature: Ceres CLONE 1559155
  misc_feature: Encodes the peptide sequence at SEQ ID NO. 74712
ctggagctccccgcggtggcggccgctctagaactagtggatcccccgggctgcaggaattcgtctcacccctagaaaaagctagcgcgagtggtggcacccacgcatactcttctcccccccagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggaagccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaagcccaaggcgagcacggagtacatcgcgtacagcggcgacggcttcaagctgctgatcccgtccaagtggaaccccagcaaggagcgggagttccccgggcaggtgctccgctacgaggacaacttcgacgccaacagcaacgtgtccgtcatcatccagcccacgtccaagaagaccatcgccgactacggctctcccgaggagttcctctcccaggtcgactacctgctcggcaggcaggcctacggcggcaagaccgactccgatgtcggggtcgagtacggcgccgtggccaccgcaacgtcctggagagctccaaccccgtgatcgacggcagcagtactacgccgtgtccgtgctcacaagacggcgaacgcgacgagtgcggtatgcacagctcatcggggccacgtctccgacggaagctctaatctgcaagcgaagcccgggacaagaggtgttcaaggcgccagaagggatcaaaaaagccccctctcctcagcgtgaaagatgatgaatttattcctccaagggagggatgcccccctccttaa

SEQ ID NO: 74712 - protein, 193 aa, Zea mays
  misc_feature: Ceres CLONE 1559155
  misc_feature (57)..(190): Pfam Name: PsbP Pfam Description: PsbP
MASTSCCLLHQSTARLGASPRLAAAPPRSAQLLVCKARKQEAAADQSDVSRRAALALLAGVTAAAGAKVGPAAAAYGEAANVFGKPKASTEYIAYSGDGFKLLIPSKWNPSKEREFPGQVLRYEDNFDANSNVSVIIQPTSKKTIADYGSPEEFLSQVDYLLGRQAYGGKTDSDVGVEYGAVATATSWRAPTP

SEQ ID NO: 74713 - DNA, 967 bp, Zea mays
  misc_feature: Ceres CLONE 1559157
  misc_feature: Encodes the peptide sequence at SEQ ID NO. 74714
  misc_feature (816)..(816): n is a, c, t, g, unknown, or other
aaaagctggagctccccgcggtggcggccgctctagaactagtggatcccccgggctgcaggaattcgtctcacccctagaaaaaatcccatctctcactcgctagcactagcatagtcgtctctttcttttctgcttccagacattgtccacacgagctagtgcactggtgtcgctcgcaaccaaattaaggacgtactgagccatggcatccaagggcgtcctcttcttggctctcaacctcctgttcttcacagtggccaacgcctgcggcagctgcccgaccccaacgccgccggtcgtgccaccgccgccgcctccttctgctaccccacccccttcatcctccagtgggaagtgcccgctgaacgcgctcaagttcggcgtgtgcgtcaatgtgctcggcctcgtcaaaggcgaggctggcaaggtacctgccgagccatgctgcaacctcatcaaaggccttgcagacttcgaggccgccgtctgcctctgcacggccatcaagggcaacgtcctcggcgtcgtcttcgatgtccctatcaagttcaatgccctcgtcaactactgtggcaagtgcgtgcccaagggctacatgtgtgcgtaagctccgcgcggttacactctcgtagccgttcgcgtgcgtaattaagcatgcacctgcatggcacacatgtattgtgcgcctgctgatctctcctgtctcatttgtgcaccttaggttctacagtccctagaacatatttccagcaaattcttgtcagttcacatgtattgtcccttggtggaatttctattttttggttttatttnggaattgaacatttgttaatagagttggccatctcctctccaaaaaaagaggagtgcggcttctagtttttatatcacaaggcaggcatgtatctgttaaaggcattggtttgtgtattcaacaagccctgaattgaattaatctttttcc

SEQ ID NO: 74714 - protein, 134 aa, Zea mays
  misc_feature: Ceres CLONE 1559157
  misc_feature (52)..(133): Pfam Name: Tryp_alpha_amyl Pfam Description: Protease inhibitor/seed storage/LTP family
MASKGVLFLALNLLFFTVANACGSCPTPTPPVVPPPPPPSATPPPSSSSGKCPLNALKFGVCVNVLGLVKGEAGKVPAEPCCNLIKGLADFEAAVCLCTAIKGNVLGVVFDVPIKFNALVNYCGKCVPKGYMCA

SEQ ID NO: 74715 - DNA, 900 bp, Zea mays
  misc_feature: Ceres CLONE 1559159
  misc_feature: Translation starting site: 186
caaagctggagctccccgcggtggcggccgctctagaactagtggatcccccgggctgcaggaattcgtctcacccctagaaaaagcgccgccacttccctcccgacccactcgcccaaaaccgtagcgccctcgcctgctcgccgccgccgtcgttgcgagctccccatcttcctccgttaaccatggcgacccagatcagcaagaagaagaagttcgtcagcgacggcgtgttctacgccgagctcaatgagatgctgacgcgggagctcgcggaggacggctactccggcgtggaggtgcgtgtcacaccgatgcgcacggagatcatcatccgcgcaacgcgcacgcagaacgtgctcggcgagaagggccgcaggatcagggagctcacgtctgtggtccagaagaggttcaacttccccgagaacggcgtcgagctctacgccgagaaggtcgtcaaccgcggcctctgcgccatcgcgcaagctgagtccctccgctacaagctcctcggaggccttgccgtccggagggcctgctatggtggtcttcgcttgttatggagagtggtgccaagggttgtgaggtcattgtgagtggaaagctcagggctcaaagaagccagtccatgaagttcaaggatggctacatgatctcatctgggcagccacggaatgagtccatcgactcagctgggagaaccgtcctcctcaaaacggttggtctggggatcaaagggaaaatcatgcttgactgggacccaaaggggaaggtgggcccaatcaccccttttcccggaccgggggacatccattaccccaaaaggaggaggaacaagttgccccccccgtcttggggagggtgaggcctaaaggccccaaacggctcttgaaaagg

SEQ ID NO: 74716 - DNA, 920 bp, Zea mays
  misc_feature: Ceres CLONE 1559160
  misc_feature: Encodes the peptide sequence at SEQ ID NO. 74717
  misc_feature (647)..(647): n is a, c, t, g, unknown, or other
  misc_feature (664)..(664): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (801)..(801): n is a, c, t, g, unknown, or other
atagctggagctccccgcggtggcggccgctctagaactagtggatcccccgggctgcaggaattcgtctcacccctagaaaaaatcaatcaaatactcagacaaccatggggcaccagcaggcgcagcacggcaaggacgacaccgaggagctgcttgcagcccaccggcagctgtggtgccatgccctgggctacgtcaagtccatggcgctcaagtgcgccctggacctgcgcatccccgacaccatcgaccgctgcggcgggagcgccaccctgggcgagctgctcgccgccagcgagatcccggcgtccaaccacgactacctccggcgggtcatgcgcacgctgacagccatgcgcatcttcgcggccagccacgaccccgccaaggccgacgacgcggccgccatctcctaccagctgaccccggcgtcccggctgctcgtcagcagcagcagcagcgtcgacgacgccgccggcgcctcgaaggagaacactactaccccgagcatcctccccaacatcgcccacctggtccgccccaacaccatctccctgctgttcagcatgggcgagtggatgaaggacgagagcgcggcgtccgtgtcgctgtacgagacggtgcaccggcaggggatgtgggcngtgcgtggaggacgacncggccaacagggccagcttctacgagagcatggacgccgacacccggctcgtgatgcatgccgtggtccgccggtgcccgcacgtgttcgacggcgtcagtcccgttcgnnnannnntggggggggggggccggggnaacggccgccgccgccgttgttcgccgcctttccgccacattcataggtggcacgttcatggtaccttccccacgtcggtcgccctagtctcccgcccgggcaccggccggcctggtct

SEQ ID NO: 74717 - protein, 246 aa, Zea mays
  misc_feature: Ceres CLONE 1559160
  misc_feature (34)..(82): Pfam Name: Dimerisation Pfam Description: Dimerisation domain
  misc_feature: SWISSPROT Homolog: EC 2.1.1.146 (Iso)eugenol O-methyltransferase
  misc_feature (186)..(186): Xaa is any aa, unknown, or other
  misc_feature (223)..(223): Xaa is any aa, unknown, or other
  misc_feature (224)..(224): Xaa is any aa, unknown, or other
  misc_feature (225)..(225): Xaa is any aa, unknown, or other
  misc_feature (232)..(232): Xaa is any aa, unknown, or other
MGHQQAQHGKDDTEELLAAHRQLWCHALGYVKSMALKCALDLRIPDTIDRCGGSATLGELLAASEIPASNHDYLRRVMRTLTAMRIFAASHDPAKADDAAAISYQLTPASRLLVSSSSSVDDAAGASKENTTTPSILPNIAHLVRPNTISLLFSMGEWMKDESAASVSLYETVHRQGMWAVRGGRXGQQGQLLREHGRRHPARDACRGPPVPARVRRRQSRSXXXGGGGPGXRPPPPLFAAFPPHS

SEQ ID NO: 74718 - DNA, 948 bp, Zea mays
  misc_feature: Ceres CLONE 1559161
  misc_feature: Encodes the peptide sequence at SEQ ID NO. 74719
  misc_feature (765)..(765): n is a, c, t, g, unknown, or other
  misc_feature (863)..(863): n is a, c, t, g, unknown, or other
ctggagctccccgcggtggcggccgctctagaactagtggatcccccgggctgcaggaattcgtctcacccctagaaaaaatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcttcatcgtgggcgccggctccgcggggctgtcctgcgcgtacgagctctccaaggaccccgccgtgagcatcgccatcgtggagcagtcggtgtcgcccggctgcggcgcgtggctgggcgggcagctgttctcggccatgatggtgcgcaagccggcgcacctgttcctggacgagctgggcgtggcgtacgacgaggccgatgactacgtggtcatcaagcacgacgcgctcttcacgtccacggtcatgagcctgctcctggcgcgccccaacgtctagctgttcaacgccgtgggcgtggaggactcatcgtcaggggaaggcgcgtctgntggtttcttcaccactggggcgctcgtgtccatgaccaagacacgcagtcctgcatggaccccaactctgggaggccaggtcgtggtcagctcctgcnggcaagacggccccttcggcccaccgggtcagaagcccaggaactcgcatgacacccccttgcggggattaagcccccgactaac

SEQ ID NO: 74719 - protein, 185 aa, Zea mays
  misc_feature: Ceres CLONE 1559161
  misc_feature (64)..(185): Pfam Name: Thi4 Pfam Description: Thi4 family
MATAAASSLLKSSFAGSRLPAATRTTPASLVVATGPRGAGAGPICASMSMSSSNPPYDLTSFRFSPIKESIVSREMTRRYMTDMITYADTDVFIVGAGSAGLSCAYELSKDPAVSIAIVEQSVSPGCGAWLGGQLFSAMMVRKPAHLFLDELGVAYDEADDYVVIKHDALFTSTVMSLLLARPNV

SEQ ID NO: 74720 - DNA, 964 bp, Zea mays
  misc_feature: Ceres CLONE 1559162
  misc_feature: Encodes the peptide sequence at SEQ ID NO. 74721
  misc_feature (888)..(888): n is a, c, t, g, unknown, or other
  misc_feature (922)..(922): n is a, c, t, g, unknown, or other
  misc_feature (923)..(923): n is a, c, t, g, unknown, or other
ggagctccccgcggtggcggccgctctagactagtggatcccccgggctgcaggaattcgtctcacccctagaaaaactcacaacctacgacgagcggctaccttaattagctaagctagaattcttgggggccgcacgcggcagcgtctagctcggaggcggcggccatggcgaagccgcaggaggtgcgcagcgtcgactccttctcgcagctgccgttcatccggccggccccgcccccggctccggcgcagccgagggacgccaccatccggctcttcggctgcgacttctccaacgacgaccagcagcagcggcaggccaagcagcagcagcagcaccgccagcaggacgccgccgcggccgccgactcccccgacgccgccaacggcagctcgatcacgtccgagagcaacaacggagccaacaagagcggcgccggcgccggcgccgacaggaagttcgagtgccactactgctgccgcaacttcccgacgtcgcaggcgctgggcgggcaccagaacgcgcacaagcgcgagcggcagcacgccaagcgggcccacctccaggcctccctcgccatgcaccgctacgtgcccggccacatgtacggcctcttcaactaccaccagcagcagcaccacctctgcggctgcggcggcggccgcttcgactaccccgcgccgctgcagttgccgcccccgccgcggcgcgctacccgatgtggacgagcgccggccccgcggggccctacggcggaggcccaggctccatgtcgcagccatcaaacgtagcccggtgcgccgggggctctgggaggttgcgccccccgctgcgacgaccaccacactaccggcatggtagaatttcggcgtgcccggcgcccngcacgcgctgctggtgggacggcggctgtcctgnncccttggccggctggccccgagcggcggctgcatgaacaac

SEQ ID NO: 74721 - protein, 208 aa, Zea mays
  misc_feature: Ceres CLONE 1559162
MAKPQEVRSVDSFSQLPFIRPAPPPAPAQPRDATIRLFGCDFSNDDQQQRQAKQQQQHRQQDAAAAADSPDAANGSSITSESNNGANKSGAGAGADRKFECHYCCRNFPTSQALGGHQNAHKRERQHAKRAHLQASLAMHRYVPGHMYGLFNYHQQQHHLCGCGGGRFDYPAPLQLPPPPRRATRCGRAPAPRGPTAEAQAPCRSHQT

SEQ ID NO: 74722 - DNA, 919 bp, Zea mays
  misc_feature: Ceres CLONE 1559163
  misc_feature: Encodes the peptide sequence at SEQ ID NO. 74723
  misc_feature (777)..(777): n is a, c, t, g, unknown, or other
ctccccgcggtggcggccgctctagaatagtggatcccccgggctgcaggaattcgtctcacccctagaaaaaactgctcctctctttcgacaagttcctcttccactacctgaagcgccgctggttctccggcggcagcggcgccaccgtcccaaggccccccgccaaatcgaggcggaacatggcggccgccaagtggagcgagacggccatgctcgttatcgacatgcagaaggacttcgtggacccggcgatgcgcagcccgatgctggtggccggtggcgaggccgtcgtccctgccgttgccggggccgtcgccgtcgcaagggagcgcggcattttcgtcgtctgggttgtcagagagcatgacccttctggaagagatgttgaacttttccgtaggcaccattattctgggggaaagggtccaacagtgaaaggtctgaaaggagcggagctggctgatgggcttgttatcaaagaaggggagtacaagttggtgaagactagatttagtgctttcttcgcaacacatcttgattctgtcctgaaaactgcaggaataaagaacttggttattgttggagttcagacaccaaattgcattcggcagactgtgttcgatgctatagcactggactatgagaaaagtacggttctaattgatgcaacagctgctgcaagacaagaatccatttgtcaatatcagggatatgaagaacatcggagtggacacgccaaccctggaaaaatggcgccgcctaggttactctgtnctctggcagcccagcaaacggaaatgacctgttgtataaatgcatgcagcacctcctgcatctacttcttgccttctaactgcgtctgactgcccgtacgttgttgtatgttatacccgtgccgtagacattgcaaaggggg

SEQ ID NO: 74723 - protein, 227 aa, Zea mays
  misc_feature: Ceres CLONE 1559163
  misc_feature (7)..(194): Pfam Name: Isochorismatase Pfam Description: Isochorismatase family
  misc_feature: SWISSPROT Homolog: EC 3.5.1.59 N-carbamoylsarcosine amidase
  misc_feature (199)..(199): Xaa is any aa, unknown, or other
MAAAKWSETAMLVIDMQKDFVDPAMRSPMLVAGGEAVVPAVAGAVAVARERGIFVVWVVREHDPSGRDVELFRRHHYSGGKGPTVKGLKGAELADGLVIKEGEYKLVKTRFSAFFATHLDSVLKTAGIKNLVIVGVQTPNCIRQTVFDAIALDYEKSTVLIDATAAARQESICQYQGYEEHRSGHANPGKMAPPRLLCXLAAQQTEMTCCINACSTSCIYFLPSNCV

SEQ ID NO: 74724 - DNA, 973 bp, Zea mays
  misc_feature: Ceres CLONE 1559165
  misc_feature: Encodes the peptide sequence at SEQ ID NO. 74725
  misc_feature (666)..(666): n is a, c, t, g, unknown, or other
  misc_feature (669)..(669): n is a, c, t, g, unknown, or other
gctggagctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccacctagagatggatccgcaccaagagcaccaagggtgggtgggttgttggcggcngcngcagcagctttgtcgattcagggaacaaggtatacgtgggggacctttgcatggggcgttgacaactcgactctggagaacctattcagtgagcaaggacaggtgctggatgctaaggtcatctacgacagggatagcgcaggtcaaagggggtttggtttcgtcacctatggctctgccgaggaggtcacaatgcataatcaactttgatggcattgacttggaatgtaagacgatcccagtcacggtgcagaaatcaaccccagcgtgaattgaaaatttttgtaaaggggttataaagcca

SEQ ID NO: 74725 - protein, 244 aa, Zea mays
  misc_feature: Ceres CLONE 1559165
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEEAGAAVEQFNGYTFQGRPLRVNCGPPPPRDGSAPRAPRVGGLLAAAAAALSIQGTRYTWGTFAWGVDNSTLENLFSEQGQVLDAKVIYDRDSAGQRGFGFVTYGSAEEVTMHNQL

SEQ ID NO: 74726 - DNA, 904 bp, Zea mays
  misc_feature: Ceres CLONE 1559166
  misc_feature: Encodes the peptide sequence at SEQ ID NO. 74727
  misc_feature (904)..(904): n is a, c, t, g, unknown, or other
gctccccgcggtggcggccgctctagaactagtggatcccccgggctgcaggaattcgtctcacccctagaaaaaccacacctccagtcctccactgacaagccgccgccgctcttccacctacctctccccgggctcgcacccatggccacggctttgatggttgcagccaccacctcctgctccccgggccgcgccgcgcctcgcctgaagcctgtggcctcctcctcctccagcagtagcagcagcaactcggcgcggccgcggcggcccttggagcaagagatcccgcggctgctggcaactgcggcggatgcggaggtagcaaacgcgccgctccctgcgctggcggaggagatggagaaggccgcactgtttgacttcaacctgacgctcccggcgatcgagaccgagttcctgctgctcatggaggcgctggacaaactctacttcaccccgctaggtaagttcatggatgagcgggacgcccagatccccgcggagctcgggggatgtcaagggccccccccaggaggtgaagcagctggaagaccccgggggggccatcttgaaaggtgcgcccgccaagatccacagcgggcttatacaagattgaagaggaaaccccccgatacatgggagcccaacatgagacaaggtaccatccatggggagggcgggatcttaaaggggcccccccacccccggtgcgcccaaaagaaaagggtcgtcattggcggctccccccccaatcccccccctccgtgatgtaaaaccaaagaaaagaggcccgccccccccggaaaaaaaactaaacgcgcccccgcctatcccaaatacataaaattcgccaaaactcggagagtattgaagaagtctgagaacatgtgcggggaaaccaccn

SEQ ID NO: 74727 - protein, 207 aa, Zea mays
  misc_feature: Ceres CLONE 1559166
  misc_feature: SWISSPROT Homolog: EC 3.6.3.14 H(+)-transporting two-sector ATPase
MATALMVAATTSCSPGRAAPRLKPVASSSSSSSSSNSARPRRPLEQEIPRLLATAADAEVANAPLPALAEEMEKAALFDFNLTLPAIETEFLLLMEALDKLYFTPLGKFMDERDAQIPAELGGCQGPPPGGEAAGRPRGGHLERCARQDPQRAYTRLKRKPPDTWEPNMRQGTIHGEGGILKGPPHPRCAQKKRVVIGGSPPNPPPP

SEQ ID NO: 74728 - DNA, 961 bp, Zea mays
  misc_feature: Ceres CLONE 1559168
  misc_feature: Encodes the peptide sequence at SEQ ID NO. 74729
  misc_feature (621)..(621): n is a, c, t, g, unknown, or other
  misc_feature (704)..(704): n is a, c, t, g, unknown, or other
  misc_feature (705)..(705): n is a, c, t, g, unknown, or other
  misc_feature (794)..(794): n is a, c, t, g, unknown, or other
  misc_feature (915)..(915): n is a, c, t, g, unknown, or other
  misc_feature (961)..(961): n is a, c, t, g, unknown, or other
ggagctccccgcggtggcggccgctctagaactagtggatcccccgggctgcaggaattcgtctcacccctagaaaaaaatcttttctttccagcctcaaatcccgtttttcccatcccgtgaagaaccatggcacggtactccccaccgtcgctgcgctgcttcttccgctgcgccgccagctccgcctcccgagccgtaggcagcggcactcggaagaagaaccttgtattcttgggctctccccaggtcgccgcctcggtcctggacaagctgctgggcgcgtccggctccccggaatccgcatttcaggtggctgccgtcgtgacgcagccgccggccgccaagaacagggggaggaagttgatgccgtcggccgtcgcgcagttagcgctcgatcgcgggttcccagaggaactcatcttcacgccagaacgagcccgagaagagtcgttcctgtcggccttgaaggaagtggaaccggatgtttgcataactgctgcttacgggaacattctgccccagaaatttcttgatatcccatcgtgcggcacagttaatatacacccaagtttgttgcctctatatcgtggtgcagctcctgtgcagagggcactgcangatggtgttgcagaaacaggtgtttcccttgcatatactgtccgtgcattggatgcaggtccagtgattgcgtgtgaaaggtnnttctgtgatgaatgtattaaggcaccagagctactttctatgctgtttcatttaggatccaagctattgattaatgaacttccatccantctttgatggtcggctaaagataaggcacaccacaggatgactcccaagctacactggcacaaagttaaattctgaggagtcatggctatcgtttgacgaaaaaactaagggctgcatacnaagtgcggggcattgcaggatggcctgggaccccgcaagctgcacn

SEQ ID NO: 74729 - protein, 223 aa, Zea mays
  misc_feature: Ceres CLONE 1559168
  misc_feature (31)..(219): Pfam Name: Formyl_trans_N Pfam Description: Formyl transferase
  misc_feature: SWISSPROT Homolog: EC 2.1.2.9 Methionyl-tRNA formyltransferase
  misc_feature (164)..(164): Xaa is any aa, unknown, or other
  misc_feature (192)..(192): Xaa is any aa, unknown, or other
  misc_feature (222)..(222): Xaa is any aa, unknown, or other
MARYSPPSLRCFFRCAASSASRAVGSGTRKKNLVFLGSPQVAASVLDKLLGASGSPESAFQVAAVVTQPPAAKNRGRKLMPSAVAQLALDRGFPEELIFTPERAREESFLSALKEVEPDVCITAAYGNILPQKFLDIPSCGTVNIHPSLLPLYRGAAPVQRALXDGVAETGVSLAYTVRALDAGPVIACERXFCDECIKAPELLSMLFHLGSKLLINELPSXL

SEQ ID NO: 74730 - DNA, 961 bp, Zea mays
  misc_feature: Ceres CLONE 1559170
  misc_feature: Encodes the peptide sequence at SEQ ID NO. 74731
  misc_feature (541)..(541): n is a, c, t, g, unknown, or other
  misc_feature (884)..(884): n is a, c, t, g, unknown, or other
ctggagctccccgcggtggcggccgctctagaactagtggatcccccgggctgcaggaattcgtctcacccctagaaaaaagcagccagctcccactcgcaccgcccgtccgcccagaactatctcgctcgtccgcgttcagctcagctactccaatttcgcaacaagttgcaagcaataaccgaccaaggacgacgaacgggtcgatggccacgctctcctcctgcagccgcctgagtagcggcaccggcgccgcggccatccaccggcagccggcccgtgctggagccgtcctcgtcgtcacctgcaggcggagctcctccgcgaccgtccgcgccgcagccgctgccacggcggcggcgccggctgccgtagagctgcagaacaagggggtgtcgctgccgacgtgggcggagttcgagctcgggcgggcgccggtctactggaagaccagcagcggcctcccgccctcgccggggcgaggggctgaccctgttctacaacccggcggcgacgaagatggccccgaacgaggtgttcnggcgtggcgttcaacggcggcttcaaccagcccatcatgtgcggcggagagccgaggcagatgacgctgcaggagcggggcaaagccgacccgcccatctacccatcaggatacgcgtgccgcagcacgccgtaagcttgatcttctccttcaccaacggggccgagtgggacgggccgtacacgctcaagttcagggtccccaagccatggcagaaccaagcgctgagcttctttcacggagggcctgggcgacgaactcaacaggggaggggcgcctgcgacctggccatctacccggacaaggacatcgccatcaccagctgcgccatgaacgctactcnaggaaaggggggggggattccggtgcaagctggaactcctgagccggtgcacggaacccagcttccaaatggttcca

SEQ ID NO: 74731 - protein, 132 aa, Zea mays
  misc_feature: Ceres CLONE 1559170
  misc_feature (112)..(112): Xaa is any aa, unknown, or other
MATLSSCSRLSSGTGAAAIHRQPARAGAVLVVTCRRSSSATVRAAAAATAAAPAAVELQNKGVSLPTWAEFELGRAPVYWKTSSGLPPSPGRGADPVLQPGGDEDGPERGVXAWRSTAASTSPSCAAESRGR

SEQ ID NO: 74732 - DNA, 959 bp, Zea mays
  misc_feature: Ceres CLONE 1559171
  misc_feature: Encodes the peptide sequence at SEQ ID NO. 74733
tggagctccccgcggtggcggccgctctagaactagtggatcccccgggctgcaggaattcgtctcacccctagaaaaaaaaaaccaacgtgctcgatctccctccgccactccatccatctcctcgctcccagtccccgggaagctacgaagcatggcgtccgtcaccgcccgcgccccggtcgcggcccttcgcccgtcgtcggcatcgctcaagtcgtcgtcggccttccttggccactctagccgcctcggccgcaccgcgtcgcccacgaggcgcagcctcaaggcggaggccaagggcgagtggctccccggccttccctccccctcctacctcgacggcagcctggcgggtgacaatggcttcgacccgttgggcctggcggaggaccccgagaacctgcggtggttcgtgcaggcggagctggtgaacggccggtgggccatgcttggcgtggccgggatgctcatcccggaggtgctgaccaaagccgggctgatcaacgcgccgcagtggtacgacgccggcaagtcggagtacttcgcgtcgtcgtccacgctgttcgtggtcgagttcatcctgttccactacgtggagatccggcggtggcaggacatcaagaaccccggcagcgtcaaccaggaccccatcttcaagagctacagcctgccgccgcacgagtgcggctaccccggcagcgtcttcaacccgctcaacttcgcgcccacgctcgaggccaagggagaggagctcgccaacgggaggctgccgatgctggcgttcctgggcttccctgatcagcacacgtcaccgggcaggggcccttcgacacctgctgcagcacctgtctgaccatggcacacaccatcatcaaaactttctccggttgaatcaaggtcaaggaaggatccatccatcgctggggactgaatatgactggaaggcacctgggacc

SEQ ID NO: 74733 - protein, 233 aa, Zea mays
  misc_feature: Ceres CLONE 1559171
  misc_feature (57)..(219): Pfam Name: Chloroa_b-bind Pfam Description: Chlorophyll A-B binding protein
MASVTARAPVAALRPSSASLKSSSAFLGHSSRLGRTASPTRRSLKAEAKGEWLPGLPSPSYLDGSLAGDNGFDPLGLAEDPENLRWFVQAELVNGRWAMLGVAGMLIPEVLTKAGLINAPQWYDAGKSEYFASSSTLFVVEFILFHYVEIRRWQDIKNPGSVNQDPIFKSYSLPPHECGYPGSVFNPLNFAPTLEAKGEELANGRLPMLAFLGFPDQHTSPGRGPSTPAAAPV

SEQ ID NO: 74734 - DNA, 865 bp, Zea mays
  misc_feature: Ceres CLONE 1559172
  misc_feature: Encodes the peptide sequence at SEQ ID NO. 74735
ctggagctccccgcggtggcggccgctctagaactagtggatcccccgggctgcaggaattcgtctcacccctagaaaaaatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgcaacggcgtcaagttcggcgaagccgtgtggttcaaggccggctcccagatcttcagcgaaggcgggctggactacctcgggaacccgagcctcatccacgcgcagagcatccttgctatctggccctgccaggtcgtgctcatgggcgccgtcaagggctaccgcatcgccggcggcccgcttcggcaagtcgtcgacccgctctaccccggcggcagcttcgacccgctcggcttcgcgaagaacccaaggcctcccccaaccaaaggcaaggactacaaaacgccccccccccaggttccccaagttcggattcttcgtccaggcatcgtcacccgggaaggcccccttcaaaacc

SEQ ID NO: 74735 - protein, 240 aa, Zea mays
  misc_feature: Ceres CLONE 1559172
  misc_feature (65)..(203): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWPCQVVLMGAVKGYRIAGGPLRQVVDPLYPGGSFDPLGFAKNPRPPPTKGKDYKTPPPQVPQVRILRPGIVTREGPLQN

SEQ ID NO: 74736 - DNA, 978 bp, Zea mays
  misc_feature: Ceres CLONE 1559173
  misc_feature: Encodes the peptide sequence at SEQ ID NO. 74737
  misc_feature (863)..(863): n is a, c, t, g, unknown, or other
ctggagctccccgcggtggcggccgctctagaactagtggatcccccgggctgcaggaattcgtctcacccctagaaaaaatggcagtggggaagatgctgatgaagtaaaggcatcagctgagcgactgagcttagatattagagtctatccaggccgtgatcatggagattcaatattccacgactacaaggtcttcataaacccaagtacaactgatgtggtatgcacaacaactgcagaagctttggcaatggggaagattgtgatctgtgcaaaccatccttcaaatgtttttttcaaaagatttcctaattgtcacatgtacaatactgatgaagagtttgtgagactaacaatgaaagctttggcagaagaacctatcccactgtcagatgatttgcggcatgaactttcctgggaggcagcaacagaaagagttattagggttgctgatattgcaccaactgtgcctgtgggactaccaccaccctcctcgcagcatttcatgcgcatctccccagatgaactgcagaagaacatggaagaggcatctgcatttttccataatactatctctgggtttgaagctgtgcattgatgtgttcggtgcaataccaaacacactgcagccggatgaacagcaatgcaaggtacttgggtggaatttgcagggatagcattagcttttcttgcgatgctgtttgcatggaccatagaatgagcatgtctactgcacggcaaaaagctttgtcggaaaggtctcagactgtcaaaatactttctatgtgggtgttctgggtgtggggcactgcattgtttctcatttatcagaagcggtctgaagtccctggatgcctcgntatctgccgatgttaatctcaagcagctggaatggaaccctatataccgcccaaaatttggggacggttttttcaccaggttgttcccccagaattgaccctggttttgaaactt

SEQ ID NO: 74737 - protein, 115 aa, Zea mays
  misc_feature: Ceres CLONE 1559173
  misc_feature: SWISSPROT Homolog: EC 2.4.1.241 Digalactosyldiacylglycerol synthase
MGKIVICANHPSNVFFKRFPNCHMYNTDEEFVRLTMKALAEEPIPLSDDLRHELSWEAATERVIRVADIAPTVPVGLPPPSSQHFMRISPDELQKNMEEASAFFHNTISGFEAVH

SEQ ID NO: 74738 - DNA, 973 bp, Zea mays
  misc_feature: Ceres CLONE 1559176
  misc_feature: Encodes the peptide sequence at SEQ ID NO. 74739
  misc_feature (732)..(732): n is a, c, t, g, unknown, or other
tggagctccccgcggtggcggccgctctagaactagtggatcccccgggctgcaggaattcgtctcacccctagaaaaaatcccctgcgcctgccctcccctcctgcagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtggggaaagctgctggcgacaggtggaaatccctgagcgagtcggacaaggctccctatgtagccaaggctaacaagctcaagctcgagtacaacaaggccatcgctgcctacaacaagggcgagagcactgcagctaagaaggctcctgcccaggaggaagaggaggaagatgaaagagagtctgacaagtccaagtcggaggtcaatgacgaggatgatgaagaggttagtgaggaggaatgaanatgatgacccagtgatggagctcctcgagacaatggaccgtgcttcatcccacaatggagcggcttccacaaggccccgtggcgatccccaaaaaggagcctaattccatgtactaggaattattcagttcactcccacatcgggatgttttaatttttacctttgccgggcttaaccggatagcgctcctcgttggcgccactggcgggggggtcgccccctggccgaggggggtttggg

SEQ ID NO: 74739 - protein, 152 aa, Zea mays
  misc_feature: Ceres CLONE 1559176
  misc_feature (41)..(110): Pfam Name: HMG_box Pfam Description: HMG (high mobility group) box
MKGAKSKGAAKADAKLAVKSKGAEKPAKGRKGKAGKDPNKPKRAPSAFFVFMEEFRKEFKEKNPKNKSVAAVGKAAGDRWKSLSESDKAPYVAKANKLKLEYNKAIAAYNKGESTAAKKAPAQEEEEEDERESDKSKSEVNDEDDEEVSEEE

SEQ ID NO: 74740 - DNA, 971 bp, Zea mays
  misc_feature: Ceres CLONE 1559177
  misc_feature: Encodes the peptide sequence at SEQ ID NO. 74741
  misc_feature (716)..(716): n is a, c, t, g, unknown, or other
  misc_feature (723)..(723): n is a, c, t, g, unknown, or other
  misc_feature (754)..(754): n is a, c, t, g, unknown, or other
ctggagctccccgcggtggcggccgctctagaactagtggatcccccgggctgcaggaattcgtctcacccctagaaaaaaacaagagatagtacttgacactcctgtcctgctcctcccactcccacgctcccaaccgagctcgagcgcacgcacacgcgcacaagcaggagctcctgtcccgctagatcccaaacagtctcctgcccgcgcgcgtttggggtggcgcgaaggaatcaccggatggcgatgttcgcgcggccgctgctggccaccctgctgctgctgccggcgttcctgctctctgccgcctcggccgccgacagcaagagcaaccctgctgatgagctcgtggcactgatcaacagcaaccgcactgctggcaaggcatcttctgtttcggacaaccaaggtttgggatgcatcgctctgcagtacatcaaagcatacgaaggccattgtgaccaggtggacgacaagaagccgatggagtcaagcttcaccgacacgttcgccccgacctgtggcgtccaggccacaaccctctccaagatcaccggaaggctggtggcttgccagtcccagtacttggctccagctgaggcctttggcgtcttgttggtgaacgacgcgaagggcctccagatactgcgcagcaagaaccacacggaggtcggggcggctgtgagcggcaccgatgggcgtggaccgtactnctggtgncgtcctgtcagtgacggcaagcgatacagcnttcaaggggggaaatgcgaaaatgccgaagggcagcatccaccgggggatgctcagtgccaacaatgacgactgctcgggcccaacaatggcgcccgtttgaacaatgctggtgcccctgaagctggtgaacgccatttcttttgctgtacctgcttgggaaacgggaaaaataggggaaatgtttccggccattaattggctttggccaccatccc

SEQ ID NO: 74741 - protein, 192 aa, Zea mays
  misc_feature: Ceres CLONE 1559177
  misc_feature (158)..(158): Xaa is any aa, unknown, or other
  misc_feature (160)..(160): Xaa is any aa, unknown, or other
  misc_feature (171)..(171): Xaa is any aa, unknown, or other
MAMFARPLLATLLLLPAFLLSAASAADSKSNPADELVALINSNRTAGKASSVSDNQGLGCIALQYIKAYEGHCDQVDDKKPMESSFTDTFAPTCGVQATTLSKITGRLVACQSQYLAPAEAFGVLLVNDAKGLQILRSKNHTEVGAAVSGTDGRGPYXWXRPVSDGKRYSXQGGKCENAEGQHPPGDAQCQQ

SEQ ID NO: 74742 - DNA, 789 bp, Zea mays
  misc_feature: Ceres CLONE 1559178
  misc_feature (346)..(346): n is a, c, t, g, unknown, or other
  misc_feature (393)..(393): n is a, c, t, g, unknown, or other
  misc_feature (508)..(508): n is a, c, t, g, unknown, or other
  misc_feature (509)..(509): n is a, c, t, g, unknown, or other
  misc_feature (562)..(562): n is a, c, t, g, unknown, or other
  misc_feature (566)..(566): n is a, c, t, g, unknown, or other
  misc_feature (572)..(572): n is a, c, t, g, unknown, or other
  misc_feature (577)..(577): n is a, c, t, g, unknown, or other
  misc_feature (583)..(583): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (625)..(625): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (632)..(632): n is a, c, t, g, unknown, or other
  misc_feature (677)..(677): n is a, c, t, g, unknown, or other
  misc_feature (678)..(678): n is a, c, t, g, unknown, or other
  misc_feature (685)..(685): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (723)..(723): n is a, c, t, g, unknown, or other
  misc_feature (730)..(730): n is a, c, t, g, unknown, or other
  misc_feature (749)..(749): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
tggagctccccgcggtggcggccgctctagaactagtggatcccccgggctgcaggaattcgtctcacccctagaaaaagtgcgggtgcgctttgctcctctccccgcgtgctctccctctctctcgcgcgcgcggcgacgactcggctagtcggctaccgccgccgcccctacgccagcttcccagctcttcgtcaggcccttctccgtcaacgagcacccagcacagatcctgagcctccacacctcaacgatggcgggattcagcatgccttgcacccaagaccaggaacctggtggtggctgggggcctgtcggccttcgtgctcggggtctactactacanccatgagagccccgtggggaaggcaccggacgaaactgcccaggggngggggggacaaccccaaaattttgaggaaaaaaaaaaaaaaaggacccccccccaaaaaccccccccccgggggggggggatattaaaaaaggggggggcccccctcccccccgnnttttgctttttttgagaaaaaaaaaaaccctgtttttttcctcgggggggggngganaaaaanaaaanaaaagngggggggggggggggggnnnnagacggccccccccccccacnaannnanaaaaaaaaaaaaaaaaaagggggggcccccccccccccttttgtnnagggganaaaaaaaaaaaaannnnaaaaaaaaaaagaaaaagtgngggtggncccccctccctccctcccnccatnnnnnnnaatttttttaataaaaaaggggggggggt

SEQ ID NO: 74743 - DNA, 970 bp, Zea mays
  misc_feature: Ceres CLONE 1559179
  misc_feature: Encodes the peptide sequence at SEQ ID NO. 74744
ctggagctccccgcggtggcggccgctctagaactagtggatcccccgggctgcaggaattcgtctcacccctagaaaaaaagcgttccagatcgtactggaccaatctgccaccacactttgatcacacacagacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgcgcagctgccgtcgtcgcgaccgaggccgcgcagatcgactacagctcaagcgtctcggtgttcccgatggaggcctgcgacctgcttggtggcgacgcgtgcaacgggcccatgttcccggaagccaagcccgcctcggcggcggcggcggcgagcaggagtgtggtcggggtggacagggactacctgtcctacgacgagccaaagacggtgttcccgggcgaggcgtgcgacgacctcggcggcgagttctgcgaggcgccgtaccaggactgcgtctccagggagctggcgcacgcctgaagaccctgatccatccatgtctgtccacacgctatgtacgtatgtgtagcagatggtttacaatctacgtgttagaacaactccagcagcactccgcatggcggctccggatccctattttgcggagcctagctcactattcatcagtccagcaggctccgcatccggctccgtaaaacggacggcctgtacctgcactccccatttccacggctttctctctcctctccgcacctctctgcttgcgcgcgcggctgctcccgggccccaggtgtcataaatgcatccgaaatggggaattggaaatgttcttgaaacggaacggaaacggaaagaaagggaaacagttggcccccttttaagggaaacggaagaggatctccttgatttgccct

SEQ ID NO: 74744 - protein, 138 aa, Zea mays
  misc_feature: Ceres CLONE 1559179
  misc_feature (1)..(126): Pfam Name: Lir1 Pfam Description: Light regulated protein Lir1
MQAAATAAGFSAVLPAKGRPAARSRVVARVPATRRSVRAAAVVATEAAQIDYSSSVSVFPMEACDLLGGDACNGPMFPEAKPASAAAAASRSVVGVDRDYLSYDEPKTVFPGEACDDLGGEFCEAPYQDCVSRELAHA

SEQ ID NO: 74745 - DNA, 960 bp, Zea mays
  misc_feature: Ceres CLONE 1559181
  misc_feature: Encodes the peptide sequence at SEQ ID NO. 74746
ctggagctccccgcggtggcggccgctctagaactagtggatcccccgggctgcaggaattcgtctcacccctagaaaaatccgtcgaacacagagtcacttcgccacgaacaaaagcgcatcgatctcgctgtcgtcactcctcgtcacccagccacgaacagaggcaccacccagcatggccctgcaggcggcgctcctcccatccaccctctcatccgtccccaagaagtgcagcctcgccgtcgcggcgaaggacacggcattccttagcgtatcccagaagaaggtgcaggcggcgtcgctgtcggtgagaacgcgggtggcgacgacggcgcctgtggccacgccggggtccagcacggcggccaaggatgggaagaagaccgtgcggcagggcgtggtggtgatcacgggcgcgtcgtcggggttgggcctggcggcggccaaggcgctggcggagaccggcaagtggcacgtggtgatggcctgccgcgacttcctcaaggcggccaaggcggccaagggcgccggcatggcggacggcagctacaccatcatgcacctggacctggcctccctcgacagcgtgcggcagttcgtggacagcttccagcgcgccggcatgccgctcgactcgctcgtctgcaacgccgccatctacgggccacggcaagaacgccgacgttcacggcggacagatactagatgagcgtcggcgtcaaccacctgggccacttcctcctggcgcgcctgctcctggacgacatgcagaagtccgactacccgtcccgccgcctcatcatcctcgggctcatcaccgggaacaccaacacgctgcccgggacatcccgcccaaggcggggctgggcgacctcgcggccctccggcggggctgcgcggcaagacggctcctgcatgaatcaagcttccaaacttcgaggggccaaaggctaaaag

SEQ ID NO: 74746 - protein, 177 aa, Zea mays
  misc_feature: Ceres CLONE 1559181
  misc_feature: SWISSPROT Homolog: EC 1.3.1.33 Protochlorophyllide reductase
MALQAALLPSTLSSVPKKCSLAVAAKDTAFLSVSQKKVQAASLSVRTRVATTAPVATPGSSTAAKDGKKTVRQGVVVITGASSGLGLAAAKALAETGKWHVVMACRDFLKAAKAAKGAGMADGSYTIMHLDLASLDSVRQFVDSFQRAGMPLDSLVCNAAIYGPRQERRRSRRTDTR

SEQ ID NO: 74747 - DNA, 1004 bp, Zea mays
  misc_feature: Ceres CLONE 1559182
  misc_feature: Encodes the peptide sequence at SEQ ID NO. 74748
  misc_feature (446)..(446): n is a, c, t, g, unknown, or other
  misc_feature (447)..(447): n is a, c, t, g, unknown, or other
  misc_feature (877)..(877): n is a, c, t, g, unknown, or other
  misc_feature (948)..(948): n is a, c, t, g, unknown, or other
ggagctccccgcggtggcggccgctctagaactagtggatcccccgggctgcaggaattcgtctcacccctagaaaaagacgctcgcttctccaaatccccccttcgccttgcgagggggcggaggggaggtggtagtggtagggtatacaggagtgctctgcccatggagaaggcggggcaacaacgccatgttatcggcggcggcggcaagaaggcgcccgcgctggggctgcagaagcagaactcgtggtcgccggacatcgagcgcgacgaggcgtgggagcgccggcgcaggggcatgcgccgcggggccacggcgctgcggcgcgcccgcagcgtcacggacgacgacctcgacgagctccgcggctgcatcgacctgggcttcggcttcgagccggcgcccgccgccgcgtgcgcctgcgcctgcgcccgggggaaccnngcctctggagacgctggcggcgctcgacctctactacgccgtccacggcgggggcgggcggaggcgccccccgtgctccgtgcggccccccgtcggaaggcgtcctcctcccaaagaatccccccctcggaaacccccttgtccatccctctctcaggggaacccccggaaaaacgggaaaaaaccgccttaaccatggggcgccaggggtttcccccttccctttctaacccccccctaaatctctccggcccccggccccccccaccttgttccttttggaggagaagaaaaaaaaccttcgcaggttcccccccccccaaaagaggaactcccccgcggcccccccccccccgaaaaggggggaaagaaaaatcctctgtgggggtggcgctttggggggccgcccccccccccccaccgcgggggnttttggggagacgggaaaaatatctcttcccccccaagtattttagttccggagaaaaaaaaacccgcccnagttgttgttgttttataacccccgcccccccccacaaaaaaaaaaaaaccggcct

SEQ ID NO: 74748 - protein, 279 aa, Zea mays
  misc_feature: Ceres CLONE 1559182
  misc_feature (21)..(115): Pfam Name: DUF1685 Pfam Description: Protein of unknown function (DUF1685)
  misc_feature (94)..(94): Xaa is any aa, unknown, or other
  misc_feature (238)..(238): Xaa is any aa, unknown, or other
MEKAGQQRHVIGGGGKKAPALGLQKQNSWSPDIERDEAWERRRRGMRRGATALRRARSVTDDDLDELRGCIDLGFGFEPAPAAACACACARGNXASGDAGGARPLLRRPRRGRAEAPPVLRAAPRRKASSSQRIPPSETPLSIPLSGEPPEKREKTALTMGRQGFPPSLSNPPLNLSGPRPPPPCSFWRRRKKTFAGSPPPKRGTPPRPPPPRKGGKEKSSVGVALWGAAPPPPPRGXLGRREKYLFPPKYFSSGEKKTRPSCCCFITPAPPHKKKKTG

SEQ ID NO: 74749 - DNA, 880 bp, Zea mays
  misc_feature: Ceres CLONE 1559184
  misc_feature: Translation starting site: 152
caaagctggagctccccgcggtggcggccgctctagaactagtggatcccccgggctgcaggaattcgtctcacccctagaaaaaacatcttgagccgctatcgaccttcatgtctcgctacatatcggtgcaatagaaaaagcagccgcaatggagagcagcaacatggccctctcctccacaggcttagacagcatggccgtgatcgtgccatcgcacgaccacctgcggcgaggcccgcgtgacgatgcgcaagacggaggggaaggccaagccggcagaggcgtcctgggagcccgtggtatggccccgaccgcgtgacgtacctgggacctgtgtccggcgagacgccgagctacctgacaggcgatctcccgggcgactacaactgggacaccgctgggctgtcggctgaccctgacacgttcgccaagaaccgggagctggaggtgatccactcgcgctgggccacgctgggcacgctccgatgcgacttccgtgagctgctcgcacgcaacggcgtcaagttcggccaggccgtgtggttcaaagccggctccaacatcttcagagagggtggactggactacatcgggaacccgagcctcatccacacgcagaggatcagcgacatctgggactgccaggtcgtgctcaagagcgccgtcgatggatacctcatgtactgagggccgctctgagagtcaaccacccgatctatgcatgcggtagcttcgacacatcaggctctcgagtaaccgagccatggctgagctcaacgcgatgactatgatcgacgcctcgcctttctcatgtcgcgatctcggcatgcatcggcactggcatgcccgctgaaactcgatactaattgccacccgt

SEQ ID NO: 74750 - DNA, 942 bp, Zea mays
  misc_feature: Ceres CLONE 1559185
  misc_feature: Encodes the peptide sequence at SEQ ID NO. 74751
  misc_feature (711)..(711): n is a, c, t, g, unknown, or other
ctggagctccccgcggtggcggccgctctagaactagtggatcccccgggctgcaggaattcgtctcacccctagaaaaagccgcgcggcgatgcggagcagaagcaatggaggtgctcagctccagccgcttcgctagggcactcttactcccgacaattctctacccggtctccaggcacctcatcacgcccccgtgccgccgccacgccgtccataccctagcctcaggctcagcccccgttcccgccgccgatgccgccgatccttcgccgtcgctcgcccggctcctcgccgccgcgttgcggggcggccgctcgggaagggagctccccgacctctctgccgctaccactggcggcgccaggatagggactctgctcatgagcaccacggcggcagcggtgaccaacgcgcgggagagcccgtacctgctggcgctggcggccaacccgaccttcgtgtcggggctgctggcgtgggccgcggctcaggacgacaaggcccttctcacctcagtcggcgagcagcgctgggacctgcggatgctcttcagctgcggcaggatgccgtgctcatacaccgcgctctgcaccgcgctcactgcttccgtcgagctctgccatggtgccagcgacgcgctcttccctgatttgtctcggtttcactctgataattatgtacagatgcgaccggcgtcaggcgacaacnccagaatgcaggccgatgtactcaatcacatcgtggatgaccatgtttgaaagccatcccacttagagaaagagaacccaggagctgttatgacagactaccgcacaggtctgtgctgaagcattttcggcatctacgctgccatggtattgctgccacgatggcatgccccccgtttggacgtgcgggtttatgtatgcatgaccaagaacgaaacattccctcgcgggt

SEQ ID NO: 74751 - protein, 217 aa, Zea mays
  misc_feature: Ceres CLONE 1559185
  misc_feature (202)..(202): Xaa is any aa, unknown, or other
MEVLSSSRFARALLLPTILYPVSRHLITPPCRRHAVHTLASGSAPVPAADAADPSPSLARLLAAALRGGRSGRELPDLSAATTGGARIGTLLMSTTAAAVTNARESPYLLALAANPTFVSGLLAWAAAQDDKALLTSVGEQRWDLRMLFSCGRMPCSYTALCTALTASVELCHGASDALFPDLSRFHSDNYVQMRPASGDNXRMQADVLNHIVDDHV

SEQ ID NO: 74752 - DNA, 950 bp, Zea mays
  misc_feature: Ceres CLONE 1559186
  misc_feature: Encodes the peptide sequence at SEQ ID NO. 74753
  misc_feature (909)..(909): n is a, c, t, g, unknown, or other
ctggagctccccgcggtggcggccgctctagaactagtggatcccccgggctgcaggaattcgtctcacccctagaaaaaacaccccgcgtcccaccaacttccattccctaccgcccgcccaccccactccactccgctcctcccactcgagccatcatggccctcgcctcccgcgccgccgcagccgccgtggcgtgcgtcctcctggcgctcgccgcctccgccgcgggggcgggctccaactcccctgcaccggcgccggcggtggactgtatctcccaggccgccagactgatcgactgcatcgactacgtccagaaggggagcagcgcgcgccgtccgtccgctgcctgctgcggcgaggtcaagaccgcagtggccagccccatcatcgtgggctgcctctgctccctcgccggctccaactccagtaacctgggctttcccatcaacatgaagcacgtgctggagctccccggcgcgtgcggcgcgtccaacgccgccttcagcaagtgcaacattgccgcgcttcccccaaccgaagcacctgcaccgtccgccgccggggggtcatctagcggaggcgcggaggcatcttcaccgcgcgcctcggcggagagctctcctccgatgacggcgaccgccctgttagctgccgtggcggctcccctgctcgcctactactgcagctacatcttctgagggtttccttctgctgctgatgacgtctaggctgactgacctatctctatgtatgtgacgactccagttaaactgtggagcgcggctgcacgtgcaattgtgcatgcgcagtcgacaatgttgctgtagtcctgcgatactctagtacttgaaaagtggtgttgtattgactggtttaacttgctccccgtgctacatcgacggnttacccctcagttgacacctgggaaccggtgttactgggaa

SEQ ID NO: 74753 - protein, 181 aa, Zea mays
  misc_feature: Ceres CLONE 1559186
MALASRAAAAAVACVLLALAASAAGAGSNSPAPAPAVDCISQAARLIDCIDYVQKGSSARRPSAACCGEVKTAVASPIIVGCLCSLAGSNSSNLGFPINMKHVLELPGACGASNAAFSKCNIAALPPTEAPAPSAAGGSSSGGAEASSPRASAESSPPMTATALLAAVAAPLLAYYCSYIF

SEQ ID NO: 74754 - DNA, 924 bp, Zea mays
  misc_feature: Ceres CLONE 1559187
  misc_feature: Translation starting site: 434
  misc_feature: Pfam Name: DUF150 Pfam Description: Uncharacterised BCR, YhbC family COG0779
ctggagctccccgcggtggcggccgctctagaactagtggatcccccgggctgcaggaattcgtctcacccctagaaaaaatggcggctctgaagtcatcttgttttcgatggattccggccacccaaatcgtctctcatgggcgctttccagtcatgacgtcaaggcttcctcttctgcccggctcgttgccctccactactgttgcagtgagtgctcccttttcccgacgtccatgcccacccacttgcttgtaccaatgccccagcggtgagtgccatttcccaagaagaagaggaatgaatatgtcgaaaatccgccagatgaggaagtcgcacatgatttcacccaccagttggatgaggacttctacgacgcccaataagacgaacgcgatgtaatggatgacgactgaatacctatgacgactactatgactttgaagatgattttgcacatcgatgatgaacacgatctttatgctcgagatggatgtgctggtggcaacatatcccttgcaggtgcatgatgggacacagaacccttagctttggcacagcacgtctcagcgtccgtggaagaatacttgaaatatacgctgtcatgacagctgcaaacttgaccattaaagtaccctttgataagatgtaccccccgtatggctctccaaggattattcacttttaagcttacacagttgcataatcttgcaaaggtgaccaaacgaagtcggcggcaaaaaaccgaaaaacctccccggaagaggcgaccccgagggtaaaagagtacccggtcccccgaagattgaactttccaaaaaagggatttgttgtcaaattccaacccaggtatttggaaccccccctagaaaagggaggtgggtaaaccattttccttaaaggcccttaaaatttcatgtggaat

SEQ ID NO: 74755 - DNA, 924 bp, Zea mays
  misc_feature: Ceres CLONE 1559188
  misc_feature: Encodes the peptide sequence at SEQ ID NO. 74756
  misc_feature (737)..(737): n is a, c, t, g, unknown, or other
  misc_feature (773)..(773): n is a, c, t, g, unknown, or other
  misc_feature (804)..(804): n is a, c, t, g, unknown, or other
  misc_feature (809)..(809): n is a, c, t, g, unknown, or other
ggagctccccgcggtggcggccgctctagaactagtggatcccccgggctgcaggaattcgtctcacccctagaaaaaagcttcacaagctaggtgtgtcagcccaaaaccaccaaccagcccgagcttttctttgctgcctgccgcggcgcgtcgcgacccgggccgacaagatagggtcggaaagccccgccgccgacggcgtcggcgacgccgcgcgcaagcggcccagcggcgatgttggccccaccccggggccagccgacaagcgccgccgcccggagcacccttcttcctcctccgcgggctcccgcgaccgccaccaccaccaccacggccgccgcccgccgtcctcggccgacgagaaggtgcgcgcctctcacatcctgatcaagcacgagggctcccgccgcaaggcctcgtggcgggatcccgaaggcgtcgccatctccgccacgacacgcgacgacgcggccgacctcgcgcgcgcgctccgcgaccagatcgtctccggtgaccgcgagttcgaggacgtcgctgccgagaactccgactgcagctcggccaagcgcggcggtgacctcggttcatttgggaggggtaagatgcagaagccttttgagaaggccgcgtttgctctgaaggtcggggagatcagcgacgtggttgatacagagagcggggtgcacatcatcaagaggactggctgactgcacctgctgcagtatccatacacngtggatgccttggagaggctgtatggtttcttgctncattggtgaatttgtgcgtgttttttctccntcccntagacgggttgtttggatgctcatctcttcacctcacgcaaatgggttggagtggtttgaaatccaaccaactactccaaccctatttggatgaaatgaaatttatcacgcgcct

SEQ ID NO: 74756 - protein, 34 aa, Zea mays
  misc_feature: Ceres CLONE 1559188
  misc_feature: SWISSPROT Homolog: EC 5.2.1.8 Peptidylprolyl isomerase
MQKPFEKAAFALKVGEISDVVDTESGVHIIKRTG

SEQ ID NO: 74757 - DNA, 955 bp, Zea mays
  misc_feature: Ceres CLONE 1559192
  misc_feature: Translation starting site: 232
  misc_feature (737)..(737): n is a, c, t, g, unknown, or other
  misc_feature (810)..(810): n is a, c, t, g, unknown, or other
ggagctccccgcggtggcggccgctctagaactagtggatcccccgggctgcaggaattcgtctcacccctagaaaaaatcccttggagccagcaactccactcctgagtcctcacctcgtgctgcccgcgccatttccacctcccactgtcctttcgtccagtccccagccctgcagcccaaccgtggaggttctggaaggcggtgtatcccttctagaaccttctcgagatgcagagcgccgcggctttccggccgtgccccactcggctgctggtgagcagcccttgtcgccccctcctctcggcccgcccgcttcgtgtctccgccgctggcgccgtcgctaccagaagcagcgccgtgggccctcgcggtctggggctcgggctgctgccagcctcgcccgatcgggatggcaagtgccgccagcgacaggtgtcatgcagcgcggccggggatgctgtggcggccccgaaggcggaagaaggaggcgggctcatgaagacgctgtggctcggctcgctcttcggcctctggtacctgttcaacatctacttcaacatctataacaagcaggtactcaaggttttcccataccctataaacatcacagaagttcaatttgctgtcggaactgtagcagctctgttcatgtggatcactggtattataagaggccaaagatttctggagcacagcttgtagccatcctacctctggctattgttcatactatngggcatctcttcaccacatgagccttggggaagttgcagtgtcatttacgcacaccatcaggctatggagccntgcttttccggtattctttctgcaattttccctgggcgagtacctactatttgggtagatcatcccttcctcaaatggtggggggtgtgcattggcatcccttactgaagcaccctttaactgggctggcttttggatgcaaagg

SEQ ID NO: 74758 - DNA, 962 bp, Zea mays
  misc_feature: Ceres CLONE 1559193
  misc_feature: Encodes the peptide sequence at SEQ ID NO. 74759
ctggagctccccgcggtggcggccgctctagaactagtggatcccccgggctgcaggaattcgtctcacccctagaaaaaatacttgcgaacagatctctctcataagtgcaaccgagctcgccctcttccttcctcatacaagcgcgagacatgctctgatgcccacccacctgactgatactcccacgcctgatgtggatgaatcccctgcatcgtgccctgcgacaccccagtggcacctgtctgtggacgctttagccggccaacgacgaaaaggcgcgctgctcccaataatatcgccagccctacccatccccctgacgccaagatgggcacggaagcgatcgcttcgctcgttgacaacacggcgcccaccaacttagctattcccaagctcttgtatgacatcgcaccatgacattctcacgccctgctacgacatgcttatgatctggcatctcaatatactcgtcgaccgccgcgagctgacagaggagaacaactcgtacgatctgtcaggctgctccgagcctaaggccgccccgaagaagacaacaccggtcgtgtacaagcacttggctgctgctagacatgaaaggctaagtctcccgcgaagcctaaccccccatcaaagcgcgaggccgaccgggaatccctcttccaatcccgaaagcagcgggaaatcccaaggggcccattcaagcccgaagcccaaccttgcccgcaaagtcaaaccccaagattgccggcggttaagccaaatccaagcttccctaaaagaacagccccccccggcaaggggggtattaaatttcgagcccagggcccggcgggaaaaaatagggcgccggtgtcgcagaaaaaaccccgcgtccccccccataaaagcgccccggaaacaaagaagggcgcccccgagaaaaaaaaggggggtccacaaaagacctaaaaacccccccc

SEQ ID NO: 74759 - protein, 29 aa, Zea mays
  misc_feature: Ceres CLONE 1559193
MGTEAIASLVDNTAPTNLAIPKLLYDIAP

SEQ ID NO: 74760 - DNA, 905 bp, Zea mays
  misc_feature: Ceres CLONE 1559194
  misc_feature: Encodes the peptide sequence at SEQ ID NO. 74761
ctggagctccccgcggtggcggccgctctagaactagtggatcccccgggctgcaggaattcgtctcacccctagaaaaaatgagcaaagcatacacgtcgcgcagtcagctgaagacacgcccccagctctctcattctccttgatcgctcgctctccctggaccctacaagcagctggaagaggactgcgctctccgagagacagcagaagctgccagatgcaaagtaattgcttgccgctcccttgcgaccctattagattggacgtcgctagcacctagctgagccgtaatgcgtaccggcagctagagctgctagctcgatcgatatagctgcgtacaagagactgccgcagcatacgcagtagccagcttcagatagccgatccggtggtaaaaggcaactttttttggacatggcagccgagaggaccaccgtgactagtgagatatgctggctgcttggtacgcatctgcgacacctcccgccgaggttcctgttccgccccacgaaaaggaagcctacatggtgcaatacctccgggtcgcaaggtcttgggcgcgccactccccgccgaccagttatccgcgtcgtccgctacctctacagcctctgcaactgtgacgccgtcgacgtgcctgccgcccctgatgcaagccgcgaagcgagagatagcttctcccggtgcggacggcaggcgacctcctaaatcgctagaccgctaccactagcttgctgtgtacgcccgcagtaacgagtaaccagtgccctgccccgccgtgcgggggctgcaactcctgtgagcgtaaaaagacaatggtctcgtccccgcagaagagaaaaagcgggggggggcggcccggcatcagggggtatgcccagtacgcctcccggccgtgcaaa

SEQ ID NO: 74761 - protein, 97 aa, Zea mays
  misc_feature: Ceres CLONE 1559194
MAAERTTVTSEICWLLGTHLRHLPPRFLFRPTKRKPTWCNTSGSQGLGRATPRRPVIRVVRYLYSLCNCDAVDVPAAPDASREARDSFSRCGRQATS

SEQ ID NO: 74762 - DNA, 950 bp, Zea mays
  misc_feature: Ceres CLONE 1559195
  misc_feature: Encodes the peptide sequence at SEQ ID NO. 74763
  misc_feature (372)..(372): n is a, c, t, g, unknown, or other
ctggagctccccgcggtggcggccgctctagaactagtggatcccccgggctgcaggaattcgtctcacccctagaaaaagttcgacagatcccagagcaccctcggcggggccgccgccagctgtggcggtagccgtggcatccccaagggtttcggctccgtgaacatggacgagctgctccggagcatctggaccgcagaggagacccaggccaaggcctccgcctctatcgcaggagcgagcgcggggatgccccccacgccgatgcagcggcagggatcgtcgctcacactgccccgcatgctcagcaccaagacggtcgacgaggcgtggagaaatctcgtgcgcgacgaaccgccgcaggggcgngacggcggtggacaccagccgccccaccgccagtcaacgctcggggagatgactctggaggagttcttggtcagagctggcgcggtcaaggagaaccccgcttctgctcctccagcgccgccacccatggtgccgccgcggggccggtacctgttgcccctaaaagctccgccttttttggggatttaccgggtgccgacgacgacgcagctacggcagctggtagggtttgcaccggtcgggcatggtggatctggccctgataccgcccagggcggcaggcatgggaggcagcgccatggctgtgcaaacagcggtgagccagcttgattctgtcgggtaaggatacagcgacctgtcgtcgctgacggaccgcaaacttttcgttgaaaaatgattccggggagatgcatggagcgagtgaaaaaaaattgtgaaaaagggccccccccccgaagtattattaaaaaacaggagccccgccgcgaggtcccgagcgcgcaacaggttttatcaatggaatttaaagccgaaattcaaactcagaggcagatccggaacctgggaaggaaacgggc

SEQ ID NO: 74763 - protein, 177 aa, Zea mays
  misc_feature: Ceres CLONE 1559195
MDELLRSIWTAEETQAKASASIAGASAGMPPTPMQRQGSSLTLPRMLSTKTVDEAWRNLVRDEPPQGRDGGGHQPPHRQSTLGEMTLEEFLVRAGAVKENPASAPPAPPPMVPPRGRYLLPLKAPPFLGIYRVPTTTQLRQLVGFAPVGHGGSGPDTAQGGRHGRQRHGCANSGEPA

SEQ ID NO: 74764 - DNA, 896 bp, Zea mays
  misc_feature: Ceres CLONE 1559196
  misc_feature: Encodes the peptide sequence at SEQ ID NO. 74765
  misc_feature (703)..(703): n is a, c, t, g, unknown, or other
  misc_feature (807)..(807): n is a, c, t, g, unknown, or other
ctggagctccccgcggtggcggccgctctagaactagtggatcccccgggctgcaggaattcgtctcacccctagaaaaaagcaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggagaccttcgcgcgcaaccgggagctagaggtgatccactcccggtgggcgatgctgggggcgctgggctgcgtgttcccggagatcctggctaagaacggcgtcaagttcggcgaggcggtgtggttcaaggccggcgcgcagatcttctcggagggcgggctggactacctggggaaccccaacctggtgcacgcgcagagcatcctggccatctgggcgtgccaggtggtgctcatgggcttcgtcgaggggctaccgcgtcggcggcggcccgctcggggaatggctcgancagtgtaccccggcggcgccttcgacccgctggtcctctgcgacgacccgggacacgccgccgagctcaaagtgaaggtagctcagacggcccgctttgcatgntcccatgttccgctttctcgtgaaggcatcgtcaccggcaggggcccatcgagaactcttcgacacggtggcgaccccgtcgcaacaag

SEQ ID NO: 74765 - protein, 245 aa, Zea mays
  misc_feature: Ceres CLONE 1559196
  misc_feature (59)..(212): Pfam Name: Chloroa_b-bind Pfam Description: Chlorophyll A-B binding protein
  misc_feature (182)..(182): Xaa is any aa, unknown, or other
  misc_feature (216)..(216): Xaa is any aa, unknown, or other
MAASALHQTTSFLGQALVARAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGLPRRRRPARGMARXVYPGGAFDPLVLCDDPGHAAELKVKVAQTARFAXSHVPLSREGIVTGRGPSRTLRHGGDPVAT

SEQ ID NO: 74766 - DNA, 953 bp, Zea mays
  misc_feature: Ceres CLONE 1559197
  misc_feature: Encodes the peptide sequence at SEQ ID NO. 74767
  misc_feature (777)..(777): n is a, c, t, g, unknown, or other
  misc_feature (856)..(856): n is a, c, t, g, unknown, or other
ctggagctccccgcggtggcggccgctctagaactagtggatcccccgggctgcaggaattcgtctcacccctagaaaaacagcggattgttccaaagctgcaactccgacgagaaccggctctcctggaaatctcgaaggattttctgcggctaaccccttcttgacgtgacccattgggagatgcctctccgtctatcgccaaggacgtcaccgagttgatcgggaacacgaccgctggtgtacctcaacaaggtgaccgatgggtgcgtcggccgcttcgccccaaaactcgagtccatggagccctgctccactgtcaaggatatgattggctacagcatgatcacggacacttaggagaaagggctgattactccaagcgtgagtgttctgactgaaccaactagatgccactcaggcattggactgggctttatgggtgctgccaagggctactaacttactctcacaatgcctgcctccgtgagcatggagaggaggatcatattgaaggcttctggtgctaaacttgtccttactgacccactctcgggaatgaaatgagctgtcgagatcgcggaagataacgcgccaagactccctactcgtacattcttcaacaagttgaatatccagctaacccagagattcactatgagactactgggcctgaaatctggacagctcagcaggaaaaatcgatcgccttgtatctggtatcgagacatgacgtacaatcaccggtactgggcgatacctcaaagaacaaaatcntaatggcaagctctatggcgtggaggccggtaggagatgcctgctctggaatcgtggaaagctggaccacgcaagatcnatgggattggagctgcttttgatcccgagagccctgggatgttgacccccttgattaaactcttacaggtttcaatgatggaaccttcgagactgct

SEQ ID NO: 74767 - protein, 30 aa, Zea mays
  misc_feature: Ceres CLONE 1559197
  misc_feature: SWISSPROT Homolog: EC 2.5.1.47 Cysteine synthase
MPASVSMERRIILKASGAKLVLTDPLSGMK

SEQ ID NO: 74768 - DNA, 937 bp, Zea mays
  misc_feature: Ceres CLONE 1559198
  misc_feature: Encodes the peptide sequence at SEQ ID NO. 74769
  misc_feature (762)..(762): n is a, c, t, g, unknown, or other
  misc_feature (815)..(815): n is a, c, t, g, unknown, or other
  misc_feature (817)..(817): n is a, c, t, g, unknown, or other
  misc_feature (858)..(858): n is a, c, t, g, unknown, or other
agctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaacacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggcctgccaggtcgtgctcatgggcgccgtcgagggctaccgcatcgccggcggcccgcttcggcgaagtcgtcgacccgctctatcccggcgtcagcttcgacccgctcggcctcgccgacgaccccgagccntcgctgagctcaggtgaggagctcaagacggccgcctcgcatgttctcatgtncngattctcgtcaggcatcgtcaccgggaggccgctcgagacntgctgaccaaatgcgacccggcacaaaagcttggctacccaacacttctccccgaagtaggaggcccccggtactttag

SEQ ID NO: 74769 - protein, 211 aa, Zea mays
  misc_feature: Ceres CLONE 1559198
  misc_feature (65)..(210): Pfam Name: Chloroa_b-bind Pfam Description: Chlorophyll A-B binding protein
  misc_feature (207)..(207): Xaa is any aa, unknown, or other
MASSTMALSSTAFAGKAVNVPSSSAFGEARVTMRNTAGKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLRRSRRPALSRRQLRPARPRRRPRAXAELR

SEQ ID NO: 74770 - DNA, 920 bp, Zea mays
  misc_feature: Ceres CLONE 1559199
  misc_feature: Encodes the peptide sequence at SEQ ID NO. 74771
  misc_feature (665)..(665): n is a, c, t, g, unknown, or other
ctggagctccccgcggtggcggccgctctagaactagtggatcccccgggctgcaggaattcgtctcacccctagaaaaatccattccgtcgtcgtcgtcagcagcttctgcttgctttgtgggggaaggagagagagagagagcgagagagagatctagtagagaggctagtaggtggtcctcgaacgaagatgttggcggtgttcagcgggcaggtgatggaggtgccggcggagctggtggcggcgggcagccggacgccgtcgcccaagacgaaggcgtcgcagctcgtggggcgcttcctggccgcctccgagccggccgtgtccgtgcagctcggcgaccacggccacctcgcttactcccacaccaaccaggcgctcctccgccccaggtcgttcgcggccaaggacgaggtgttctgcctggttcgaaggggtgctggacaacctgggtcggctgagccagcagcacgggctgtcaagcaagggcgccaacgaggtgctcctcgtcatcgaggcctacaagacgctgcgcggtacgcgccgccctacccggccagctttatgctcagccagctcaccggctcctacgccttcgtcctcttcgacagtccacaactcccttgctcgtcgatcccgacccctagggcagggtgcgctcncttctgggggatccccgccgacggctgcgtcgccttctcgaagacatcgaatgctcaaagctcatgcggcagtcgctcgcgcgtttccgcaggctgctctactcaacgcctggggagggtcagggctacagaccccaagaaaagttaccgctgtccgccaacaaaaaaatctcgggccccttcagggtggggaaagtttacgtctgaggggctcacgatgatttccctggcgaggctgccggtgatatgcaattg

SEQ ID NO: 74771 - protein, 242 aa, Zea mays
  misc_feature: Ceres CLONE 1559199
  misc_feature (158)..(158): Xaa is any aa, unknown, or other
MLAVFSGQVMEVPAELVAAGSRTPSPKTKASQLVGRFLAASEPAVSVQLGDHGHLAYSHTNQALLRPRSFAAKDEVFCLVRRGAGQPGSAEPAARAVKQGRQRGAPRHRGLQDAARYAPPYPASFMLSQLTGSYAFVLFDSPQLPCSSIPTPRAGCAXFWGIPADGCVAFSKTSNAQSSCGSRSRVSAGCSTQRLGRVRATDPKKSYRCPPTKKSRAPSGWGKFTSEGLTMISLARLPVICN

SEQ ID NO: 74772 - DNA, 914 bp, Zea mays
  misc_feature: Ceres CLONE 1559200
  misc_feature: Encodes the peptide sequence at SEQ ID NO. 74773
  misc_feature (626)..(626): n is a, c, t, g, unknown, or other
  misc_feature (643)..(643): n is a, c, t, g, unknown, or other
ctggagctccccgcggtggcggccgctctagaactagtggatcccccgggctgcaggaattcgtctcacccctagaaaaaatcgccaccagtggccgcgtcctcttcatttccgccatccgtatcgtctccctagggtttggcactttggccgccgccatggcgtcggcgtcgcgtgcgctcctcctctcccgtgcgctccaggccggcgcgtctcgccgcgtccccgccctcctgcgcccggtcgctgcggccgcgagcctcctcccagcggtggcggggccggcaggggccgccctcggcgctagggtgcggtgcttcgcgacccagccggcgacgtcctcgctgcgggactcgtccccaaactggagcaatcgcccgcccaaggagacgatcctcctcgacggctgcgacttcgagcactggctcgtcatcatggagccgccgcctggtgacgcctccaaccccgacatcacacgcgacgagatcatcgatagctatatcaagactctcgccccagtcgtcgggagtgaggaagaagctaggcaaaagatatactctgtatcgactcgtcattactttggctttggtgctcctgtatctgaggaacttttctacaaactgaangaaaatccccaggtccngctgggttcctcctgattcaaacttggatgtcaaaaaacaggactaggggagccaacccctcataaatgggccaactggtccctatgatcccaaattcccgaaaaaagggggaaaaaaaatggcccggccaataacaaaacgggccaagaaaggcccccaaatttaacaggcaaggactttgaccgaaaagggaaaattcaaatccccaaaaaaaatgggcccccccccaagtttaatggcccccccccccctcgggaaaaaaaatgcccc

SEQ ID NO: 74773 - protein, 166 aa, Zea mays
  misc_feature: Ceres CLONE 1559200
  misc_feature (156)..(156): Xaa is any aa, unknown, or other
  misc_feature (162)..(162): Xaa is any aa, unknown, or other
MASASRALLLSRALQAGASRRVPALLRPVAAAASLLPAVAGPAGAALGARVRCFATQPATSSLRDSSPNWSNRPPKETILLDGCDFEHWLVIMEPPPGDASNPDITRDEIIDSYIKTLAPVVGSEEEARQKIYSVSTRHYFGFGAPVSEELFYKLXENPQVXLGSS

SEQ ID NO: 74774 - DNA, 905 bp, Zea mays
  misc_feature: Ceres CLONE 1559202
  misc_feature: Translation starting site: 227
  misc_feature (677)..(677): n is a, c, t, g, unknown, or other
ctggagctccccgcggtggcggccgctctagaactagtggatcccccgggctgcaggaattcgtctcacccctagaaaaaaccctcggatacatctaagagaggatccgagcaactgagctagctggtcatgtatctaaggccactcctgtcttgccttgcgtcgcttgctcatctagtcgcgggggtaatcgatctgatgggggcctgacgtacgtacattacatatgggcgtggggaagctgatgaacgacctaaagaggtacctggcgatggtgctgctgcacttggacttctcccgcatatatatactatacctcgactgcctcagactccgtgtgagacacttcctactagatgtctaacatatcttccttgcctcaggtgtataagctctcttagaccgcctcttcgacaggagagtgatgccctatatgacgccgctaatatctctcaagatcatgaggacttgccggtcttgacccggtgctagaccataacatgtactaacctcgcccgaaccttacctcagggaccttagcctcgcagctcgtccagatcgtggctggcatcaaattactcatgacactggtcctcaggattgatagactgagactagcgagcctccgcagcatgatcatgtcgacgagacagtatgcaacgtcgtggggaagcgcntgatgatgctgtaccagatgcacatggtgctgattccgtagcccgagggcgccgacgatgcgtaatcccgacgccaccagccctgcagatgaaagcccaggtccacatgctggctaaacggaatcgtagtgtagatcaggatgcggctgctagccgtccggcctctttgtgctcaatggaaccggcatggtaaccaccccttgcagctgaccctggtacgctgacatt

SEQ ID NO: 74775 - DNA, 865 bp, Zea mays
  misc_feature: Ceres CLONE 1559203
  misc_feature: Encodes the peptide sequence at SEQ ID NO. 74776
  misc_feature (713)..(713): n is a, c, t, g, unknown, or other
ctggagctccccgcggtggcggccgctctagaactagtggatcccccgggctgcaggaattcgtctcacccctagaaaaaaagaagatcggttccagcggcaggcgcgagcgaggcgtgaccgatggcggccgcgtctctgctgagccgggcgcggtggctcctggtggagcacccggccgtggcctcgttccgctggcagccaggccgcacggtcggcgcgacgccgtccttcgcggccgccgtcatctgcggctacctcgccgcggtgctcgtcctccgccgcctcgtcctgccccgcctcccggcgctgcctccgccggcgctccgcgcgctctccgccgcccacaacgcggtcctgctggcgctctccgccgccatggccggcgggtgcgcgctgtcgacggccgcgacggcgccggcgccgcggtgggcgtggtgccttctgcttcccgccgcgggcgccacggaggcgtcggggcccgtcttcttctgggcgcacgtgttctacctctcctaggtgtacgagctcggcgacacgctgctcatcctgctcgcccgccgcccgctcacgctgctccacgtgtaccaccacgcgctcgtcgtcgccatgtgctacctctggctcgccacccgccagtcgctgatgcccgtcgcgctcgtcaccaacgccggcgtgcacgtcgtgatgtactcctactacctctcctggancggtcgcctgcgctggccctgggcggtgtatcccgccgtcccggagctgcaaattgggcagttccccttaagcttccgggcctccggggggatgcttgtggtccccttcacccttggcggttccaaggggatggcccgctgtggggtcaaac

SEQ ID NO: 74776 - protein, 131 aa, Zea mays
  misc_feature: Ceres CLONE 1559203
MAAASLLSRARWLLVEHPAVASFRWQPGRTVGATPSFAAAVICGYLAAVLVLRRLVLPRLPALPPPALRALSAAHNAVLLALSAAMAGGCALSTAATAPAPRWAWCLLLPAAGATEASGPVFFWAHVFYLS

SEQ ID NO: 74777 - DNA, 947 bp, Zea mays
  misc_feature: Ceres CLONE 1559205
  misc_feature: Translation starting site: 186
  misc_feature: SWISSPROT Homolog: EC 2.7.1.20 Adenosine kinase
ctggagctccccgcggtggcggccgctctagaactagtggatcccccgggctgcaggaattcgtctcacccctagaaaaaatctcgcccacacgaactcgagacctcgcccgcccaaatacaaaagcctcagatctcagtgaccagcgccgccgcttcgttcgtgtcgaatagagaagagaggaaatggcggcgagcgagggcgtgctcctggggatgggcaaccccctcctcgacatctccgccgttgtcgatgacgccttcctggcaaagtatgacatcaagctgaacaatgccattctcgctgaggagaagcactcgcctatgtatgatgagttggctagcaacagcaatgttgaatatattgctggaggagccacccagaactctatcagggttgcccaatggatgcttcaaactcctggtgcaacaagttacatgggatgcattgggaaggacaagtttggtgaggagatgaagaaaaatgctcaagctgcaggagttactgctcattactatgaggatgagactgctcctactggcacatgtgctgtatgtgttgttggtggcgaaaggtcattgattgcaaatctgtcggcggcaaactgttacaaatctgagcatctcaagagaccagagaactggggcactagttgagaaggcaaaatacatctacattgctggatttttcctcacggtgtcacctgattctatccagttagttgctgagcatgctgcggcaaataactaggtgttcctgatgaacctctctgctcccttcatctgtgagttttctatgatgcccagagtaggtcctcccgtatgctgacttcatcttcgcaatgaaccgaggcaaaaatctcgcaaaagtccagagggagactgaaaatgccgaggaaattgcttgaaaatcctcagcttcctttgctcaggcaagcaaagaagatg

SEQ ID NO: 74778 - DNA, 955 bp, Zea mays
  misc_feature: Ceres CLONE 1559206
  misc_feature: Encodes the peptide sequence at SEQ ID NO. 74779
  misc_feature (677)..(677): n is a, c, t, g, unknown, or other
tggagctccccgcggtggcggccgctctagaactagtggatcccccgggctgcaggaattcgtctcacccctagaaaaaagcagctaaagaagcaaagcaagtgtctgctcactcagtcctgcgcaagagctcgctctcggagaaaaaaacgcgggaggcgataatggagggaggtgccggtgcgagcgagaaagggacggtgctggtcacgggggcgtcgggcttcgtcggctcctggctcgtcatgaagctcctccaggccggctacaccgtccgggcgaccgtgcgcgatcccgcgaacgttgggaagacgaagccattgatggaccttcccggagcaacggagcgcctgtccatatggaaagccgacctggcggaggaaggcagcttccacgacgccatcaggggctgcaccggcgtcttccacgtcgccacgcccatggacttcctgtccaaagaccctgaggtagatcagtcttggctgcacaattaattagtctctcgatctctacgtcttcacactgcacatgcactgcacacgtatactacatacgtatgggtttccattgcaaaatgagggaatcaaggccgacgggtgaaagggatgataagcatcatgcgggcatgcaaggaagcccgggcaccgtggcggggcattgtttttcactttcctccngccggggacggtcaaccctgaaagaccggcaaaaggcccttcctccaccagggatgcttgggaccgaatttaaatttttgcccttccggttaaaatgaacgggggggatggcctctcgggcctaaaaccctggggaaaaaaggggccctgggtttaccgggggaaaccagggctggaactgggaccaattttcccaaccctctgggggtccccctttttataggggggttttgcccccaactttattaggggtggggcctttttgggggaaacccccc

SEQ ID NO: 74779 - protein, 109 aa, Zea mays
  misc_feature: Ceres CLONE 1559206
  misc_feature: SWISSPROT Homolog: EC 1.1.1.219 Dihydrokaempferol 4-reductase
MEGGAGASEKGTVLVTGASGFVGSWLVMKLLQAGYTVRATVRDPANVGKTKPLMDLPGATERLSIWKADLAEEGSFHDAIRGCTGVFHVATPMDFLSKDPEVDQSWLHN

SEQ ID NO: 74780 - DNA, 945 bp, Zea mays
  misc_feature: Ceres CLONE 1559207
  misc_feature: Encodes the peptide sequence at SEQ ID NO. 74781
  misc_feature (793)..(793): n is a, c, t, g, unknown, or other
  misc_feature (828)..(828): n is a, c, t, g, unknown, or other
  misc_feature (829)..(829): n is a, c, t, g, unknown, or other
  misc_feature (840)..(840): n is a, c, t, g, unknown, or other
  misc_feature (921)..(921): n is a, c, t, g, unknown, or other
aagctggagctccccgcggtggcggccgctctagaactagtggatcccccgggctgcaggaattcgtctcacccctagaaaaactcgttgtcttggcggctgcggcggagcacggaggcgaaggaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggaccgacaagacctaccctgctgggttcatggatgtcatttccatccctaagacaatggagaactacaggctgctttatgacaccaagggccgcttccgtcttcacccaatcagggatgaggatgccaagttcaagctctgcaaggtgaggtccgttcagtttggccagaagggcatcccctacctgaacacctacgacggccgcaccatccgctaccccgacccgctcatcaaggccaatgacaccatcaagatcgatctggagacaacaagatcatgaacttcatcaagtttgacgtcggcaacgtggtcatggtgaccggcgggaggaacaccgggcgtgtcggaatgatcaagaacagggagaaagcacagggcnggctcgatacatccacgtcgaggactcatggccanncagtcgcaccngcatggggcaacgtgtcaccatcgcaaggcaaacagccgtgggtgagctgcccaaagcaagggtatcagctcgcatcatcnagagcaaagaagcccaccttgctc

SEQ ID NO: 74781 - protein, 169 aa, Zea mays
  misc_feature: Ceres CLONE 1559207
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
MARGLKKHLKRLNAPKHWMLDKLGGAFAPKPSSGPHKSRECLPLILIIRNRLKYALNYREVISILMQRHVLVDGKVRTDKTYPAGFMDVISIPKTMENYRLLYDTKGRFRLHPIRDEDAKFKLCKVRSVQFGQKGIPYLNTYDGRTIRYPDPLIKANDTIKIDLETTRS

SEQ ID NO: 74782 - DNA, 928 bp, Zea mays
  misc_feature: Ceres CLONE 1559209
  misc_feature: Encodes the peptide sequence at SEQ ID NO. 74783
  misc_feature (712)..(712): n is a, c, t, g, unknown, or other
  misc_feature (729)..(729): n is a, c, t, g, unknown, or other
  misc_feature (809)..(809): n is a, c, t, g, unknown, or other
  misc_feature (810)..(810): n is a, c, t, g, unknown, or other
  misc_feature (839)..(839): n is a, c, t, g, unknown, or other
ggagctccccgcggtggcggccgctctagaactagtggatcccccgggctgcaggaattcgtctcacccctagaaaaatctccgtgtgttgtgtctgcgctaggcagacgggcgcgacgcaaaaagctttgttctcagcggaagggcctcaggcctcacggggccgaggccgcgaggcgaggctataaaacgctgccccacccaagccaaccgcctcgtcgttccatccagctctcccagcgcgctgctcgactcgactcgacttcctctgcaacgcgtgtccggtgtaggctgagagagtgagtgagaggcgagatgaggagcgggcggctggcggtggcagtggcggtggctctggcgtgggcgttcgcggcgtcagcggcggcggcagcgcagaagtacaatgccatcttcaacttcggcgactccatcaccgacaccgggaacctctgcaccatacgggaggccgtcgcagatcaccttcacgcagccgccctacagcgagacctacttcggcacgccgacgtgccgctgctgcgacggccgcgtcatcccggacttcctctgctccaggttcggcctgccgttcctgccgccgtccaagtccacgacggccgacttcaagaagggcgccaacatggccatcaccggcgccacggccatggacgcgcccttcttccgctcgctcggcctctccgacagatctggaacnactggtccatcagcttncagctgcagtggtccagcaggtcacctaccgccatgtgctggcagagtgaactgcagagctacctgacaactcgctgtcnntgttcggcgagtcgggatgcacgactacnacgccctgctgttcgcagctacacgcggaccaggcagacgttaaccgccgccatctgagcccctccgggccgtcttgtaaaactgtgcc

SEQ ID NO: 74783 - protein, 130 aa, Zea mays
  misc_feature: Ceres CLONE 1559209
  misc_feature: SWISSPROT Homolog: EC 3.2.1.51 Alpha-L-fucosidase
  misc_feature (109)..(109): Xaa is any aa, unknown, or other
MPSSTSATPSPTPGTSAPYGRPSQITFTQPPYSETYFGTPTCRCCDGRVIPDFLCSRFGLPFLPPSKSTTADFKKGANMAITGATAMDAPFFRSLGLSDRSGTTGPSAXSCSGPAGHLPPCAGRVNCRAT

SEQ ID NO: 74784 - DNA, 924 bp, Zea mays
  misc_feature: Ceres CLONE 1559210
  misc_feature: Encodes the peptide sequence at SEQ ID NO. 74785
  misc_feature (843)..(843): n is a, c, t, g, unknown, or other
ggagctccccgcggtggcggccgctctagaactagtggatcccccgggctgcaggaattcgtctcacccctagaaaaagatttgtgccctcttcttttgcaggcaacttttgtgcagccgcccccgctttcccccccgcgaaaacccagcagccgccgccgctgccgccgccgccgccgccacatccagtcctgccccggggccctgaaccctagccatggcgtcctccatactctccgactgctcctcggcccgcctcctccctctccgccgctcgctcctcccgccgcgggcgccccgcctccgctcctgccccgctctagctacccccaggcgcctactcgtcgccgccaggccccagctgcttccgcgcccgcgccacatggactcggtccccgcagccaccgcctcttccgccgactcagcaaccgtctcagccgatgcgcctgccaaactgattgacgggaagctcgtggcgaagcaagtgagagaagaaatagctgtccaagtcaccaggatgaaggatgtgatcggcattgtgcccggcctggctgtcatccttgttgggtcgaggaaggattctcagacttacgtgcggaaacagaagaaggcgtgcgaagcggtcggtattaagtcgaacgaaggcaacttggcctgaggaacagctccgaaggaaggaggttttcaagccactatgggaggtttccaacgggaaccccccccggggcagggataccttggggttaattggcccctctcccagggggtttttgaaagaggaaaaaaaacttctttaataacgggcgggcgttttttaaaaaaaaaaaagtgtttttgggagtnttttttcccccccccgaaaaaaaaaaaaaaaaaagaagtggtgttttttaatttggggaggaggaaaaaaggaacgtcctt

SEQ ID NO: 74785 - protein, 146 aa, Zea mays
  misc_feature: Ceres CLONE 1559210
  misc_feature (79)..(146): Pfam Name: THF_DHG_CYH Pfam Description: Tetrahydrofolate dehydrogenase/cyclohydrolase, catalytic domain
MASSILSDCSSARLLPLRRSLLPPRAPRLRSCPALATPRRLLVAARPQLLPRPRHMDSVPAATASSADSATVSADAPAKLIDGKLVAKQVREEIAVQVTRMKDVIGIVPGLAVILVGSRKDSQTYVRKQKKACEAVGIKSNEGNLA

SEQ ID NO: 74786 - DNA, 989 bp, Zea mays
  misc_feature: Ceres CLONE 1559211
  misc_feature: Encodes the peptide sequence at SEQ ID NO. 74787
  misc_feature (500)..(500): n is a, c, t, g, unknown, or other
ctggagctccccgcggtggcggccgctctagaactagtggatcccccgggctgcaggaattcgtctcacccctagaaaaaaagacgaagaaaccctcctccaccaccaacccgatccagctacatccgttgaggcccgtgcgtttcttccctgttctcccatcaatcgacctagccttacgccgaccaggggcttcctctaatcgatctggtgtctgttctgtggtattggtctgggtgcactccagggccaggagcagctagccgtcttcgttcgatccgttcgcaccccccaacgcggttcgatttgcaggaaggagcgtgatggccaagacgagctcgttcaagctggagcaccccctcgagaagaggcaatctgaggctaaccgtatcagagagaagtaccctgacagaattccagtgattgttgagaaggctgaagagagtgatattcctgacatcgacaagaaaaagtacctcgtccctgcagatcttacagtncggcaattccctgtatgttgttaggaaagagatcaagctcagtgctgagaaagctatcttcatatttggtgaaaaacacccttcaccaaaagctggctctgatggcttcaaatcttgaagaagacaaagcccaggaagggggtcctccaactggacttaaggggggggaaaacccttccgaaatgcttctaaagggcccccaatggggtgtcccttgcctttggccatgcccccggtaaaataaacccgccaaccaccgggtttattttcgggttcccccccccaagggggtggccccttcgtaaaaaccccaccatcatttgggggggttcccccctttttggccccccttacaattttttattgttgggccccccaccgggggaaaaaagggaaaccccccttgtttttggggtggggcctttctccccaagaaagggggggggggtgcgttaaaaaaaaaaaaaacaacgcccggggccctcttcc

SEQ ID NO: 74787 - protein, 66 aa, Zea mays
  misc_feature: Ceres CLONE 1559211
  misc_feature (15)..(67): Pfam Name: MAP1_LC3 Pfam Description: Microtubule associated protein 1A/1B, light chain 3
MAKTSSFKLEHPLEKRQSEANRIREKYPDRIPVIVEKAEESDIPDIDKKKYLVPADLTVRQFPVCC

SEQ ID NO: 74788 - DNA, 959 bp, Zea mays
  misc_feature: Ceres CLONE 1559212
  misc_feature: Translation starting site: 284
  misc_feature: SWISSPROT Homolog: EC 1.10.99.1 Plastoquinol--plastocyanin reductase
  misc_feature (754)..(754): n is a, c, t, g, unknown, or other
  misc_feature (782)..(782): n is a, c, t, g, unknown, or other
  misc_feature (845)..(845): n is a, c, t, g, unknown, or other
ctggagctccccgcggtggcggccgctctagaactagtggatcccccgggctgcaggaattcgtctcacccctagaaaaagtgtgccacagcccacagccttgaacatgtggtgctcgcaggccggtcgctgcgcctcaaccaatcaccggcagcctcccacgacccggcgcaaagataaagttaggctcggcaccgggggctcatccgcaagcctgtggacgcgagtgagtgaacaccagccgtattgtcccgaccccgaccgatcctcgcctgctgcagccatggcgacctccgcggcgctctctaccgccgccaatcccacccagctctgccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacgggtggaggcgtggctcaacacgcacggtcccaacgaccgcacgctcgcgcaggggctcaagggtgaccccacggtacctggtggtggagcaggacaagacgctggccacctacgggaatcacgccgtgtgcactcacntccggctgcgtcgtgccgtggaaacgcnccgagaacagttcatctgcccatgccacggatcccagtacacaaccaagggacaggttgtccngtggaccgcggctcctgtcgctgggcctgggtcacgccgactcgacaaaaggaaggtcccttttctgtccgggggtggaaaccgacttcggaccggggaagaacccggggggaa

SEQ ID NO: 74789 - DNA, 946 bp, Zea mays
  misc_feature: Ceres CLONE 1559213
  misc_feature: Encodes the peptide sequence at SEQ ID NO. 74790
  misc_feature (457)..(457): n is a, c, t, g, unknown, or other
  misc_feature (485)..(485): n is a, c, t, g, unknown, or other
  misc_feature (515)..(515): n is a, c, t, g, unknown, or other
ctggagctccccgcggtggcggccgctctagaactagtggatcccccgggctgcaggaattcgtctcacccctagaaaaagactcgccgccgccccaggctagctcgatgattgggtgcgccaagccgctcgcggcgccgctgcaggcatgggctcgcccgccgtctcccgccggtcgccgcctccccccctcgttctgcgcccctgacacctccccagctctcacccgcgccgtcgagagcccaggccagtctcagtctgacgacgccccgccaccacagctcgggtgaggccgcctcgtccctggcgccgcgcgcgagctcgcatctcgaccgatggtcccggtcgcgtgcgctgcggtcgggccaccggccggcgctgaatcgcgcggctctctcctcgagctcagtctcggcgccgcgggtgaatcagtcgccgcggccagaggaccctgccntggcggtaggagaatggcgagaaccacnacctgtgccaaggctataaggatcgccacngccgggtatgccatctacctattgcccaacgggaccgggtggaccccggagcaatccgggaaagccggccctcgaaagttaaaaactgcctacccaacccggggtgacttgtgaaaccaaccccttttccctaattgccaaattggatccacttttttgggggataaacccagccccaagggagggggccgggttttcttcccccttgcaaagctttaaggggcagggcaaaaaaaaaggccgtatattcgggggggtccccaacaaaaattttttcgcccttggggaaaaacttttccccaaaggggggttgcccctctgaaaaacccaaaccccccgagaaaagggccgcataaaaaaaatccacactctttttttttttttttacaaaaaaaaaaaggggggcccccaaaatctcccgaaaaaaatta

SEQ ID NO: 74790 - protein, 97 aa, Zea mays
  misc_feature: Ceres CLONE 1559213
  misc_feature (41)..(41): Xaa is any aa, unknown, or other
MVPVACAAVGPPAGAESRGSLLELSLGAAGESVAAARGPCXGGRRMARTTTCAKAIRIATAGYAIYLLPNGTGWTPEQSGKAGPRKLKTAYPTRGDL

SEQ ID NO: 74791 - DNA, 908 bp, Zea mays
  misc_feature: Ceres CLONE 1559214
  misc_feature: Encodes the peptide sequence at SEQ ID NO. 74792
  misc_feature (696)..(696): n is a, c, t, g, unknown, or other
aagctggagctccccgcggtggcggccgctctagaactagtggatcccccgggctgcaggaattcgtctcacccctagaaaaaaagaaatttccatcgccgcgcccggcgtctcctccactcgcctcccctacgctatagcattccattcctgagctcgctaactgcgcttcttcggttcgccggaaagccacgggttgggttcggcgggaggccgggaaacgggaatttatttcaccagtatgcaacagatggccatgccatcgttcgccgtaacctcacctccgtcacatggcactaccttatgggcgcctcatgctcgtcgtcctcaaagactgcacaggagacacgtgcgcagccaagtccgggcagtggcacaagcacagctgcagtaccagaagctgggggactcagacctcctcatcagtgaggtcactcttggaacgatgacttttggcgagcaaaacacggagaaggaagcacatgacattatcgcttattctttcgatcaaggtgtcaatatcctagacacagcggaaatttacccagttccaatgaacaaggaaactcaagggagaactgatctttatattggcaggtggatgcaatcaaaaccacgagacaagataattttggccacccaaagtgccgggtattcagagcggtctacatttcttcgagacatgcaaaaagtggntcgtgtcgatgctgccaatatcaaagaaagtattgaaaagagtcttaaacgcttgtctacagattacattttgattgctcagatacactgggcagatagtatgtggcaactatttggggagttttagtatatccgaccaatggagggcagcatccctttgaaagaacaatgagggctttacggagttattggacaaagaaagttcccctttt

SEQ ID NO: 74792 - protein, 190 aa, Zea mays
  misc_feature: Ceres CLONE 1559214
  misc_feature: SWISSPROT Homolog: EC 1.1.1.91 Aryl-alcohol dehydrogenase (NADP(+))
  misc_feature (149)..(149): Xaa is any aa, unknown, or other
MAMPSFAVTSPPSHGTTLWAPHARRPQRLHRRHVRSQVRAVAQAQLQYQKLGDSDLLISEVTLGTMTFGEQNTEKEAHDIIAYSFDQGVNILDTAEIYPVPMNKETQGRTDLYIGRWMQSKPRDKIILATQSAGYSERSTFLRDMQKVXRVDAANIKESIEKSLKRLSTDYILIAQIHWADSMWQLFGEF

SEQ ID NO: 74793 - DNA, 931 bp, Zea mays
  misc_feature: Ceres CLONE 1559215
  misc_feature: Encodes the peptide sequence at SEQ ID NO. 74794
  misc_feature (740)..(740): n is a, c, t, g, unknown, or other
  misc_feature (770)..(770): n is a, c, t, g, unknown, or other
  misc_feature (861)..(861): n is a, c, t, g, unknown, or other
ctggagctccccgcggtggcggccgctctagaactagtggatcccccgggctgcaggaattcgtctcacccctagaaaaaactcccaccttcttggagacaccgccaggcgccatcttccggccgctgcccgcctgccccccccgggaggtcgaactgccttctagagccctctcctgttttcaggcgaatgtgcaggtagcttgacgtctgatgaacgctcagccatgctgctgatgctacacgaaactcttcctttcgtgaggccgacgagttcttgccgggacccaaaactctccgagaagagtgcctctgctctccacggtaaattgggatgcagtgcggtctgcagttcagcggaaggccatcgtgtacagaagccacacattgttcacagctacaaagttagcttcactaggaccagccatcatctgtgtaaaagcttaaacgagagaactacaaggcactgcctgcatcggttccatgttaatgcttcgcccgatgacgacgacttccgctcgtcgcgtaacatagcgatcagtttgttcaagcggtacaagaatgtcattgaccgaggaggtggagaaaacctaaatgagtttgtcagtgctggagtgaccgcttacgcactagggtgtacagatgaggggcttagaaaggaactatggatattgaagattctggtctgggagatgaaggcttagggtccttggggggcaccagcctcaagtcaaagtcacntccttgaaatcggtgagtgctcctgtggcntcagtatagtgttcgtcacaatactgtgcacaccacactaacaggtatcaggtggtctccgaacccacggtgtcagcgacgtcttgctcantgggaaaggattctgtgctctatcccgaacgctactattcaaaagaattgcatggttgccgtgaaaccct

SEQ ID NO: 74794 - protein, 158 aa, Zea mays
  misc_feature: Ceres CLONE 1559215
MLLMLHETLPFVRPTSSCRDPKLSEKSASALHGKLGCSAVCSSAEGHRVQKPHIVHSYKVSFTRTSHHLCKSLNERTTRHCLHRFHVNASPDDDDFRSSRNIAISLFKRYKNVIDRGGGENLNEFVSAGVTAYALGCTDEGLRKELWILKILVWEMKA

SEQ ID NO: 74795 - DNA, 914 bp, Zea mays
  misc_feature: Ceres CLONE 1559216
  misc_feature: Encodes the peptide sequence at SEQ ID NO. 74796
  misc_feature (565)..(565): n is a, c, t, g, unknown, or other
ctggagctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaagccgtctggttcaaggccggctcccagatcttcagcgagggcgggctggactacctcggcnaccccagcctgatccacgcgcagagcatcctcgccatctgggcctgccaggtcgtgctcatgggtgccgccgagggctacccatttgccggcggccgcttcgggaagggctcgacccgctgtaccctggcggcagcttcgaccccttggcctggccgaagaccccaaagcctttcccaagtccaggggaaagaccccaaaccgcccccccgcctggtttccagttcggttttttggccaggcctttttaccgggaaggcccccctaaaaacccccgaaaccctctgggacccgtaaaaaaaaggtgggggcatccccacaatttttccccggaaaaaaatcaagggttt

SEQ ID NO: 74796 - protein, 242 aa, Zea mays
  misc_feature: Ceres CLONE 1559216
  misc_feature (61)..(190): Pfam Name: Chloroa_b-bind Pfam Description: Chlorophyll A-B binding protein
  misc_feature (145)..(145): Xaa is any aa, unknown, or other
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGXPSLIHAQSILAIWACQVVLMGAAEGYPFAGGRFGKGSTRCTLAAASTPWPGRRPQSLSQVQGKDPKPPPRLVSSSVFWPGLFTGKAPLKTPETLWDP

SEQ ID NO: 74797 - DNA, 929 bp, Zea mays
  misc_feature: Ceres CLONE 1559217
  misc_feature: Translation starting site: 146
ctggagctccccgcggtggcggccgctctagaactagtggatcccccgggctgcaggaattcgtctcacccctagaaaaaaagaaccaacgtgctcgatctccatctcgaccgtcgctcaccgggaagctacgctacgacgaagcatggcgtccgtcaccgcccgcgccccggtcgcggccctgcgcccgtcggcgtctctcaagtcgtcgtcgtcgtcggcggcggccttccttggccactctagccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtgccgggatgctgatcccggaagtgctgaccaaggccgggctgatcaacgcgccgcagtggtacgacgcccgcaagtcggagttattggccgtcgtcgtcaacccggtccgggaacaaattcatcccgtttccctacgggggaaatccgggggggggaggaatttaaaaaccccgggggggtcaaccaggaaccccttttaaaaaactaaacctggcccccccaaagagggggttccccgggagggttttttaccccttaattttcgcccccccttaggggaaaagaaaaggccccccaaggggggggcggcccgggggggtctccgggccttttaaaaacaaaaaaccccccggggagggggccccttaaaaactgtggggcccccgtttccccggggaaacaacacttttcaacccccgggtggtggtttcccccccccaacggtgtggtggcacaaaaaaaa

SEQ ID NO: 74798 - DNA, 946 bp, Zea mays
  misc_feature: Ceres CLONE 1559219
  misc_feature: Translation starting site: 174
  misc_feature (652)..(652): n is a, c, t, g, unknown, or other
  misc_feature (786)..(786): n is a, c, t, g, unknown, or other
  misc_feature (789)..(789): n is a, c, t, g, unknown, or other
  misc_feature (890)..(890): n is a, c, t, g, unknown, or other
ctggagctcaccgcggtggcggccgctctagaactagtggatcccccgggctgcaggaattcgtctcacccctagaaaaaaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcacgtggctgggcgggcagctgttctcggcccatggtggtgcgcaagccggcgcacctgttcctggacgagctgtggcgtggcgtacgacgagccngatgactacgtggtcatcaagcacgccgcgctcttcacgtccacagtcatgagcctgctcctggcgcgccccaacgtcaagctgttcaatcgcgtggccgtggatgaactcatcgtcagggggaggcgcgtccngcngcgtcgtcacaaactggggcgctcgtgtccatgaaccacgacacgcagtgctgcatggaccccacgtcatggaagggccaaggtcgtggtcagctcctgcngccacgacgggcccttcggcgccaccggcgtcaagagctccaggaatgcggctgaa

SEQ ID NO: 74799 - DNA, 924 bp, Zea mays
  misc_feature: Ceres CLONE 1559220
  misc_feature: Encodes the peptide sequence at SEQ ID NO. 74800
  misc_feature (226)..(226): n is a, c, t, g, unknown, or other
  misc_feature (749)..(749): n is a, c, t, g, unknown, or other
  misc_feature (799)..(799): n is a, c, t, g, unknown, or other
gctggagctccccgcggtggcggccgctctagaactagtggatcccccgggctgcaggaattcgtctcacccctagaaaaatacttaggccgtcacaaggagaccctcctcagccgctagtaccagtagtcgtcgcgtttgcagctaggcagatctgagttagccggcggatccgatccgtgcgcgtgcgcagtgtgtgtgtgtgtgtgtgtgtgtgtgtgtgtcnggtggagagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaaccttccggcctaccgcaccgccgtgagcccgctgctgcggggcgtcgaggtcggcctcgcgcacggctacctcctcgtggggcccttcgcgctcacgggcccgctccgcagcacgcccgtgcacggccaggccggcgcgctcggcgccgccggcctcgtcgccatcctcagcgtctgcctcacaatgtacagcgtcgcctcctttcacgagggggacccgtccacggggccctcgctcacgctcaccggcaggaagaagggaggcgacnagctgcagacctccgacggctgggccagttcacccgggggattcttctcngcggcatctccggcgtgctctggggctacttttctctctacgtgctcgaactccctacttcttcaagtagaaatcatcaagatgcgtatattatagctccgggcgatcctcctctctgcgtatgg

SEQ ID NO: 74800 - protein, 212 aa, Zea mays
  misc_feature: Ceres CLONE 1559220
  misc_feature (44)..(204): Pfam Name: PsaL Pfam Description: Photosystem I reaction centre subunit XI
  misc_feature (165)..(165): Xaa is any aa, unknown, or other
MASQVMKSSLVVHSRPRGLSGAAALTRRPGRFTVKAIQPEKATYQVVQPINGDPFIGSLETPVTSSPLVAWYLSNLPAYRTAVSPLLRGVEVGLAHGYLLVGPFALTGPLRSTPVHGQAGALGAAGLVAILSVCLTMYSVASFHEGDPSTGPSLTLTGRKKGGDXLQTSDGWASSPGGFFSAASPACSGATFLSTCSNSLLLQVEIIKMRIL

SEQ ID NO: 74801 - DNA, 941 bp, Zea mays
  misc_feature: Ceres CLONE 1559222
  misc_feature: Translation starting site: 145
ctccccgcggtggcggccgctctagaactagtggatcccccgggctgcaggaattcgtctcacccctagaaaaaaccatctttttcttcctcgcgccgccgccgccgtgacggaaggaagaggaggagcaaggagcacgacgcgatgggtcactccaacgtttggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccgttgaagaggccactgtgctgctgtggagaacttcctacatcaaagaaatgggtccttcattagaaggcctaatttatgcgctttagctttttgttcagaacttgagactcatgtgttctagccgccttcccgtccttttcctttcataaaccccaagccgcgccgcaatagctcgccccctcgttcgccgcctctcctgctcctaccgcagctctccctcaggtttagtgttcgcaatggcggcctttcacaagcttggtggccttctaaggcacagtgctctggtgagcggtatcactggtggctcttctcccgcagtgttcaatgctgcacggctcatgtctaccaagctatttatggtgggtcttgactggggtggtgatgacctgaaactaaaaaaagcatttaccagctttggagagttactgaagcgaaggggatccccgacgggagacctgggaggccaaaggcttgggctttttggacacccccaacgggatgctgccaaggaacattttctgcaaggatggaaggaaattgagggcggcgggactgtgcaaagggctaatgaaaacccgcgggaaaccggggggggcgcccttgtggggcggctatgaggagggggccccg

SEQ ID NO: 74802 - DNA, 994 bp, Zea mays
  misc_feature: Ceres CLONE 1559223
  misc_feature: Encodes the peptide sequence at SEQ ID NO. 74803
ggagctccccgcggtggcggccgctctagaactagtggatcccccgggctgcaggaattcgtctcacccctagaaaaagtactgtacattgttcctgcgaagacactgggtcgtccgggtcaatcggcagcttgaacaagccatggcggcgcaccggccgaacgccgcggcgccgctgctcgccaagctcgacgccaccgccacgccgccggcgaagcgcaacaagtaccccttcttctgcgccgtgctcgcatccatgacctccgtgctcatgggctacaacgtcgcggtgacgagcggcgcgcagatcttcatggcggaggacctcgggatgagcgacgcgcagatcgaggtgctctcgggggtcatcaacatatactccctcgtcggcgcgctgctggcaggctggacctccgaccgtctcggccggggcctcaccatcgtcctcggccaacgccttctttctccgtcgggcccgttcgccatgggcgcttggccggcgggtacaccctgggtcatggggggggcccttcaattccccggggttcggggtttcgggtaaccccgccctttatttcggcccaattttaacctcggcccaaaaaaacggcccgggggttttatccccggggggggcccccccagggcccacttctccggagaaaatttttttacaacacccccgggggggggtgaccgggaaatttccccgggtccaaatccccccccccccccgggggggggccccctcgcccactttttgggggggggggggatttcccgcggggggggggggagcgcccccgggtgttcatggggggcgggggggttccccaccgcgagaaatcgccccgggtgggggttaataaaagacgggggccccccaaaaaaagagggtcactcaaaaatgagagaacccccccgcgaatgaaagacgcgccgccaaaaaaaagaaattcgggtaaccgccgcgcccaccgcgcggcagagggcg

SEQ ID NO: 74803 - protein, 139 aa, Zea mays
  misc_feature: Ceres CLONE 1559223
MAAHRPNAAAPLLAKLDATATPPAKRNKYPFFCAVLASMTSVLMGYNVAVTSGAQIFMAEDLGMSDAQIEVLSGVINIYSLVGALLAGWTSDRLGRGLTIVLGQRLLSPSGPFAMGAWPAGTPWVMGGALQFPGVRGFG

SEQ ID NO: 74804 - DNA, 997 bp, Zea mays
  misc_feature: Ceres CLONE 1559224
  misc_feature: Encodes the peptide sequence at SEQ ID NO. 74805
  misc_feature (509)..(509): n is a, c, t, g, unknown, or other
  misc_feature (512)..(512): n is a, c, t, g, unknown, or other
ctggagctccccgcggtggcggccgctctagaactagtggatcccccgggctgcaggaattcgtctcacccctagaaaaaaacccctcacactcccatccagccgccaccaggtgcagagtctttcgtcatctcttctccggcgaagaacccccagtcgcccaccagatcacttgttaaactttgttgaggggtgatggcggtttctttcgcaaacctcaactccgaggcagggcttaaaaagcttgatgagtaccttctcactcgcagctacatcactggctaccaagcttccaaggatgacttggctgtctacacttcgttttcggctgctccctcgtccaagtatatcaacgtagcaaggtggtttaaccacattgatgcgctcgtgaggctgagcggaattactgcagagggccaaggtgtgaaaggtgaaatctcagcagttcctttcagccccactccagatgttgctgaagcacaggcccccagttgctgaggaggacgacnacnatgatgttgaccttttttggtgaggaacccaagaagaaaaaaagggctgctaaaaagcgtgctgcaactgccaaggcctcctggaagaaaaaaagatccttggaaagcctccagtttttctttattggaaaccctgggaacaattaaactgaaattggccaacccccaaggaacctttttagaatgtcccaaatgaaaggggtttccttggggccacccaaaattttggcccttggggaattggtttaaaaaaagccgcaaatttggggaactcttggaaaaacctttttttttgggaacccctttttggagaaatttttggtccccacccccgaaaaaaaattggggaaaccgcccaaattttgcgcccaaaaaaataggggggttcccccaacactccctttcgggggggggaaaaaagaggggggggggggaacacccccccccattttccccatttttttgtcgtggggggggggggggag

SEQ ID NO: 74805 - protein, 100 aa, Zea mays
  misc_feature: Ceres CLONE 1559224
  misc_feature: SWISSPROT Homolog: EC 6.1.1.16 Cysteine--tRNA ligase
MAVSFANLNSEAGLKKLDEYLLTRSYITGYQASKDDLAVYTSFSAAPSSKYINVARWFNHIDALVRLSGITAEGQGVKGEISAVPFSPTPDVAEAQAPSC

SEQ ID NO: 74806 - DNA, 923 bp, Zea mays
  misc_feature: Ceres CLONE 1559227
  misc_feature: Translation starting site: 263
  misc_feature: Pfam Name: CTP_transf_2 Pfam Description: Cytidylyltransferase
  misc_feature: SWISSPROT Homolog: EC 2.7.7.15 Choline-phosphate cytidylyltransferase
  misc_feature (738)..(738): n is a, c, t, g, unknown, or other
ctggagctccccgcggtggcggccgctctagaactagtggatcccccgggctgcaggaattcgtctcacccctagaaaaaatgattggaggcagatgtgttgacttctactccgcatcctgctcctgttacggcccttgacgtgctccagtgttcaccttcccagctaaaaagatggagctcgtctcctatgcacgttaagcagcagggctccaagcccgccttcgcgctcagcagcacacgacacctgcaccgccacaaacatgaaggcctacgacgacctccccgtgcgcgtcatcacccacggtatcttcaatctcatgcacttcggcttcggctgcgccctcttgcacgccaagatgctgatgcccaacacctttcttctcatcagatgctgcgaccacgacctacgctacctctacgtgggcaagaccctcttgacccacgaacatcgatacgaatccctgcgggtactgcaagtgggctgataaggtcattcctgatgcaccgcgggttctcacacgggagttgattgataagcatcagattgactatgttgctcatgatgcgctgcctcatgctgatactagcggaactacagatgatgtctacgaatttgtgataagattggacaatcgaagatacagaacgacagactgggtttctacttcacatctcataatgaggatcttcgaagactataccagtatgtcatgatgatctagcacgcggctactcnaggaaagatctagtgtgagctatgtcaagagaaacatttgcagttatatgaagatcataaactgcgggagactgggaagacatcatgaaagttgaacagggaaaaacggctgtttgaccatgagatgcttgctatgcgatcccggggtcttggttcctaagaagtgacactggcccaatatggat

SEQ ID NO: 74807 - DNA, 949 bp, Zea mays
  misc_feature: Ceres CLONE 1559230
  misc_feature: Translation starting site: 179
  misc_feature (715)..(715): n is a, c, t, g, unknown, or other
  misc_feature (743)..(743): n is a, c, t, g, unknown, or other
  misc_feature (801)..(801): n is a, c, t, g, unknown, or other
  misc_feature (803)..(803): n is a, c, t, g, unknown, or other
ctggagctccccgcggtggcggccgctctagaactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccaccgtggcgtgcttcctgctccgcttctcgacgggcgggcaggccacgggcaccttcgggctgacgggcgtgtccggtgtgggaagcgctggtgcctgagatcgtgatgaccttcgggctggtgtacacggtgtacgccacgggcggtggacccgaaggaaggcagcctgggcaccatcgccccccattgcatcngcttcatcgtggggcaacattcccgggntgggcggggccttcaacgcgcgtcatgaaccccgccgtgtctttcggccccgcctcgntnagctgggatggggctaccaggggggggtactgggtcggcccttcatggggggggggctcgcgggggtatctagagctggtcttcatctccaaccaagaagcagtcccctccccgactctaaagccgaccccacccaacttgggggg

SEQ ID NO: 74808 - DNA, 933 bp, Zea mays
  misc_feature: Ceres CLONE 1559231
  misc_feature: Encodes the peptide sequence at SEQ ID NO. 74809
ctggagctccccgcggtggcggccgctctagaactagtggatcccccgggctgcaggaattcgtctcacccctagaaaaagccgtctcctccctcactctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgccttgactggggcgaggcgggcggccccgacctcatcgtcgacgactgcggcgacgccacgctgctcatccacgagggtgtcaggcccgagaagagtacgagaagaccggctagatccccgaccccgagtcaccgacaacgctgaggtcaagatcgtgctcaccatcatccgcgacgggctcaaggctgacccccagaaagtacgcaagatggaaggagaggcttgtcggcgtctctgaagagaccaccacgggtgtccagaggctctaccagatgcaggagacgggcgccctcctcttccctgcattaacgtcaacgatccgtcaccagagcaagtttgacaacctgtatgttgccgccactcactcctgatggtctgataaggccacccacctatgatcgccgg

SEQ ID NO: 74809 - protein, 171 aa, Zea mays
  misc_feature: Ceres CLONE 1559231
  misc_feature (12)..(171): Pfam Name: AdoHcyase Pfam Description: S-adenosyl-L-homocysteine hydrolase
  misc_feature: SWISSPROT Homolog: EC 3.3.1.1 Adenosylhomocysteinase
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDCGDATLLIHEGVRPEKSTRRPARSPTPSHRQR

SEQ ID NO: 74810 - DNA, 910 bp, Zea mays
  misc_feature: Ceres CLONE 1559232
  misc_feature: Encodes the peptide sequence at SEQ ID NO. 74811
  misc_feature (749)..(749): n is a, c, t, g, unknown, or other
  misc_feature (902)..(902): n is a, c, t, g, unknown, or other
  misc_feature (903)..(903): n is a, c, t, g, unknown, or other
ctggagctccccgcggtggcggccgctctagaactagtggatcccccgggctgcaggaattcgtctcacccctagaaaaatttgatccagcttccacaggatgaagctctacttacagattggaagcagcagttggatcgtgatgttgaaacccttaaagccaaatcaaatattggtagcattcgcatgtttctgagccgcaatggaattgaatgcaatgatcttgaagaattattcatcaaagaccaatcattgagtaatgaaaatgtggacaagattgttgggtacgcagtgagttatcaccttaatcagaataaaattgaaacctctaaggatgccaaacttgtactcacaactgaaagccttaagcatgggctcaacatgctccaaagcatgcaaaatgataacaagagctccaaaaaatcactgaaggatgttgtcacagagaatgagtttgagaaaaggcttttggcagatgttatacctccaaatgacattggagttacctttgatgatattggagccttggagaatgtaaaggacacgttaaaggagctggtgatgctccctttgcaaagacctgagttgttctgcaaagggcagttaacaaagccttgcaaggggatattgcttttcggacctcctggcactggaaaaactatgcttgccaaagcagtagcaactgaagcaggcgctaatttcatcaatatatcaatgtcgagcattacatctaagtggtttggtgaaangggaaaaaagtatgtaaacggcttttttctcactagcaagtaatatagcacccagctgtatattttattgatgaaggtcgatagtatggctaggaaggagagataatccaggggagcatgtagcgatgcgcaagatgaaaatgaattatgggnnaaaatgg

SEQ ID NO: 74811 - protein, 201 aa, Zea mays
  misc_feature: Ceres CLONE 1559232
  misc_feature: SWISSPROT Homolog: EC 3.6.4.3 Microtubule-severing ATPase
  misc_feature (188)..(188): Xaa is any aa, unknown, or other
MFLSRNGIECNDLEELFIKDQSLSNENVDKIVGYAVSYHLNQNKIETSKDAKLVLTTESLKHGLNMLQSMQNDNKSSKKSLKDVVTENEFEKRLLADVIPPNDIGVTFDDIGALENVKDTLKELVMLPLQRPELFCKGQLTKPCKGILLFGPPGTGKTMLAKAVATEAGANFINISMSSITSKWFGEXGKKYVNGFFLTSK

SEQ ID NO: 74812 - DNA, 959 bp, Zea mays
  misc_feature: Ceres CLONE 1559235
  misc_feature: Encodes the peptide sequence at SEQ ID NO. 74813
  misc_feature (483)..(483): n is a, c, t, g, unknown, or other
  misc_feature (592)..(592): n is a, c, t, g, unknown, or other
ctggagctccccgcggtggcggccgctctagaactagtggatcccccgggctgcaggaattcgtctcacccctagaaaaagctcctcatttccactttccactgcgcctccgctgcccatcgccgtccccgaccgcagcgcaggactgaggatgagtgaagaggataaggctgctgcttctgctgagcagcctaagagggcccctaagctcaatgaagggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaactggactgattaaggttgatcgagtcctttactcatcagttgtataccctcacaattatggtttcattccagggactctttgtgaagacatgaccccatggatgtgttggtcctgatgcangagccctgttgtcctggttcgttcctgagagctagagcattgggcctatgcccatgattgaccaggggtgaaaaggatgacagatatagcaggttgtgctgacgatccntgaataccgtcactacaacgacatcagggaagctgtctcctcaccgccctgcaaaaaatcaagcccttctttgaagtttccagaaaaacgggaacaaaaagccccagttgatggtttctttgccccgaaacggttagaaaaccttccatcccccgggacctttagccccgttttttttgcaaaatttggggcttaatttcaaccacatttttccttctccccctggaaacggggggagttttataaaacaaaaccctttttttttggcaaccctgaattaaaaacccccccccggggggtccccccttcccccaaaataaaaagaaagggaagcacccatttttggggggggccttttaattcccac

SEQ ID NO: 74813 - protein, 108 aa, Zea mays
  misc_feature: Ceres CLONE 1559235
  misc_feature: SWISSPROT Homolog: EC 3.6.1.1 Inorganic diphosphatase
MSEEDKAAASAEQPKRAPKLNEGILSSLSRRSVAAHPWHDLEIGPGAPAVFNVVVEITKGSKVKYELDKKTGLIKVDRVLYSSVVYPHNYGFIPGTLCEDMTPWMCWS

SEQ ID NO: 74814 - DNA, 779 bp, Zea mays
  misc_feature: Ceres CLONE 1559236
  misc_feature (292)..(292): n is a, c, t, g, unknown, or other
  misc_feature (307)..(307): n is a, c, t, g, unknown, or other
  misc_feature (320)..(320): n is a, c, t, g, unknown, or other
  misc_feature (356)..(356): n is a, c, t, g, unknown, or other
  misc_feature (518)..(518): n is a, c, t, g, unknown, or other
  misc_feature (573)..(573): n is a, c, t, g, unknown, or other
ctggagctccccgcggtggcggccgctctagaactagtggatcccccgggctgcaggaattcgtctcacccctagaaaaaacgcgcgcgcgcgctccgctagccagccagctcgttctctctatctctatctatctatctgtctgtctcagctagagctcgaggcagcatcatcagagcttgcttgctcgcatgctagcttgccgtcgtcctgcgttggtccttgctgggtcgtcttgtgttcatttctcatcgtcggagagaagaaggagtatagctagctagctagctangaaggggaaggtgcntggttggtccccntattatttcattgcccccatgggaaggggggccccngaaagaaaggccccaaggccgaaaaaagggggggccccccggggcccttggggaaagggggcccccccggggggattttgggggccccccccccggggggggggggaggaggggccccccaaaaatattaaaaggggggggggggggggtaaaaaaaacaanctcccccgcgggggggggggggcgccccccctccctattgttggggggggggggnaaaaaaaaaaaaaaaagagggttttttttttttttttaaaaaaaaaaaaaaaacaccccccccccccccggcgggggggaaggagagagggtttccccccccccccccccaaacaaaataaaaaatttttctttcccccccttcccccccccccccaaaaaattttttatccccccccccccccccccccccccctcgcggggggg

SEQ ID NO: 74815 - DNA, 912 bp, Zea mays
  misc_feature: Ceres CLONE 1559237
  misc_feature: Encodes the peptide sequence at SEQ ID NO. 74816
ctggagctcaccgcggtggcggccgctctagaactagtggatcccccgggctgcaggaattcgtctcacccctagaaaaaatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcagaggtgccggagtacctcaccggagaggtccctggagactatggctacgacccttttggcctgggcaagaagccagaggacttcgccaagtaccagggctacgaactgatccatgccagatgggccatgctcggtgccgctggcgctgtcatcccagaggcctgcaaacaagtcgggcgctaactgtggaccctgaagctgtctggttcaagaccggcgcgctgctcctgaacggaaaacccttaataacttgggaaaagcatcccaataaacctggtggtgggcgtgatccccaaagtaattctcgtcgggggggccgaatactacgggatccccaaggactggacctaaagaaaacctgcccccgggggggccctttaaccccgggggcgggaaaggaaccccaaaagggcccctttttaaagggaaagaaaaaaaaaaagggggggggggcattttcccaagtgtcccctctttccgggggctatttccgggaaaaggccgcgggagaaaacctccaaagaccccccccc

SEQ ID NO: 74816 - protein, 142 aa, Zea mays
  misc_feature: Ceres CLONE 1559237
  misc_feature (83)..(143): Pfam Name: Chloroa_b-bind Pfam Description: Chlorophyll A-B binding protein
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFAKYQGYELIHARWAMLGAAGAVIPEACKQVGR

SEQ ID NO: 74817 - DNA, 887 bp, Zea mays
  misc_feature: Ceres CLONE 1559238
  misc_feature: Encodes the peptide sequence at SEQ ID NO. 74818
  misc_feature (510)..(510): n is a, c, t, g, unknown, or other
tggagctccccgcggtggcggccgctctagaactagtggatcccccgggctgcaggaattcgtctcacccctagaaaaaactggacgacccaagcaagcaagcaagcagcgagtacatacatactaggcagccaggcagccatggcgcccaccgtgatgatggcctcgtcggccaccgccgtcgctccgttccaggggctcaagtccaccgccagactccccgtcgcccgccgctcctccagaagcctcggcaacgtcagcaacggcggaaagatccggtgcatgcaggtgtggccggcctacgacaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactactacggccgctactggaccatgtggaagctgcccatgttcggctgncacgacgccacccaggtgtacaaggagctgcaggacgccatcaaatcctacccggacgctttacacgcgtcataagcttcaacacatcagcagacgcagtgggtccgcttcatcgcctaacagcccccggggggggattaaacggacccgccggactcccaccaccgggtaagtaaatgaaagcccccggcggaaaggggaaaaaggcccagggccaccccccgccttgggtttgcctggggcaccgggacccttgggggggggggcccaattccccttctcccatttttatcctttttccccggtatggtacctttgtttcccaaaatctcgggggggggagaaaaacccttgggaaaaagggcccttttttggca

SEQ ID NO: 74818 - protein, 147 aa, Zea mays
  misc_feature: Ceres CLONE 1559238
  misc_feature (58)..(146): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
  misc_feature (123)..(123): Xaa is any aa, unknown, or other
MAPTVMMASSATAVAPFQGLKSTARLPVARRSSRSLGNVSNGGKIRCMQVWPAYDNKKFETLSYLPPLSTDDLLKQVDYLLRNGWIPCLEFSKVGFVYRENSTSPCYYYGRYWTMWKLPMFGXHDATQVYKELQDAIKSYPDALHAS

SEQ ID NO: 74819 - DNA, 953 bp, Zea mays
  misc_feature: Ceres CLONE 1559240
  misc_feature: Encodes the peptide sequence at SEQ ID NO. 74820
ctggagctccccgcggtggcggccgctctagaactagtggatcccccgggctgcaggaattcgtctcacccctagaaaaacagctacttattgtatagttcaggaaaaattcatcatgttgtcatcggacctcttgaagataacactatttattactaccgatgtggagggcagggtccacaattccaatttaagaccccgccctcccaatttcctttgtcattggctgttgttggtgatcttggtcagactagttggacaacgtcaaccctgaatcacattaagcagtgtgagcatgatatgcttttactccctggtgctctatcttacgctgactatatgcaacacttgtgggatgccttctgcacattggtggagccacttgctagcaaccggacttggatggtgacagaaggcatccatgagtacgagcacattccattgtgcgagtcacgatttcaatcttgtaatgcacgatgaaaaatgcctttatgaacagagcggatccagatcaaatttggactactcttttaaacttgcctggtggaaacatcataatgcttcgttccaccccgggattatgaagattacccccaattcccttgcttggcttaacgggggtcttgccaaaggttaaacaaaagggaccccccgggttcattggggtttttgcaagttacagggtaacaaaacaattgggcccctcggggttaagggccatattttgggtgttttatgggaccccttttgtcccccggccatgggagttccgaaaaaaggggcgcgcccctggttttataagggggggggagagtccccaaacccccaccggggggggggggggccccccccaatattcttcccggcggtgaaaaaagaaaatgttgcccccggagccctcaaaataataaccggggggggttttttatggagagaccttttgtggccccatt

SEQ ID NO: 74820 - protein, 59 aa, Zea mays
  misc_feature: Ceres CLONE 1559240
MLLLPGALSYADYMQHLWDAFCTLVEPLASNRTWMVTEGIHEYEHIPLCESRFQSCNAR

SEQ ID NO: 74821 - DNA, 897 bp, Zea mays
  misc_feature: Ceres CLONE 1559241
  misc_feature: Encodes the peptide sequence at SEQ ID NO. 74822
ctggagctccccgcggtggcggccgctctagaactagtggatcccccgggctgcaggaattcgtctcacccctagaaaaaactcctctcgtctccgtctccatctccgtggtcgtgactctcgcgtgccgtaactgctgctgtctgtgtccctctccctcaatataacacctcgccaacggtgtcgctgcctgtctgctgacttccctccatacatgcgctatcccagccctgtgagaacgccacccagatacagatacacaccgcagggatcatccttccgtcataccatcacccatggacaaccttcaggagcagaagcgccgcgactccgcttgcgccaacgtcggactctgcattaccgtaccagcattagtgcactgggacacgaacaacggtgcgctgccagactactcagtggacttgctccacatccgcgagactctgcatcagaagaagaaagagctgtctccacgcagcctcggtgacgacgacgtactcttcggcagggcgacgcacatgcccagtaagccgatgccatcatttctcagcccaagctacgtcgaccctgccgctggtctgacagtgtactggtctacgccgggcactactccctaaagcagggaaataggttcggacctcctccatggcggataagggcaggataagcactgcccccaagctaaacagtcgactgggctttaaccccactaaacccccctgagcatttggggcccgggttgttaaatacccaaaacgcccaattatttgcccttatggcccccacttaaccttttgccaggagtaaacaccctctggttatgggcccagggaaacctttttttgacggggaaaataaattgggggcccacggggtttaaagttcccccgttttaat

SEQ ID NO: 74822 - protein, 106 aa, Zea mays
  misc_feature: Ceres CLONE 1559241
MDNLQEQKRRDSACANVGLCITVPALVHWDTNNGALPDYSVDLLHIRETLHQKKKELSPRSLGDDDVLFGRATHMPSKPMPSFLSPSYVDPAAGLTVYWSTPGTTP

SEQ ID NO: 74823 - DNA, 946 bp, Zea mays
  misc_feature: Ceres CLONE 1559242
  misc_feature: Encodes the peptide sequence at SEQ ID NO. 74824
  misc_feature (632)..(632): n is a, c, t, g, unknown, or other
  misc_feature (751)..(751): n is a, c, t, g, unknown, or other
  misc_feature (773)..(773): n is a, c, t, g, unknown, or other
  misc_feature (818)..(818): n is a, c, t, g, unknown, or other
ctggagctccccgcggtggcggccgctctagaactagtggatcccccgggctgcaggaattcgtctcacccctagaaaaagcgccggccacccatccggatcttgcgaagccgtgcaagtatcctgcttcgcggaggatttcagtcatccgcctgccgagggccgagctcttccgagtttctgcggagagtgggcaacttttctcggtcccgaatcgatttgcctgctactcgcggtaggcgaagggaaggattcaaatcaacataacatggccgcagccaccgccgccgcttccaccatgtcgctgctcccgatctcccagctcaggcagcagcacggcgcgggcgccatgaggcggcggccctgggtcgcgcggcggaggcgatacgtcgttccgacggcgaggctgttcgggccggcgatcttcgaggcgtcgaagctgaaggtgctgttcctgggcgtggacgacgaggccggcagcaagcagcacgggccgctgccgcggacgtacacgctgacgcacagcgacgtgacggccaggctgacgctcgccgtctcgcacaccatcaaccgcgcgcagctgcagggctggtacaaccgcctgcagcgcgacgaggtggtggccgagtggnaagaaggtgcgcggccggatgtcgctgcacgtgcactgccacatctccggcggccacttcctgctcgacctcatcgcgggcctgcgctacgtcattttccgcaaggagctccccgtggntgctcaggcgttcgtgcacggncgacgcgacctgttcagccggcaccggagctggaggagccaccgntgtggtctacttccactccaactggtccgcttcaaccgggtggaatgctgggtccgctccgcaacgccccgcgccgcccaaggagaatcaccggggcgccgagcctcaaatccaggaggcggccgatg

SEQ ID NO: 74824 - protein, 216 aa, Zea mays
  misc_feature: Ceres CLONE 1559242
  misc_feature (112)..(112): Xaa is any aa, unknown, or other
  misc_feature (159)..(159): Xaa is any aa, unknown, or other
  misc_feature (174)..(174): Xaa is any aa, unknown, or other
MSLLPISQLRQQHGAGAMRRRPWVARRRRYVVPTARLFGPAIFEASKLKVLFLGVDDEAGSKQHGPLPRTYTLTHSDVTARLTLAVSHTINRAQLQGWYNRLQRDEVVAEWXEGARPDVAARALPHLRRPLPARPHRGPALRHFPQGAPRGCSGVRARXTRPVQPAPELEEPPXWSTSTPTGPLQPGGMLGPLRNAPRRPRRITGAPSLKSRRRPM

SEQ ID NO: 74825 - DNA, 886 bp, Zea mays
  misc_feature: Ceres CLONE 1559243
  misc_feature: Encodes the peptide sequence at SEQ ID NO. 74826
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
ctggagctcaccgcggtggcggccgctctagaactagtggatcccccgggctgcaggaattcgtctcacccctagaaaaaagaggaaccaaagctagagacaaccgctgcgtaaacgaatccatcgccatggcgtctcgtctcgttgcggcggcggcctcctcctcctccctctcctcagcgtcccccctcgctcgcctaatctctcgccgcggccttgccggtgccgcagacggccatgggtctgcgaaggtgcccttgtggaaagatccgttgagcccgagcaagtggaaggaagagcactttgttctagcaagcctctcaatgtggggggttattttttatggtggttacaagctttttagtggaaagaaggaagccaagactgaggcggcatcaccacaggcataggtggcggagatggagttatacccgtatctgtggcctgggctcaatgctaaataaaaggaatgctttatgttgtgctttcaagttgataaattgtggcaacaggagattttgctttacgtaggcaatatattgagaaactactcttactcatcaaccatgaaaatctttgctgcaaaggaccttcatgtccgcaaacatggcaaaagtgggacctccttcatggaaatgagaaggtgaaggttttacttcggtggccccaaacagtttaaaccccgggccttcaaaatgaaaaaaaatccccggggcttctaaaaaannnaattttcccaaaggaactccccaggaggttaaaaaaccctaacccccggaaacccctcgcctttttttccccccccccccaaaaaaaaaaaaaaaaaccccggggggggggagaaaaaaccccccaaaagggggggggcgctttaaaaaaacccccc

SEQ ID NO: 74826 - protein, 93 aa, Zea mays; identical to SEQ ID NO: 60640
  misc_feature: Ceres CLONE 1559243

SEQ ID NO: 74827 - DNA, 886 bp, Zea mays
  misc_feature: Ceres CLONE 1559244
  misc_feature: Translation starting site: 157
  misc_feature: Pfam Name: DUF1517 Pfam Description: Protein of unknown function (DUF1517)
  misc_feature (783)..(783): n is a, c, t, g, unknown, or other
ctggagctccccgcggtggcggccgctctagaactagtggatcccccgggctgcaggaattcgtctcacccctagaaaaacaccaccgccgcagccctctcctcctccgcctccgcatcacattccacttccattcccgcggcccgcgccgccatcatggccaccgcctccctcctcgaggccactcgcctcctttccaccccgcgcccgccccgccgcagcctccacacccacctcctcaggaccccgcgcctctccgctctccgcgctcacctccaccgttccgcaactctcgacgcgcaggagccgacggcgaggcctggcgcgctcctggtcctcgacgcgctcaggaggtccgtggtcgactccctcgcggcgctcaagcggcccgcgctcgcgctcctgctggccggcgcgctgctcgccgcggcgtcaatgggcgggccgcacgccgcggcgctggccgcttcgggcgggcgcgtcggcgggtccgccttctcctcccgctcctcctcacctccgtcctacggctacagcgcgccggcgcccaggggcgggtacacggccgcgccctactactcgccttcgcccttcgtgtccttcggcccggccgtcggcatcggcttcggggggatcgggtttcctcgtgaccctcattggcttcgcggcattcctctatctcgccgggttcctgtccgactcgtcaggcggtaccagtgtgcttacagagacggataagacaccgtcctcaagctacaggttgggcttgctgggcatggcacnatcatttcagaaggagcttgaccaaatagctgagaaaacagatacatctaactcgggctggtttgagctatgtgttgacgagacaacattagcatacttcggc

SEQ ID NO: 74828 - DNA, 948 bp, Zea mays
  misc_feature: Ceres CLONE 1559245
  misc_feature: Encodes the peptide sequence at SEQ ID NO. 74829
  misc_feature (581)..(581): n is a, c, t, g, unknown, or other
  misc_feature (657)..(657): n is a, c, t, g, unknown, or other
  misc_feature (703)..(703): n is a, c, t, g, unknown, or other
  misc_feature (741)..(741): n is a, c, t, g, unknown, or other
ctggagctccccgcggtggcggccgctctagaactagtggatcccccgggctgcaggaattcgtctcacccctagaaaaaaacagatacacacacactcgggtaaagctatctcgagctagctagctgctgtaagccgttgccatggccaaaatggtgttgctctgcgtgctcgtctccttcctcctgatgcccttggcctccctagccctgacgcaggacttctgcgtcgccgacctgacctgcagcgacacgccggcggggtacccgtgcaagtccagcgtcaccgccaacgacttctacttccacggcctggccggccagggcaaaataaacccactcatcaaggccgccgtgaccccggccttcgtgggccagttcccgggcgtcaacgggcttggcatctctgcggccaggctcgacatcgaggtgggcggcgtcgtgccgctgcacacccacccggcgggctcagagctcctcttcgtgacccagggcaccgtcgccgccggcttcatcagctccggctccaacaccgtctacaccaagacgctgtacgccggcgacatcatggtgttcccccanggcctgctccactaccagtacaacgcccgcaccggcgctgccgtgggcctcgtcgccttcagcagccccaacccgncctgcagatcaccgactttgcgctctttgcaaccacctcccgtccngcgtcgtggaaaaggtcacctttctggacaacgcgcangtgagaagctccaggtgggctcggcggcagcggttactgttttccagacatacatgcaggctgggttgcacctccccctcctcctctggcctccccaccaatggaacctgggcttgcttctcatgcgcgtgccccctgccccccggcaaaaaacccggccccttccactaccctttttattccccctttcccccgggaggttccctc

SEQ ID NO: 74829 - protein, 268 aa, Zea mays
  misc_feature: Ceres CLONE 1559245
  misc_feature (55)..(189): Pfam Name: Cupin_1 Pfam Description: Cupin
  misc_feature: SWISSPROT Homolog: EC 1.15.1.1 Superoxide dismutase
  misc_feature (146)..(146): Xaa is any aa, unknown, or other
  misc_feature (172)..(172): Xaa is any aa, unknown, or other
  misc_feature (187)..(187): Xaa is any aa, unknown, or other
  misc_feature (200)..(200): Xaa is any aa, unknown, or other
MAKMVLLCVLVSFLLMPLASLALTQDFCVADLTCSDTPAGYPCKSSVTANDFYFHGLAGQGKINPLIKAAVTPAFVGQFPGVNGLGISAARLDIEVGGVVPLHTHPAGSELLFVTQGTVAAGFISSGSNTVYTKTLYAGDIMVFPXGLLHYQYNARTGAAVGLVAFSSPNPXCRSPTLRSLQPPPVXRRGKGHLSGQRAXEKLQVGSAAAVTVFQTYMQAGLHLPLLLWPPHQWNLGLLLMRVPPAPRQKTRPLPLPFLFPLSPGRFP

SEQ ID NO: 74830 - DNA, 974 bp, Zea mays
  misc_feature: Ceres CLONE 1559246
  misc_feature: Encodes the peptide sequence at SEQ ID NO. 74831
  misc_feature (974)..(974): n is a, c, t, g, unknown, or other
tggagctccccgcggtggcggccgctctagaactagtggatcccccgggctgcaggaattcgtctcacccctagaaaaaactacacagctcagctcagcccagcctccctttcccttgaagcctctccaccaacccaaagtcacagagacagagaggaccaaggcaggcagccgtcagcgagccagctagccagccatgggcaaggactgcggcaaccacggggacgatgacttccggcagtcatgccggcgcctgctggccatcctgctgaccatggcgctgctggtgggcgtcgtggcgctgatcgtgtacctggtgctccgccccacgcacccgcgcttctacctgcaagacgcggcgctgcggcagctggacctgagcaacggctcggccccgctgctgtccacggcggcgcaagtcaccgtggcgtcccgcaaccacaacgggcgcgtcggcgtctactacaaccgcctcgacgtctacgccacgttcaagttacagcaagtgaacgctgggggtcatgcctgccccccggtgtaccagggccacaggcgaacttcaacttctgggtggccccggggctggggggggccccagccttccccctttcgggcccctttcttcggcgaaaggggcttcgtccaaggggacacccgccgccggggggagtcttggtccctgccaatctaaagaattcaaggtgaggtgccctcctggaaaagtccgccacctctgggggttggggccacccaacaccacgttttgtgtatccttccgccgccttatttttattagatcccggggcgcgggcgtttttaaccggcgggggtagtctagggggttaagtgtcatggggtcatgacacctacataatgggcgcgggggagggtataatatctttgcaggcgaaggggtgatattggataatgtctgaaactcaaccgcttttttggttggcagcccccgtttaaan

SEQ ID NO: 74831 - protein, 164 aa, Zea mays
  misc_feature: Ceres CLONE 1559246
  misc_feature (39)..(163): Pfam Name: Hin1 Pfam Description: Harpin-induced protein 1 (Hin1)
MGKDCGNHGDDDFRQSCRRLLAILLTMALLVGVVALIVYLVLRPTHPRFYLQDAALRQLDLSNGSAPLLSTAAQVTVASRNHNGRVGVYYNRLDVYATFKLQQVNAGGHACPPVYQGHRRTSTSGWPRGWGGPQPSPFRAPFFGERGFVQGDTRRRGESWSLPI

SEQ ID NO: 74832 - DNA, 989 bp, Zea mays
  misc_feature: Ceres CLONE 1559247
  misc_feature: Encodes the peptide sequence at SEQ ID NO. 74833
ggagctcaccgcggtggcggccgctctagaactagtggatcccccgggctgcaggaattcgtctcacccctagaaaaaatcgccgcctcctccccactgcctcgtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatcctctagcagcgcctcaaggtaccaccggcgctcaaccagttcacccgcaccctcgacaagaacctcgctacgaacctgtttaagatgcttctcaagtaccggcctgaagacaaggctgccaagaaggagaggcttctggagaggggccaagctgaaaatgaaagaaaaactgttgagtcgaagaaaccaatttgtggggaagtatgggccttaaccatgtgaactttccccctttgagcaaaaacaaggctccaccttgttggtctttcgccccccaacgtgggatccccaatcggaccttggtggtggggggctccccaccccctggggcaagaagaaaatgggagggccccctttacagggcgttgtgttaaaaagagaagggcgcccgccccttggatggaaattgggccacaaagaaaaaaataacgttcccgcctctttggggtgtgaaccccggttaaaaaaacaaagaaataaacgtctcattttatccccaaaagttttttgcgggggtattctttgggcaagatttttccgcagcaaaattttttttataaagttcactggaataaaaggtgggtggaggggcgtattatagtgggattacccacgcctcgccgcctcatatactaagcccgcgccgtatat

SEQ ID NO: 74833 - protein, 63 aa, Zea mays
  misc_feature: Ceres CLONE 1559247
MAPKRGGRAPVPAKKKTDKVTNPLFEKRPKQFGIGGALPPKKDLHRFVKWPKVVRIQRQRRIL

SEQ ID NO: 74834 - DNA, 955 bp, Zea mays
  misc_feature: Ceres CLONE 1559248
  misc_feature: Encodes the peptide sequence at SEQ ID NO. 74835
  misc_feature (635)..(635): n is a, c, t, g, unknown, or other
  misc_feature (647)..(647): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (660)..(660): n is a, c, t, g, unknown, or other
  misc_feature (665)..(665): n is a, c, t, g, unknown, or other
  misc_feature (666)..(666): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (678)..(678): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
ggagctccccgcggtggcggccgctctagaactagtggatcccccgggctgcaggaattcgtctcacccctagaaaaacccgtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccacctagagatggatccgcaccaancaccaggtggtngnnnnnnnngggnggggnntnnnnnnnnggnttttnnngggtgggggaaaaaggaggaattcgggggaaaccctgatgggggggttaaaaaaccgacttcggaaaacctttccgggaccagggaccgcggctggaaagctaaggccatctacaacgggaaacccgcagggcaaggggggtttggcttcctcccccttgggtttgccgagcaggtcaaaatggcctatcaacccttcagggcttccacttgaagggtaaacaaaccccagtcgggggtgccaaatctaagaccccccggggggttggaa

SEQ ID NO: 74835 - protein, 192 aa, Zea mays
  misc_feature: Ceres CLONE 1559248
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (164)..(164): Xaa is any aa, unknown, or other
  misc_feature (168)..(168): Xaa is any aa, unknown, or other
  misc_feature (169)..(169): Xaa is any aa, unknown, or other
  misc_feature (170)..(170): Xaa is any aa, unknown, or other
  misc_feature (171)..(171): Xaa is any aa, unknown, or other
  misc_feature (174)..(174): Xaa is any aa, unknown, or other
  misc_feature (175)..(175): Xaa is any aa, unknown, or other
  misc_feature (176)..(176): Xaa is any aa, unknown, or other
  misc_feature (177)..(177): Xaa is any aa, unknown, or other
  misc_feature (180)..(180): Xaa is any aa, unknown, or other
  misc_feature (181)..(181): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEEAGAAVEQFNGYTFQGRPLRVNCGPPPPRDGSAPXTRWXXXXGGXXXXGFXXVGEKGGIRGKP

SEQ ID NO: 74836 - DNA, 954 bp, Zea mays
  misc_feature: Ceres CLONE 1559251
  misc_feature: Encodes the peptide sequence at SEQ ID NO. 74837
  misc_feature (544)..(544): n is a, c, t, g, unknown, or other
  misc_feature (545)..(545): n is a, c, t, g, unknown, or other
  misc_feature (554)..(554): n is a, c, t, g, unknown, or other
  misc_feature (679)..(679): n is a, c, t, g, unknown, or other
ctggagctccccgcggtggcggccgctctagaactagtggatcccccgggctgcaggaattcgtctcacccctagaaaaaaaactccgtttcgaattctagggttttgctgctctccgaccccgagctccgaaggccgcagcatcaggcgcgccccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattgtcctctgcnngtataaggntgatgtgaagaacaggcaggtcaaagccaagcaggttacttttcacagggagaagaatctgcagtactatgaaatttctgcccagagcaactactactttgagaaaccttccctgtaccttgcanggaagcttggctgttgatccgaaccctcactttggttgagctgttgctcttaagcctccggaagtaccatcgacatggcatgcagcagcacatgaagctgagctgctgagcagctgcacacctcttctgatgacgagatgatctgattgagtagaagggtcatgagtctgaccttgagcaagagtgtgcctggcaccattaagtggtctaggtggacccccctggattaacatggcggagacacttttccccctggacttgttgcacctttgagt

SEQ ID NO: 74837 - protein, 173 aa, Zea mays
  misc_feature: Ceres CLONE 1559251
  misc_feature (15)..(173): Pfam Name: Ras Pfam Description: Ras family
  misc_feature (124)..(124): Xaa is any aa, unknown, or other
  misc_feature (127)..(127): Xaa is any aa, unknown, or other
  misc_feature (169)..(169): Xaa is any aa, unknown, or other
MALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCXYKXDVKNRQVKAKQVTFHREKNLQYYEISAQSNYYFEKPSLYLAXKLGC

SEQ ID NO: 74838 - DNA, 1005 bp, Zea mays
  misc_feature: Ceres CLONE 1559253
  misc_feature: Encodes the peptide sequence at SEQ ID NO. 74839
  misc_feature (435)..(435): n is a, c, t, g, unknown, or other
tggagctccccgcggtggcggccgctctagaactagtggatcccccgggctgcaggaattcgtctcacccctagaaaaaatccttccacgaactagacgagggaagagcgctgaagcctgaagctgtggaggaaaacgaaggatctccccgtgcttgtgtatgccaggtcgcctgctctccgtccgcatcccgtccctcgcgaaactcggcgctcccaggtgtgcaaaatccatggcttcagacactggcaagaagctcatccagatcgatgtgagctcggacacagtatgcccttggtgctttgtcggcaaaaagaacctcgagaaagcgatggagcaaagcagggacaagtttgacttcgtagtccgctggcatccgttctttctaaaccctgatgcgcctaaggagggcgtcaggaaatctgacttctacanggcgaagttggtcccctgtcagtatgagcgtgtcatttctcgcatggccgagatatttcgaggactccgggcttgagtatgacatgtccgggctgaacgggggataccatgggatagtccttagcccaatagcacttggctggaaccccaagccttgaacagccaaaagcccttggtgggaaaatttttcccttttttaccttttggaaaagaaaaattttttgggtgcaaaacaaggtttttgccgggacccctcaaaaaaaaggggggctttaaagggggcccaaaaaatttgtttcaaaacccctccaaaggagtcccataaggttccagagaaaaccccaaaaaattttctttgggatcccccggggtaacccattttgtgggacaaagaaaaaaacacccccggggggggcccccccccacaattttttttaagggggcttttttaatggggcaaaaaaggacttctttttttttaaaagagccccccccccactttcccttttttaaaagaggagggcgcccttttttaaattttctccccccctccttctttttattaaatat

SEQ ID NO: 74839 - protein, 92 aa, Zea mays
  misc_feature: Ceres CLONE 1559253
  misc_feature (68)..(68): Xaa is any aa, unknown, or other
MASDTGKKLIQIDVSSDTVCPWCFVGKKNLEKAMEQSRDKFDFVVRWHPFFLNPDAPKEGVRKSDFYXAKLVPCQYERVISRMAEIFRGLRA

SEQ ID NO: 74840 - DNA, 961 bp, Zea mays
  misc_feature: Ceres CLONE 1559254
  misc_feature: Encodes the peptide sequence at SEQ ID NO. 74841
ggagctccccgcggtggcggccgctctagaactagtggatcccccgggctgcaggaattcgtctcacccctagaaaaaacaccattcatcagaaagcgaagcacaagcctctgatgccaagccaaagcacacacacctcctccagcctttcttcctctacaaccccaattcttccctgcagctctgctgctgccttgttccgatcggtcatggcggcggtggccacagagactccgttccatgtcctggcggtggacgacagcctcccggacaggaagctcatcgagaggctcctcaagacctcttccttccaagtgaccactgtcgactccgggagcaaggcgctgcagttcctggggctccatgaccaggacagcacggttcctcctgtccacacgcaccagctggatgtggctggcaatcaggatgtggctgtgaacctgatcatcacagactactgcatgcctggcatgacaggatatgacctgctcaagaagatcaaggagtcgtcctctctcagagatatcccggtggtgatcatgtcctccgaagaactttccttcaggaatcaatagtgcgctgaaggaaagaagctaaacaattcctccctaaaccttgtgcggttttcaaacttgaacaagccaaaccccccttctgaaaacgcgatgcaaccggaaacgcccccccaaagggactgtccccggggggaaacccgggaaccccccaatggggggcgccgggaatggattaaaaaccccaaaaaaaaggggcccgcccccaaaaaattttccccccctggggaaaaaaaaaggggccttttatggaaaacgcgctttaccccaaaaacctttttttttcctttttttggcgcccttgtttttaacaaaaatgtcccccccggttttaaaaagaaagaaaactttaaaaaattccgcgggggggaacaaaaccaaagagttct

SEQ ID NO: 74841 - protein, 121 aa, Zea mays
  misc_feature: Ceres CLONE 1559254
  misc_feature (10)..(121): Pfam Name: Response_reg Pfam Description: Response regulator receiver domain
  misc_feature: SWISSPROT Homolog: EC 3.1.4.17 3',5'-cyclic-nucleotide phosphodiesterase
  misc_feature: Functional homolog of the protein sequence given in SEQ ID NO 96887
  misc_feature: Useful for making plants with altered carotene content
MAAVATETPFHVLAVDDSLPDRKLIERLLKTSSFQVTTVDSGSKALQFLGLHDQDSTVPPVHTHQLDVAGNQDVAVNLIITDYCMPGMTGYDLLKKIKESSSLRDIPVVIMSSEELSFRNQ

SEQ ID NO: 74842 - DNA, 907 bp, Zea mays
  misc_feature: Ceres CLONE 1559256
  misc_feature: Encodes the peptide sequence at SEQ ID NO. 74843
caaaagctggagctcaccgcggtggcggccgctctagaactagtggatcccccgggctgcaggaattcgtctcacccctagaaaaagtaagaaaggagctctgccaccatcatatgctgtgaagttagctcttgatattgcaagaggaatgaattacttgcatgagcataaacctcaggctatcatccatgcgtgatcttgaaccttctaacatattgagggatgacactggacatctgaaggtggcagattttgatctatgtaagatgctaaaatggagaagaaaagttagagaagataaagcagtcacttctccaggcaatgcttgtaaatatgtggctccagaagtcctgcgaaatgaagagtatgataccaaagtggatgtcttctcattcgctctgatacttcaggagatgattgaaggatgccttccttattatgataagaaaaatgatgaaattgagaaggcacataattctaaagaaaggcctccttttcgagctcctccaaagcattatgcccatgggttaagagagttgattgaacagtgctggagcgaaaattctgcagacaggcctgattttagagtaattatcaaccggctgtctgctatccaaaatgagatagctcacagaaaccgttggaaggcgagacctctcaagtgtttcctgagcattgaaggaatgtgggaagaaagatcgcaatgagggcagcaccacccgttcatcacgctcatcgcgatcctatttttaaccacagcacaagctattgatttcatcgcaagatcatattggtgattgctagaaatatactcaaatgtatatcatatttttcgtttctaaactatgaaaaaaaatgttctgcactgttttgatcccaccgaacaaagttttgaatggatatcagt

SEQ ID NO: 74843 - protein, 181 aa, Zea mays
  misc_feature: Ceres CLONE 1559256
  misc_feature (1)..(148): Pfam Name: Pkinase_Tyr Pfam Description: Protein tyrosine kinase
  misc_feature: SWISSPROT Homolog: EC 2.7.10.2 Non-specific protein-tyrosine kinase
MSINLRLSSMRDLEPSNILRDDTGHLKVADFDLCKMLKWRRKVREDKAVTSPGNACKYVAPEVLRNEEYDTKVDVFSFALILQEMIEGCLPYYDKKNDEIEKAHNSKERPPFRAPPKHYAHGLRELIEQCWSENSADRPDFRVIINRLSAIQNEIAHRNRWKARPLKCFLSIEGMWEERSQ

SEQ ID NO: 74844 - DNA, 802 bp, Zea mays
  misc_feature: Ceres CLONE 1559258
  misc_feature: Encodes the peptide sequence at SEQ ID NO. 74845
  misc_feature (538)..(538): n is a, c, t, g, unknown, or other
ggagctccccgcggtggcggccgctctagaatagtggatcccccgggctgcaggaattcgtctcacccctagaaaaaatcctctcgctcgccaggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgatatggtcttgaagttggtctgaccaactatgcagctgcctacgactggactctgtggctcgcgtgtgctaaagatcgtgtttgataggagtatgaggcatgttgagcactggtgagactctctgtgagccactgatgaagaggcattcngcgcccctggatgtggcttacagactcaaagggaccggctttgggcctcaggaactttgatggggccggaatcccccagcaaaaaaagttgccgattcaaaggaaacaacattggatctgatccccccagggctttttgggggccgttgcgaacaatgaaaaaccggcgggaaggaccccaaaattcccaacccctttgggggtctcttaaaaggggtggggcggggaaattaacccccccacaaaagttctcccccccccccg

SEQ ID NO: 74845 - protein, 113 aa, Zea mays
  misc_feature: Ceres CLONE 1559258
  misc_feature (27)..(113): Pfam Name: Ribosomal_L18p Pfam Description: Ribosomal L18p/L5e family
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYDWTLWLACAKDRV

SEQ ID NO: 74846 - DNA, 936 bp, Zea mays
  misc_feature: Ceres CLONE 1559259
  misc_feature: Encodes the peptide sequence at SEQ ID NO. 74847
  misc_feature (749)..(749): n is a, c, t, g, unknown, or other
tggagctccccgcggtggcggccgctctagaactagtggatcccccgggctgcaggaattcgtctcacccctagaaaaagccccgaattatattcattcattcatcccagccgaagagcaccaagcttcgctagcagcatatacgcatccatcccactggaaacagaccaaccctaccctaccctgcagcgcgcgcagagggggaaaggagctccagcaaaaagtttgtccagctcctcctcctactacagcgctacaaggatctgatcatcgagcagcatggcgcggcggccgcagcccatgcccaacctggtgcccacgctcctcctgctcgtcgtcgtggccgccgccgcggcggtcgtgagagccgacgacgacgagaagtgcagcaacccgtgcgggaacccctgcggcgagccgtgcgtgtacgccagcccgccgccgccgccgacgcccgtgtactcgcccccgcccccgccgccgacgcccgagtactacccgccggcgaccccgaccccgaccacgccctactggcccgccgccgccgtcgggcggcggctgctacgagccgtcgcccgggtaacacgcgtcgacgccctaaacgcccggttacaacccccacgccctccgggtccggttggtacgcgccgccctaaacgccgccgtcggaaggtaccctggtaccccagggaccccgggttccgggcaaaagcccggcccgggggggcgccgaaccctttttttccttnccggaggggggggctggcccgttttcgggttgttggagcccaccccccgaacgatggaggccccaaaccgcccctgtgggtggggtagggcccaaaacctggccccttgggggggcccttctaagccccccaaattggttgggtgtttttccccccccccggggggtgtaaaaaaaaaggagaggtt

SEQ ID NO: 74847 - protein, 185 aa, Zea mays
  misc_feature: Ceres CLONE 1559259
  misc_feature (157)..(157): Xaa is any aa, unknown, or other
MARRPQPMPNLVPTLLLLVVVAAAAAVVRADDDEKCSNPCGNPCGEPCVYASPPPPPTPVYSPPPPPPTPEYYPPATPTPTTPYWPAAAVGRRLLRAVARVTRVDALNARLQPPRPPGPVGTRRPKRRRRKVPWYPRDPGFRAKARPGGAPNPFFPXRRGGLARFRVVGAHPPNDGGPKPPLWVG

SEQ ID NO: 74848 - DNA, 968 bp, Zea mays
  misc_feature: Ceres CLONE 1559260
  misc_feature: Encodes the peptide sequence at SEQ ID NO. 74849
  misc_feature (697)..(697): n is a, c, t, g, unknown, or other
  misc_feature (752)..(752): n is a, c, t, g, unknown, or other
ctggagctccccgcggtggcggccgctctagaactagtggatcccccgggctgcaggaattcgtctcacccctagaaaaagcagggcctctcgatcgctcatcagtcgccagaggagtagttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacaaggcgaccggggaggccatcaagcactcgctggggcagtcccacccggtgcgcctggtgccctacaacccggactttttggacgagtcggtgctgtggacggagagccgcgacgtcggcaacggcttccgctgcgtccgcatggtcaacaacatctacctcaacttcgacgccctccacggcgacnagtggcacggcggcgtccgtgacggcaccgacgtcgtgcttctggaagtggtgcngagggcgacaccagcgctggaagatccagccctactactgaaccaacggatgatatgaccatcgcgcccatcgatcgtgcacatgcatgcatacgtactagcagaataacagggggtctatctcccgaggcgtcttttgcatgcatgccagcagttgcatagataagcagaacccagacaaaggtggttctggttaattgcacccgtatcacggat

SEQ ID NO: 74849 - protein, 211 aa, Zea mays
  misc_feature: Ceres CLONE 1559260
  misc_feature (175)..(175): Xaa is any aa, unknown, or other
  misc_feature (193)..(193): Xaa is any aa, unknown, or other
MDGGYYGGRDQRYSGGYYGGGGIATPGYAPAVPYGMSQVNIEGNGCGRALPPQPTVKVYCRANPNYAMSVRDGKVVLAPANPKDEYQHWIKDMRWSTSIKDEEGYPAFALVNKATGEAIKHSLGQSHPVRLVPYNPDFLDESVLWTESRDVGNGFRCVRMVNNIYLNFDALHGDXWHGGVRDGTDVVLLEVVXRATPALEDPALLLNQRMI

SEQ ID NO: 74850 - DNA, 955 bp, Zea mays
  misc_feature: Ceres CLONE 1559261
  misc_feature: Encodes the peptide sequence at SEQ ID NO. 74851
  misc_feature (790)..(790): n is a, c, t, g, unknown, or other
  misc_feature (812)..(812): n is a, c, t, g, unknown, or other
  misc_feature (823)..(823): n is a, c, t, g, unknown, or other
  misc_feature (892)..(892): n is a, c, t, g, unknown, or other
ctggagctccccgcggtggcggccgctctagaactagtggatcccccgggctgcaggaattcgtctcacccctagaaaaaacctcaccagcctcctcgtccccgatctcctcccacccgcatccaagggtttccttctcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgccaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagggtgaaggctatagccgaaatatttgctgacgctgggttttcagatgttacaaagaatttcttggctgtcctggcggacaatggcaggctgaaatatattgaacgcattgcggagagatttgttgatttgactatggaacataaggcggagatgtacggttgtggtcaggacagttatttcactcacctaggaggaggagaaagactcaaggaaaccttgcaggatatccttggggaaaacaaaactattttggttgaacagaagattgactacagcatcatgggaggattagtgattgaattcnggcagaaggtgcttgatatctncatcaggaacnggcgaagcaattgaggcgtttcttgagcacccactgacttctacagccttttggataaagagcatctcngaatgcaaagctggtcctgttaaaagtttccctgggccgccatttaatccggccctttgaaaa

SEQ ID NO: 74851 - protein, 222 aa, Zea mays
  misc_feature: Ceres CLONE 1559261
  misc_feature (56)..(218): Pfam Name: OSCP Pfam Description: ATP synthase delta (OSCP) subunit
  misc_feature: SWISSPROT Homolog: EC 3.6.3.14 H(+)-transporting two-sector ATPase
  misc_feature (208)..(208): Xaa is any aa, unknown, or other
  misc_feature (215)..(215): Xaa is any aa, unknown, or other
  misc_feature (219)..(219): Xaa is any aa, unknown, or other
MAAARHLRSGLPLLRAHLASSESAAVAQVSRGFASQAAKPTGKEIKVPKALFGGTGNYASALFLTAAKSNALDKVESEIKAIVEASKKSPLFSQFIKDLSVPKATRVKAIAEIFADAGFSDVTKNFLAVLADNGRLKYIERIAERFVDLTMEHKAEMYGCGQDSYFTHLGGGERLKETLQDILGENKTILVEQKIDYSIMGGLVIEFXQKVLDIXIRNXRSN

SEQ ID NO: 74852 - DNA, 966 bp, Zea mays
  misc_feature: Ceres CLONE 1559263
  misc_feature: Encodes the peptide sequence at SEQ ID NO. 74853
  misc_feature (788)..(788): n is a, c, t, g, unknown, or other
ctggagctccccgcggtggcggccgctctagaactagtggatcccccgggctgcaggaattcgtctcacccctagaaaaagttccacaaccctcgagaagcttccaccctcccctcctgcgacgccgccagagccgcggaaaccctacccaccccggccgctcacgcaccgggcgcccgcagccgccggtcgcgtgcctgccgccgacaccgcccaaagcgattggatctcgagatcgtcgaagccacgatggaggactgggattctgaagaattccagccagttgtgcctgttgtgaaagccgagccacttaaaaatcagtgggctgatgaagatgttgaagaagatgatgtaaaagaatcatgggaagaagaggaggaggaggagaaacctaagccagcgccagtggaaaaggtcgctgcaaaacctagcactaaggctcctgctaaaaagggaaaacaacaagcattgacaagtgctgaagaaccagatgagcctcctcttagtcccacttcacagaaaattcgccaacaaagacttgtggaagaagctgacttcaagtcgaccaccgagctttttgcaaagaagggcagtgagcaaaagtcactagatacttttattccaaagtccgagagtgactttgcggaatacgcggagcttattgcaaacaaactacgcccctatgagaaaagctttcactacatggctctgcttaagaatgtcatgagactttccatgacatcgttgataggtgcggacgcctagatatatcttcttccgtgacggcnattgctaacgagaagatcaggctgagaaggagctgcacaggctaaaagaactagagcgaaaagagcactcacatcgagaaagagacgacactcatccccggcctggttggtgctacaatgaccccgatgatccaacttctgtgactggctgggaaagaaaagaaggttccggtaggaa

SEQ ID NO: 74853 - protein, 171 aa, Zea mays
  misc_feature: Ceres CLONE 1559263
  misc_feature (1)..(172): Pfam Name: eIF3_subunit Pfam Description: Translation initiation factor eIF3 subunit
MEDWDSEEFQPVVPVVKAEPLKNQWADEDVEEDDVKESWEEEEEEEKPKPAPVEKVAAKPSTKAPAKKGKQQALTSAEEPDEPPLSPTSQKIRQQRLVEEADFKSTTELFAKKGSEQKSLDTFIPKSESDFAEYAELIANKLRPYEKSFHYMALLKNVMRLSMTSLIGADA

SEQ ID NO: 74854 - DNA, 955 bp, Zea mays
  misc_feature: Ceres CLONE 1559265
  misc_feature: Encodes the peptide sequence at SEQ ID NO. 74855
ctggagctccccgcggtggcggccgctctagaactagtggatcccccgggctgcaggaattcgtctcacccctagaaaaattatagcccctgtacctatgggagttccagctacgacaggtatgggaggctttgaaaggccgactgctaagggtgacatcttgcggtcagatgcaagtgcagcgctaaatgtcggtgttctccatcttgtacccacattggatgtatttccattgttggaagatccaaagacgtatgaaccaaacacaattgatcttgaccaggatgagttcaagtactggttcaagattttgtcagatcattcgccggacctcgtggacaaggcagttgctagtgaaggtgggactgatgatgccaaaagacggggtgatgcatttgcacatgccttttctgctcatctggcaaggttagattgatggaggagccagctgcttatggaaaagtttggttttggccaacctgtggaattgagagaaagatgtctgaaggaatttccagtcgttgatgcatatattagcatcaagcaaaaggaaaatgaaccttccctgcctgttttaccggatcctccggatgaaacctgatagtatgaattggaggagcctagcctgcctggccctaattgaaagggggccttggcgcaaatttattttaatttggggggccccaactttggtaaaaatttttccccaaggagactttaattaaaaacctttcccaaggattcccaaaaaaaatcccccccccctgggggagattagaaaactttacattttccaaaaaaaaaagcctctcctgaagaaaaccccccttccaaaaaaccccccgttttttttaaaaaacccgggggaatagtggcccccgaaacaccccctttaagggggggtttttccccccaaaaaaaaaagttttttttttaaaaatattcgggcgggtat

SEQ ID NO: 74855 - protein, 112 aa, Zea mays
  misc_feature: Ceres CLONE 1559265
  misc_feature: SWISSPROT Homolog: EC 2.7.1.33 Pantothenate kinase
MGVPATTGMGGFERPTAKGDILRSDASAALNVGVLHLVPTLDVFPLLEDPKTYEPNTIDLDQDEFKYWFKILSDHSPDLVDKAVASEGGTDDAKRRGDAFAHAFSAHLARLD

SEQ ID NO: 74856 - DNA, 918 bp, Zea mays
  misc_feature: Ceres CLONE 1559266
  misc_feature: Encodes the peptide sequence at SEQ ID NO. 74857
  misc_feature (573)..(573): n is a, c, t, g, unknown, or other
  misc_feature (714)..(714): n is a, c, t, g, unknown, or other
tggagctccccgcggtggcggccgctctagaactagtggatcccccgggctgcaggaattcgtctcacccctagaaaaaattcccattcccacccgtccatccatcctccgaagctcctcggcagacaagcagcagcgagagaaagcaagcaaggcagaggcagttgtgttgctggtcggtccgtccatggcgcccaagagaccagtgtcggcggcggcggcggcggagcagccgaggctgcgcggcgtgcggaagcggccgtggggccggtacgcggcggagatccgcgacccggtgcggaaggcgcgcgtgtggctgggcaccttcgacacgccggagcaggcggcgcgggcgtacgacgccgccgcgcgcaagctccgcgggcccggcgccgccaccaactaccccgccccggagccgacggcggaggcggttgggcgggggctccagcggcgagcgggagcgggagcgccgtggtgtacgagtcgtcgtcggcgtcggcgtcggcgtcgtcgtgctccctgccgctgggcgccccgtcgctggacctcagcctggcgctgccggctgcngcgcggccgcagagccgtaccagctgttccccgaaccggcggcggcggccgccgtgacgccgggcctgctgaatttcttgccccccaaaaacgaggaccaccaaaactcccctggggtctccgcccctgtccccctcctcnttctccggtaatgtttcaaacccggcccccccccggggggcctggggttgggccccaaacttgggcttcccccccggcccaaaaagggggaaagggaattgcccccccccccaagagggataaaacatttgcccccttttattttggccccccttttgtgggcctaaaccataaagggggccccctttcggggaagaaggtaat

SEQ ID NO: 74857 - protein, 243 aa, Zea mays
  misc_feature: Ceres CLONE 1559266
  misc_feature (16)..(67): Pfam Name: AP2 Pfam Description: AP2 domain
  misc_feature (129)..(129): Xaa is any aa, unknown, or other
  misc_feature (176)..(176): Xaa is any aa, unknown, or other
MAPKRPVSAAAAAEQPRLRGVRKRPWGRYAAEIRDPVRKARVWLGTFDTPEQAARAYDAAARKLRGPGAATNYPAPEPTAEAVGRGLQRRAGAGAPWCTSRRRRRRRRRRAPCRWAPRRWTSAWRCRLXRGRRAVPAVPRTGGGGRRDAGPAEFLAPQKRGPPKLPWGLRPCPPPXSPVMFQTRPPPGGPGVGPQTWASPPAQKGGKGIAPPPKRDKTFAPFYFGPPFVGLNHKGGPLSGKKV

SEQ ID NO: 74858 - DNA, 941 bp, Zea mays
  misc_feature: Ceres CLONE 1559267
  misc_feature: Translation starting site: 331
  misc_feature (902)..(902): n is a, c, t, g, unknown, or other
ctggagctccccgcggtggcggccgctctagaactagtggatcccccgggctgcaggaattcgtctcacccctagaaaaaatcagccatgcccttttgctgcacatctttctctgaattgtgggtctccgactatggcggggctagctccatccaagattctgggcgacccagatcatcttggccggctcctcccgctacgccaccgcagcgaccaccgctggggctcagaagattgtctcccttttcagcaagaatgctgcccagaagcccagacccgctgcggtatcgtgctcttctccagatatcaacgacgagctcgccgagtggcatggccctgacaggagggatctacctgcccgatgggctgctggaccggtcggacgtgcccgagtacctcaccggagacgtccctggagactatggctacgacgcttttggactgggaaacaagccagaggacttcgccaagtaccagtgactaccagctgatccatgccagatgggccatgctcggtgcctctggcgctgtcagtcccaaaagcctgcaacacgttcaccgctaactgtggccctgatgctggctggttcaacaaccgtgcgctgctcctggacggaacaccctcaactacttcggcgacagcatcgcatacacctggtgctggccctgatcgcagatgtcatcctcgtccgtcgcggcgagttctaccggatcacgaaccgactggatctagaagacaactagctcctagtgggcccttacgacctctgagcctgccagcgacccagaacagccgccatctcaagaggaaggaaataagaacggcggctggccatgttcacatgttcacgttctgctcatgcctaagtccacgggaaagcccagtggacaacttgaaaggncctaccgaccctttagccatagctggataccctggttcc

SEQ ID NO: 74859 - DNA, 831 bp, Zea mays
  misc_feature: Ceres CLONE 1559268
  misc_feature: Encodes the peptide sequence at SEQ ID NO. 74860
  misc_feature (390)..(390): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (415)..(415): n is a, c, t, g, unknown, or other
  misc_feature (416)..(416): n is a, c, t, g, unknown, or other
  misc_feature (525)..(525): n is a, c, t, g, unknown, or other
  misc_feature (554)..(554): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (563)..(563): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (705)..(705): n is a, c, t, g, unknown, or other
  misc_feature (706)..(706): n is a, c, t, g, unknown, or other
  misc_feature (708)..(708): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (744)..(744): n is a, c, t, g, unknown, or other
  misc_feature (751)..(751): n is a, c, t, g, unknown, or other
  misc_feature (752)..(752): n is a, c, t, g, unknown, or other
  misc_feature (787)..(787): n is a, c, t, g, unknown, or other
  misc_feature (807)..(807): n is a, c, t, g, unknown, or other
  misc_feature (814)..(814): n is a, c, t, g, unknown, or other
ggagctccccgcggtggcggccgctctagaactagtggatcccccgggctgcaggaattcgtctcacccctagaaaaagaacttggtagctgtggcgttgccgaaatgggcgctccctaccacctccaatcaccaagaaccatcataaccaaggtaatgagcatgaagcagctgccaccggccctgccacagctgccgccgccgccggtggatcagtccgaggtgaccgagcagacaccggtgctgccacggtcgcagccggtggatcctaccctacgaataaccaggcagccacaggcgccccggcagccagcgcgggcgccttccaaggtaatcctgcaaccgcgccagcggacctcgccggcgaaatgtggtgcgcgggcccatcgncttgggctttcgcccttttnnnngnnaattcctcccctcatcggccgcagggcgtcgttccccccctgggccctcctttcccgggggggggggaaaaacccaaaaaggcccccccccctcccccgctttttcaanagcgccgcctataaaacccccacttccanacannnccnccaaaagcccccttttcgttgggggaaccccccccnnnngggggccgccccccccctttttttaataaaaaaaaaaaaannnnnnaaggaagagcggcttgggggagaaaaaaaaaaattcatccccccaccccacccccannanaagggaaaggggagggnnnnaagagaaagacaaacnacggggnnttttttttaggttgtttgcgccccccgacccggcncggggacgagagagaagccnacatttnttccccattgcggagaa

SEQ ID NO: 74860 - protein, 218 aa, Zea mays
  misc_feature: Ceres CLONE 1559268
  misc_feature (102)..(102): Xaa is any aa, unknown, or other
  misc_feature (103)..(103): Xaa is any aa, unknown, or other
  misc_feature (104)..(104): Xaa is any aa, unknown, or other
  misc_feature (140)..(140): Xaa is any aa, unknown, or other
  misc_feature (150)..(150): Xaa is any aa, unknown, or other
  misc_feature (151)..(151): Xaa is any aa, unknown, or other
  misc_feature (152)..(152): Xaa is any aa, unknown, or other
  misc_feature (153)..(153): Xaa is any aa, unknown, or other
  misc_feature (165)..(165): Xaa is any aa, unknown, or other
  misc_feature (166)..(166): Xaa is any aa, unknown, or other
  misc_feature (180)..(180): Xaa is any aa, unknown, or other
  misc_feature (181)..(181): Xaa is any aa, unknown, or other
  misc_feature (200)..(200): Xaa is any aa, unknown, or other
  misc_feature (201)..(201): Xaa is any aa, unknown, or other
  misc_feature (207)..(207): Xaa is any aa, unknown, or other
  misc_feature (208)..(208): Xaa is any aa, unknown, or other
  misc_feature (216)..(216): Xaa is any aa, unknown, or other
MGAPYHLQSPRTIITKVMSMKQLPPALPQLPPPPVDQSEVTEQTPVLPRSQPVDPTLRITRQPQAPRQPARAPSKVILQPRQRTSPAKCGARAHRLGLSPFXXXIPPLIGRRASFPPWALLSRGGGKNPKRPPPLPRFFXSAAYKTPTSXXXXQKPPFRWGNPPXXGAAPPLFLIKKKKXXKEERLGGEKKKFIPPPHPXXKGKGRXXRERQTTGXFF

SEQ ID NO: 74861 - DNA, 965 bp, Zea mays
  misc_feature: Ceres CLONE 1559269
  misc_feature: Translation starting site: 162
  misc_feature: SWISSPROT Homolog: EC 2.3.1.167 10-deacetylbaccatin III 10-O-acetyltransferase
  misc_feature (839)..(839): n is a, c, t, g, unknown, or other
  misc_feature (924)..(924): n is a, c, t, g, unknown, or other
ctggagctccccgcggtggcggccgctctagaactagtggatcccccgggctgcaggaattcgtctcacccctagaaaaaatcggtcgtgaaaagaaaaagggaaacaaaccaagctagagaaaagaagaaggtactacatactagctagctagcttagctatgggcaccatcgtcgacgctgacgtcgggttcgcggtgaagaggacgagcaggtcgctggtgccgcctgcgtcggcgacgccgcgggagacgctgcggctgtcggtgatcgaccgcgtggcggggctgcgccacctggtgcggtcgctgcacgtgttcgccgcgggcggcgacaagaagcggcagcaggcgacggcgacgccggccaaggcgctgcgggaggcgctggggaaggcgctggtggactactacccgttcgcggggcggttcgtggtggtggacgcggagggcggcggggagacgtcgggtggcgtgcaccggcgagggcgcctggttcgtggaggccaacgccgcgtgctcgctcgaggaggcccgccacctcgaccaccccatgctcatccccaaggagcagctgctgccggatccctcgccggacgtcaacccgctggacatgccgctcatgatgcaggtgacggagttctcgtggcggcggcttcgtggtggggctcatctccgtgcacacgatcgcggactgcctgggcgcgggcagtcatctaacgccgggtggcggcgtacgcgccgggcgccacgtcgccacccccaaccccctgtgggcgcgcgacgtgatcctgacccgtccagattgcggcgccgcgccccgcctgggactgctggacntgcctacttcacggggacctgacccgacccattcggcaggtgtagccccgtacctgtagtccacggcacccgccccggttttttnaagtggggtgggcccactttggagcccccttggcccccttt

SEQ ID NO: 74862 - DNA, 945 bp, Zea mays
  misc_feature: Ceres CLONE 1559270
  misc_feature: Encodes the peptide sequence at SEQ ID NO. 74863
  misc_feature (828)..(828): n is a, c, t, g, unknown, or other
tggagctccccgcggtggcggccgctctagaactagtggatcccccgggctgcaggaattcgtctcacccctagaaaaaaaaaactccgtttcgaattctagggttttgctgctctccgaccccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagatacctttcctgtacctcgcaagggaagctggctggtgatccgaaccttcactttgttgaagctgttgctcttaagcctccggaaagtaccatcgacatggctatgcagcagcagcatgaagctgagcttgctgcagcagctgcacaccctcttcctgatgacgatgagnatctgattgagtagaaagatcatgagtctgaactggaccagatttgtgccttgccggtttaaaagtggtctagggggaaccctggagtccccatgggcggaaaccttttttccctgt

SEQ ID NO: 74863 - protein, 173 aa, Zea mays
  misc_feature: Ceres CLONE 1559270
  misc_feature (15)..(173): Pfam Name: Ras Pfam Description: Ras family
  misc_feature (15)..(128): Pfam Name: Miro Pfam Description: Miro-like protein
MALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEIPFLYLAREAGW

SEQ ID NO: 74864 - DNA, 935 bp, Zea mays
  misc_feature: Ceres CLONE 1559271
  misc_feature: Translation starting site: 192
tggagctccccgcggtggcggccgctctagaactagtggatcccccgggctgcaggaattcgtctcacccctagaaaaagcgtggtccttctcctgctcccgctcccgctgctcctcatcttctcgcgccgcggcccccagcctttgcccgccgctacctctctctaattgggcggcggcctgccggtccgatggcgttcaactaccacgaccacgcgctggcgatggaccccgcggcggccgccgcggttggggcggccgcgaaccctagctttgtctccggaggtggcatggccggggggcccggctgggagagggagaaggcggccatcgcggcgcacccgctgtacgagcgtctactcgaggcgcacgtcgcctgcctccgcgtggccacccccgtcgaccagctcccgcgcatcgacgctcagatagcggcgaggcccccgcccatggaggccgcggctgcggctgctgcggagggcggagcacactcgggaggcgaggaactcgacctcttcatgacacattatgtgttgctcctctgttcattcaaggaacaactcagcagcatgtgcgtgttcatgcaatggaagcagccatggcttgttgggagctcgaacaaactttacaaagccttacaggtgcatcccctggtgagggccctggagcaactatgtctgacgatgaagacaatcaggtggacagtgagagcaacatgtttgatggaaatgaggggccagatgggaatgggatttggccctttatggtgactgagggtgagagaaccttattgaaccgcgtccggaggaactaaagatgagcttaagcaggggaaaaaacaaacttgggtgaattcaggaagaaatatggggtaacgaaaagttgggaacccctgggaactggctttaccttaaagattggggccagcccatctt

SEQ ID NO: 74865 - DNA, 947 bp, Zea mays
  misc_feature: Ceres CLONE 1559272
  misc_feature: Encodes the peptide sequence at SEQ ID NO. 74866
ggagctccccgcggtggcggccgctctagaactagtggatcccccgggctgcaggaattcgtctcacccctagaaaaagctaccccctcgcctcgccctcgccgcctgctcctctccagttctcccccaccaaccgcagcagcgagagcgagactgagaatggccgcggcgccgtcgtccctcgtgtcctcccatctctcccgcctcgccgacctccgccgcgcggcggcgccggccactcccaccgtcccacagcagcttcgcgtcggcttctcgcgccgccgcgcccagcgcgtcgtcgccatggctggatccggcaagttcttcgtcggaggcaactggaagtgcaacggaacaaaggactccgttagcaagcttgtctctgaactgaatgctgctaccctcgaaactgatgtagatgttgtggtggctcctccattcatctatatcgatcaggtcaagaattcactaacgggtcgcattgaggtttctgctcagaatgtgtggattggaaaaggaggagcctacaccggagagatcagtgcagaacaactggtggacatcggttgtcaatgggttattcttggacactcagagcgtagacatattattggtgaaaatgacgagtttattggggaagaaagctgcatatgcattgagccaaaatgttaagggtattgcctgcataggagagcttctggaagagaggaaagcagggaaactttttgaagtatgtttgagcagatgaaggcttttgcagatagatttcaaactgggccgatgttgtgatgcatatgagcctggttggggctatggacccggaaaagttgctactctgagcagcccagaaagtcatgctgctgtacccgattgttgacaacaacatatcactgatgttgctcctgcaccgaatatctatggagtctggttatgcacaactgtgcaat

SEQ ID NO: 74866 - protein, 170 aa, Zea mays
  misc_feature: Ceres CLONE 1559272
  misc_feature (55)..(170): Pfam Name: TIM Pfam Description: Triosephosphate isomerase
  misc_feature: SWISSPROT Homolog: EC 5.3.1.1 Triose-phosphate isomerase
MAAAPSSLVSSHLSRLADLRRAAAPATPTVPQQLRVGFSRRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGEESCICIEPKC

SEQ ID NO: 74867 - DNA, 944 bp, Zea mays
  misc_feature: Ceres CLONE 1559273
  misc_feature: Encodes the peptide sequence at SEQ ID NO. 74868
  misc_feature (664)..(664): n is a, c, t, g, unknown, or other
  misc_feature (674)..(674): n is a, c, t, g, unknown, or other
  misc_feature (745)..(745): n is a, c, t, g, unknown, or other
gctggagctccccgcggtggcggccgctctagaactagtggatcccccgggctgcaggaattcgtctcacccctagaaaaagcaggcaccccagcagctcttgcggtcgtccctcagccgcgtcgcaccgcatcgcattctacgattcgaagctctctgctcgcaggggaccatggcgaagaactacccaaccgtgagcgccgagtacagcgaggccgtcgagaaggccaggcgcaagctccgcgccctcatcgccgagaagagctgcgcacccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgacttctaccagcttgccggagttgtggccgtcgaggtcaccggtgggcctgagatccccttccacccaggcagggaggacaagcctcagccgccacctgagggccgtcttcctgatgccaccaagggttctgaccacctgaggcaagtctttggcaagcagatgggtttgagtgatcaggacatcgttgccctctctggtggcacaccnttgggaggtngccacaagagcggtctggttttgagggtgcctggactacgaaccccttgggtcttgacaactctttactcnaggaacttctgagtgggtgacaggaggccctcttcagctccaaagtgacaaagcctgctgagcgaccctgtcttccgccctcttgtggagaaattgctgcaaatgaaaagcatttcttgatgactacaaagagcccacctcagctctccgaactggggatgctgaagctaaatggtccatatctggagcgggaccaacc

SEQ ID NO: 74868 - protein, 194 aa, Zea mays
  misc_feature: Ceres CLONE 1559273
  misc_feature (19)..(191): Pfam Name: peroxidase Pfam Description: Peroxidase
  misc_feature: SWISSPROT Homolog: EC 1.11.1.11 L-ascorbate peroxidase
  misc_feature (168)..(168): Xaa is any aa, unknown, or other
MAKNYPTVSAEYSEAVEKARRKLRALIAEKSCAPLMLRLAWHSAGTFDVSSRTGGPFGTMKCPAELAHGANAGLDIAVRLLEPIKEEFPTLSYADFYQLAGVVAVEVTGGPEIPFHPGREDKPQPPPEGRLPDATKGSDHLRQVFGKQMGLSDQDIVALSGGTPLGGXHKSGLVLRVPGLRTPWVLTTLYSRNF

SEQ ID NO: 74869 - DNA, 948 bp, Zea mays
  misc_feature: Ceres CLONE 1559276
  misc_feature: Encodes the peptide sequence at SEQ ID NO. 74870
ggagctccccgcggtggcggccgctctagaactagtggatcccccgggctgcaggaattcgtctcacccctagaaaaaggagaaggcgaggaccatggcgcgcaggctggagatcccccagtggaaggccgacggcctgccgtcgccgacgagcccgctggaccgcgcgtcggcgtcgccccgtgggtggcgccaccgcgacgccgtaggaggaggcgtggggctcgggatcctggcggcgctcgaggccgagggcccgccgcagcccgcgccgagggtgtccatcccgcggcgcgcggcgcggctggaggtgtcggagctcgggtgcagcgggcgctgcgccaccagcctgtgcggcggcgtcggcccggcccccgcccggcccggcggcggcgcggcgttccgcgtcgcggagttcctgtcgtgctgcgacatgtgccggcgggcgctggacgggagggacatcttcatgtacccgcgggagaaagccttctgcagcatggagtgccggtaccacgccatggtgagcgacgagttccagcaggagaaggagcgcaagcgccgcggcgccgtgtcccggacttcgccgcggaaatggccgggttcgcttgcatcggcgggcggcggcggcgggcatatttcttcccccaccgggattcttccccgcctgattgggggggcgggcgggcggatacggatcccgcctcccgggggcaggggaacaaaacaaagaaaaaaatcccccctgaaggaacccggggccggtgttacttaaccctgcaagggaaaaaaacccgggggaaattggggccggggggggcgccgctttttgtaaaaccaaaatagggcgggggggaattttccccccccccccccctcccccgggagaggaccccgcggggggggggtttttcccggggggttttttttttgttaaataaaaaaaaa

SEQ ID NO: 74870 - protein, 226 aa, Zea mays
  misc_feature: Ceres CLONE 1559276
  misc_feature (93)..(150): Pfam Name: DUF581 Pfam Description: Protein of unknown function (DUF581)
MARRLEIPQWKADGLPSPTSPLDRASASPRGWRHRDAVGGGVGLGILAALEAEGPPQPAPRVSIPRRAARLEVSELGCSGRCATSLCGGVGPAPARPGGGAAFRVAEFLSCCDMCRRALDGRDIFMYPREKAFCSMECRYHAMVSDEFQQEKERKRRGAVSRTSPRKWPGSLASAGGGGGHISSPTGILPRLIGGAGGRIRIPPPGGRGTKQRKKSPLKEPGAGVT

SEQ ID NO: 74871 - DNA, 1020 bp, Zea mays
  misc_feature: Ceres CLONE 1559277
  misc_feature: Encodes the peptide sequence at SEQ ID NO. 74872
  misc_feature (416)..(416): n is a, c, t, g, unknown, or other
  misc_feature (1000)..(1000): n is a, c, t, g, unknown, or other
ctggagctccccgcggtggcggccgctctagaactagtggatcccccgggctgcaggaattcgtctcacccctagaaaaactcctcctctatcttcgcatctggcacgagcagccaagcaaataaaagtagagcggcgagcgacgaccggcctgggccactctttcggccgagcgtagccagcaggtcgtcgtcgtcgtcgtcgtcgcagcacccggccggctagcatggccacgaggaggcagtggtggtggtggtgcctgctgctgctggcggcgtggtgctgcgccgcggccgcgcagtcgccgccggcggcggacccgctgcagagcaagtgccagggggacttcgggaagctgacggactgcatggactacgcgacggggcacgcggcgtcgccctcgtccacctgctgcngcgacgccggcgacacggaaatatgcggcgccccgagtggctctgctacatcatccagcagacgcccacgggggcgccacccaggtgcagtcgcctcggactgggccttcgaccgaactaatgggcgcttcccccccgccttggaaacctcccaaaacccccaaggtttcgggttttggattaacccctgggttaaaaccttaaaaccggggggttttggggaagaaaaaccccctttttttggcaaaaagccctcaaaaaatataaccccctttaagccggggggggaacccccgggaaaaggaaaaaccccccccggggaaaaagggggattaaaaccccggggtgggggggagaaagggggggggtcccccccctccccgggtggtccccacaaagaacccccttatatttttttttggaggggccccccccctcttacaagaggaggcggggggttgttttttttcccccccgggggggtgttttttcgcgggggggtcccccccccatttttttctcttttttttttcccaaaaaaaaaaaaaggcgcgggggaggtgggccccccccctccccgcccnttgtttttgggagaaaaaat

SEQ ID NO: 74872 - protein, 264 aa, Zea mays
  misc_feature: Ceres CLONE 1559277
  misc_feature (64)..(64): Xaa is any aa, unknown, or other
MATRRQWWWWCLLLLAAWCCAAAAQSPPAADPLQSKCQGDFGKLTDCMDYATGHAASPSSTCCXDAGDTEICGAPSGSATSSSRRPRGRHPGAVASDWAFDRTNGRFPPALETSQNPQGFGFWINPWVKTLKPGGFGEEKPPFFGKKPSKNITPFKPGGEPPGKGKTPPGEKGGLKPRGGGEKGGGSPPSPGGPHKEPPYIFFWRGPPPLTRGGGGLFFFPPGGVFFRGGVPPPFFSLFFFPKKKKGAGEVGPPPPRPLFLGEK

SEQ ID NO: 74873 - DNA, 726 bp, Zea mays
  misc_feature: Ceres CLONE 1559281
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (590)..(590): n is a, c, t, g, unknown, or other
  misc_feature (651)..(651): n is a, c, t, g, unknown, or other
ggtgggggcggcccgcgggggggggcacgggccnnncnnnngnnncggggggccccggagcgccctcggagcggttttaagagctggactccacctcgtggcggccgctctagaactagtggatcccccgggctgcaggaattcgtctcacccctagaaaacatcagtcatcacccaccgcctccgccgccgacaacagcgtagtgtagtgtagttccggagaaggttggggagagtagtagtgatccgcaatgtcaacggaagaggctgttgtggctgaagtccccggtgaccgaagtgccagcggaggttccgggcggcccatggtggcccgaagcggcccaaaggcgaaaaaaaggcccccaagggaaaaaaaaaaggcccccaaaaggaaaaaaaaaaaaactttttcccccccggggcgaaaaaaaaaaaccccgggggggggggggaaaaaccccttttcccccttaaaacaacctttggaaaaaaaaggggaaatttgggggaaaaaaaaaaggagcccaaaaaaaaacggccctgggggcccccccccccctaaaggggggaaaaaagagggaaaaaagggnggggggtgccccaaaaaaaaaacccccccccgcgggggggggggggcaaaataatttatgnaaaaaaaaaagttttcccacctttccctaaaagggggggggaaaaaaaaaaacccttgttgggggcgggggcaaa

SEQ ID NO: 74874 - DNA, 947 bp, Zea mays
  misc_feature: Ceres CLONE 1559282
  misc_feature: Encodes the peptide sequence at SEQ ID NO. 74875
  misc_feature (765)..(765): n is a, c, t, g, unknown, or other
ctccccgcggtggcggccgctctagaactagtggatcccccgggctgcaggaattcgtctcacccctagaaaaaaagcgacagaacagcctcaggaggcacccccgcggttagtctcgaagcttccgttcggaaccagggttagggtttcgcgtcctcccgtcgtcatcctcagccatgtccgggcgcgaggtccgcgagtacaccaatctcagcgaccccaaagacaggaagtttggtaaagggaaggataagatcgacgatgaggacatcaccttccagcgcatggttgcaaagatgcaagaggttgctggtgataggggaggctaccttcacggacgaggagcattggacagcgatgatttgctttacctgaaagagcaaatggaagctgaggaagatgcagagcgccttcttcgtcatactgagaagcgggcatttgctgcttttaagaaagcagcaattttagctgattctacacctgctgtccctgtggctcttcgtgttgaacctaaacctaaaagtgatataaggcaacaagatcttttgaagaacattgttgggatcaaaccaaagcgaccaaaagttagcagcccttcacagccaccagatagctataagcctaaacatacgggagaagacctggtcagcgagttgtcgtcatcaccggatcccgttgggacatctcatgggactgcgaatcctgaccacccagcgccaaaggtagatgaccgatccgaggtgagcaccagaacaaacctgaaanttgcctgggttaacttatgaaaatccgaataaaaaaagtggatcagcgaatccatggggacgggacttttccttgccgaggctgctccaaaaaaaaaagggaaaggtattaaggtttttaaggaaaatttttagggggggttttaaaaaaaagccgggggttttaaaaaacccccggacccc

SEQ ID NO: 74875 - protein, 202 aa, Zea mays
  misc_feature: Ceres CLONE 1559282
  misc_feature (197)..(197): Xaa is any aa, unknown, or other
MSGREVREYTNLSDPKDRKFGKGKDKIDDEDITFQRMVAKMQEVAGDRGGYLHGRGALDSDDLLYLKEQMEAEEDAERLLRHTEKRAFAAFKKAAILADSTPAVPVALRVEPKPKSDIRQQDLLKNIVGIKPKRPKVSSPSQPPDSYKPKHTGEDLVSELSSSPDPVGTSHGTANPDHPAPKVDDRSEVSTRTNLKXAWVNL

SEQ ID NO: 74876 - DNA, 969 bp, Zea mays
  misc_feature: Ceres CLONE 1559285
  misc_feature: Encodes the peptide sequence at SEQ ID NO. 74877
  misc_feature (536)..(536): n is a, c, t, g, unknown, or other
  misc_feature (642)..(642): n is a, c, t, g, unknown, or other
  misc_feature (834)..(834): n is a, c, t, g, unknown, or other
ctggagctccccgcggtggcggccgctctagaactagtggatcccccgggctgcaggaattcgtctcacccctagaaaaatccccccggagctggtgcgcgagtcggagctggtgcagggtcacccttcccctcggcctcaagagctctgcggttgccgcggccaagggcgtccgtggagaagcgggagcaggtggcggcgatggaagagcaaggcggccaggcggcgctcgggtgggcggccagggacgactccggcgtcctctccccctacagcttctccagaagggttcctaaagacgacgatgtcacgatcaaggtgctctactgcgggatctgccacaccgacctgcacgtcatcaagaacgactggcgaaacgccatgtacccagtcgtcccggggcacgagatcgtgggcgtggtgaccggcgtcggcggcggcgtcacgcggttcaaggccggcgacacggtcggcgtgggctacttcgtggggtcctgccgctcctgcgacagctgcggcaagggggacgacaactnactgcgcggggatcgtgctcacctccaacggcgtcgaccacgcgcacggcgggcgcccaccagggggggattcctccgacgtcctggtcgcgagcgagcactacgntggtccgcgtccccgacggcctggcgctggaccgcaccgcgccgctgctctgcggccggcgtcaccgtgtacagccccatgatgcgccacggccctcacgagcccgcaaggacctcggcgtcgtcggcctcggcggcctcgggcacgtcgccgtcagttcggcaaggccttccggaatgaggtcaccgtctnaacacgtccgccagcaagcgcaggaggcatcgagaactggggggcggaaagttcccctcaccccggacaagacaaattaagcggcaacgggacctgacgcttccccccccgggtgggctggcccccatccacccc

SEQ ID NO: 74877 - protein, 206 aa, Zea mays
  misc_feature: Ceres CLONE 1559285
  misc_feature (33)..(123): Pfam Name: ADH_N Pfam Description: Alcohol dehydrogenase GroES-like domain
  misc_feature: SWISSPROT Homolog: EC 1.1.1.195 Cinnamyl-alcohol dehydrogenase
  misc_feature (112)..(112): Xaa is any aa, unknown, or other
MEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFVGSCRSCDSCGKGDDNXLRGDRAHLQRRRPRARRAPTRGGFLRRPGRERALRWSASPTAWRWTAPRRCSAAGVTVYSPMMRHGPHEPARTSASSASAASGTSPSVRQGLPE

SEQ ID NO: 74878 - DNA, 898 bp, Zea mays
  misc_feature: Ceres CLONE 1559286
  misc_feature: Translation starting site: 154
  misc_feature (770)..(770): n is a, c, t, g, unknown, or other
ctggagctccccgcggtggcggccgctctagaactagtggatcccccgggctgcaggaattcgtctcacccctagaaaaagatataccggggacgctgaggtctctctccctccgcgcggctgcacaagatagcaaaaatagctaccctctccatggactccgtccccatcgcaccctcctccttgtaccttttccccgggggctcaactacacgcggatccttccccgctcagaaggcaggaatcggtcacggtggcttgaagatcaagagcctccataccgtgcggcgctgagatccccaacacacgatgagaggtggagtactggatgcagtacattggtggcattgaacgctctctctcacgccaaattctcctggacctatattgccatgacgaaatcaccgagagaccgcacagaagatgaggtcctcaccctcctgcacgaggtgggccaatacacgatagagggaaaccctgtgacgtcactgatacgattatcaactattcgatgcacttatctgattcagccctgcatgatgatagacgacttctatggataccgttaaccacttgactacacatcattgattccttgaaagcattgaagccagcctggaagactgcgtattccagttcacttcgcccattctatacgattcctggatgtcggaacagcccacttgcatgtgctcctcggactacgcggacatagatacgctgagagctggcccactgctgctcggatgctctgctgatactctcaaccntgcgtgcatcttgagctccctgactataagtgctacaaggattcaggccacagttgcgatccagatgatggacagacgacaagaacaccgccggaagttcagggaaaagggctcatctgccatcataa

SEQ ID NO: 74879 - DNA, 945 bp, Zea mays
  misc_feature: Ceres CLONE 1559287
  misc_feature: Encodes the peptide sequence at SEQ ID NO. 74880
  misc_feature (694)..(694): n is a, c, t, g, unknown, or other
  misc_feature (766)..(766): n is a, c, t, g, unknown, or other
  misc_feature (844)..(844): n is a, c, t, g, unknown, or other
ggagctccccgcggtggcggccgctctagaactagtggatcccccgggctgcaggaattcgtctcacccctagaaaaaggcaaatcagctggacacatagcacatctatcccgcttccgtctcccgctccagtcgccatggcggaagccctcgtgggcctccgcgtcgctgccctcgccgtcccgcaggctaggagccaccgcagacggcttctccccgctgcgcgcctcgctgcgttccggcgcgaccggctgagcactgcccgcgcggccgtcgcagggccaccggaggtggacgaggacgattccatgagtatcgacaacttgcatcgtttcttcgacctcaacgtcggaaagtgggacggctcattctaccaattcgacgcgcacgggagggttcttcaggagattagcacgcggctgtccgtgagcacgtacggggaggacaacctcatcagcctccttcaatcgttgtacattaagcaagcatcctctgcaatatcaatcgtggacgaagaggattctgaacctgaatgggtggaatacaaaatcaagagacgaacatattcactgtggacaaatatcagcagatagggttctttcctgaagaaaaggcatttgctctgaggtatcagactgctggaatgctggagactgttcttcgggttggcacgcttggagaagatgatactggntgaagatctcccaaaaacctgaagataccttctcgcagccatctattgtatgtgaaaattgtctttactccntgaaggcaatggtcgaatgagggctttccacatatggatccaagggagtgcttgacacacttctatttttcatgagangaagcagggatctgatttggcacatcatttaaaccctatcagtttgtacaatgagtgcagccgtgataaggatagtacagtccttggaagatgggagggcc

SEQ ID NO: 74880 - protein, 151 aa, Zea mays
  misc_feature: Ceres CLONE 1559287
MAEALVGLRVAALAVPQARSHRRRLLPAARLAAFRRDRLSTARAAVAGPPEVDEDDSMSIDNLHRFFDLNVGKWDGSFYQFDAHGRVLQEISTRLSVSTYGEDNLISLLQSLYIKQASSAISIVDEEDSEPEWVEYKIKRRTYSLWTNISR

SEQ ID NO: 74881 - DNA, 959 bp, Zea mays
  misc_feature: Ceres CLONE 1559288
  misc_feature: Encodes the peptide sequence at SEQ ID NO. 74882
  misc_feature (476)..(476): n is a, c, t, g, unknown, or other
ggagctccccgcggtggcggccgctctagaactagtggatcccccgggctgcaggaattcgtctcacccctagaaaaacccagttccagtgacactgcaccagaccacccggctccagcgagatccagacccaaaacctcacctcgcagccaacctctgctcggaggggaagggaagggaagcaatggcggccaacggaggcgggtaccgggcggaggacgactacgactacctcttcaaggtggtgctcatcggcgactccggcgtcggcaagtccaacctcctctcccgcttcaccaagaacgagttcagcctcgagtccaagtccaccatcggcgtcgagttcgccacacgcagtctccaggtcgacggcaaggtcatcaaggcccagatttgggacaccgccggccaggagaagtaccgtgctatcacaagtgcctattaccgaggagccgtaggggcactgctggtctacnatgtcaccgtgcgcaccacgttcaaaaacgtggggccgttggctgagggaactcaaaagacacaccggacagagcatcggggtgatgctgggcggcaaaaagttcgatctcccggaacttgttggccttttcgaacgacaaaccaaaggattccccaaggccaagcccttgccttatggagaaccccccccccccacacccccaaaggggaaaccccctttccggaggggggtaccaataattccccatttgggaaaaaaaaagggggggcccccaaaaggggggggctcccccccccgaaggggaaaaaaaaaaccccgggggaccttccccccaaaaaaagaggggggcgcgccccacaaagggaaaacgccaaaaaagggtgttctcatttctttcccccggccggggggaaagggggagaaaccccttttttttttttttcccccccaagggggggggaaaaaaaaatatttgtgtggg

SEQ ID NO: 74882 - protein, 258 aa, Zea mays
  misc_feature: Ceres CLONE 1559288
  misc_feature (19)..(150): Pfam Name: Ras Pfam Description: Ras family
  misc_feature (98)..(98): Xaa is any aa, unknown, or other
MAANGGGYRAEDDYDYLFKVVLIGDSGVGKSNLLSRFTKNEFSLESKSTIGVEFATRSLQVDGKVIKAQIWDTAGQEKYRAITSAYYRGAVGALLVYXVTVRTTFKNVGPLAEGTQKTHRTEHRGDAGRQKVRSPGTCWPFRTTNQRIPQGQALALWRTPPPHTPKGETPFPEGGTNNSPFGKKKGGAPKRGGLPPPKGKKKTPGDLPPKKRGGRAPQRENAKKGCSHFFPPAGGKGGETPFFFFSPPRGGEKKIFVW

SEQ ID NO: 74883 - DNA, 984 bp, Zea mays
  misc_feature: Ceres CLONE 1559289
  misc_feature: Encodes the peptide sequence at SEQ ID NO. 74884
  misc_feature (455)..(455): n is a, c, t, g, unknown, or other
  misc_feature (518)..(518): n is a, c, t, g, unknown, or other
  misc_feature (547)..(547): n is a, c, t, g, unknown, or other
ctggagctccccgcggtggcggccgctctagaactagtggatcccccgggctgcaggaattcgtctcacccctagaaaaagccgccacaatcccctccgctccacattgtgggattgagccgaacacaagcaccctcctccccgaaacctcttctttgccctgctttcggtggtatggtgcgatgatgactagggaggctgtgctgttgtccctcctcttctgcctcgccgctgccggcgaggcagtgtcactggtgagccagggcgaggcggcggagctggcggtgtcggtggacccgtcgtggcgcttccccagccagcggctgcgggacgcgtacttggcgctgcagacgtggaagcagcaggccatcttctccgaccccaggggcttcaccgccgactgggtgggcccgggggtctgcaactacactggggtcttctgcgcgccgctgccngcggggggtgcggggcgccgggtagctctcccgtcgcgggcgtcgacctcacccacggcgacntcgcggggctactcccgacggagctcggnctccttcgccgacctccttgttgctccacctaaacttccaacggtttctgcgggcctcgtggccgccaaggttccgccggggtcccccttccttggtgaagttgaacctcagaaaaaccccccttgggggggccgttcccggggcgtttttttccaaacctccgggggcataaagtttcccaacccccccgtttaaaaaaattaagggggccctccccccggaatttttttgacgcgccctttaacccttttttttaaaaaaaaaaaggctcgggtgggcgctcccaaaaaatgggaaaaatccccgcgccccctttttgtgcccacaaaaaaatttgggggaaacccaagagggaaaaatgaacccccccaccacccgggggggggggtccccgaaaaaaaattaaatttccccccacaaaaaaaaaactaaaaaa

SEQ ID NO: 74884 - protein, 186 aa, Zea mays
  misc_feature: Ceres CLONE 1559289
  misc_feature (122)..(122): Xaa is any aa, unknown, or other
MMTREAVLLSLLFCLAAAGEAVSLVSQGEAAELAVSVDPSWRFPSQRLRDAYLALQTWKQQAIFSDPRGFTADWVGPGVCNYTGVFCAPLPAGGAGRRVALPSRASTSPTATSRGYSRRSSXSFADLLVAPPKLPTVSAGLVAAKVPPGSPFLGEVEPQKNPPWGGRSRGVFFQTSGGIKFPNPPV

SEQ ID NO: 74885 - DNA, 921 bp, Zea mays
  misc_feature: Ceres CLONE 1559290
  misc_feature: Encodes the peptide sequence at SEQ ID NO. 74886
  misc_feature (747)..(747): n is a, c, t, g, unknown, or other
  misc_feature (778)..(778): n is a, c, t, g, unknown, or other
  misc_feature (800)..(800): n is a, c, t, g, unknown, or other
  misc_feature (817)..(817): n is a, c, t, g, unknown, or other
  misc_feature (824)..(824): n is a, c, t, g, unknown, or other
ctggagctccccgcggtggcggccgctctagaactagtggatcccccgggctgcaggaattcgtctcacccctagaaaaaagcatcatggcgctcaccacgagcactaacaaccaagccttgcttgacgctcagctagagctctggcacacatcctttgctttcatcaagtccatggctctcaagtctgcagtggaccttggcatagccgacgccatccacagccacggtagcaacgccaccctgccccagatagtttccagggccgcgctccacccgtccaagatcccctgcctgcgtcgcctcatgcgggtgctcacagcagccggcatcttcagcgccgcccaccgctcgccggacgacgggcgcggcgagctcgtctatggactcacaccgggcgtctcagcttctttgtttggcagctcttcaagccctggctcccttcatggtcccttggtgtttaaccccaaggcctaacgttggcccccctttccctttggccctcggggccattggggtaaaaggcccgaaaccccctcaaaaccccaaacccctttttttaaaaaataaaaccaaaggggcccccccctgcccccgggggcccccctataataacccccaaaagcccccaccccttttggggggaagaaaacttccttacacacaaaagagaggtgttggtgtgttgcgaaaaaaaaaaaacaattttttttttttagggaaaagaaaaatatttttctcccccccnaaaaaaaaaaaaaagaggggggggggggggnacaaaaccccccctctcctccntcccggggggggggggngcgccanaaaaaaaaaataattttttttttttttttccccccccaaggagaggtgttgtgtgcgcgccccccccccctcttttatttttttatacaacaccccc

SEQ ID NO: 74886 - protein, 129 aa, Zea mays
  misc_feature: Ceres CLONE 1559290
  misc_feature (30)..(78): Pfam Name: Dimerisation Pfam Description: Dimerisation domain
  misc_feature: SWISSPROT Homolog: EC 2.1.1.146 (Iso)eugenol O-methyltransferase
MALTTSTNNQALLDAQLELWHTSFAFIKSMALKSAVDLGIADAIHSHGSNATLPQIVSRAALHPSKIPCLRRLMRVLTAAGIFSAAHRSPDDGRGELVYGLTPGVSASLFGSSSSPGSLHGPLVFNPKA

SEQ ID NO: 74887 - DNA, 936 bp, Zea mays
  misc_feature: Ceres CLONE 1559291
  misc_feature: Encodes the peptide sequence at SEQ ID NO. 74888
  misc_feature (751)..(751): n is a, c, t, g, unknown, or other
  misc_feature (752)..(752): n is a, c, t, g, unknown, or other
  misc_feature (802)..(802): n is a, c, t, g, unknown, or other
  misc_feature (877)..(877): n is a, c, t, g, unknown, or other
ctggagctccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatccactcccggtgggcgatgctgggcgcgctgggctgcgtgttcccggagatcctggccaagaacggcgtcaagttcggcgaggcggtgtggttcaaggccggcgcgcagatcttctcggagggcgggctggactacctggggaaccccaacctggtgcacgcacagagcatcctggccatctgggcgtgccaggtggtgctcatgggcttcgtcgagggctaccgcgtcggcggcggcccgctcgggaagggctcgacaggtgtacccccggcgcgccttcgacccgctgggcctccgcgacgacccgnnacacgcgccgagctcaaggtgaggagctcaagacggcccgccttgcatgntctcatgttcggcttctcgtgcaggcatcgtcaccgcaaggccccatcgagaactcttcgacacgtcgcgacccntcgcaacacggctggcatagccaagaactcgtcccggcactactgattgacaacgcgta

SEQ ID NO: 74888 - protein, 254 aa, Zea mays
  misc_feature: Ceres CLONE 1559291
  misc_feature (59)..(207): Pfam Name: Chloroa_b-bind Pfam Description: Chlorophyll A-B binding protein
  misc_feature (198)..(198): Xaa is any aa, unknown, or other
  misc_feature (215)..(215): Xaa is any aa, unknown, or other
  misc_feature (240)..(240): Xaa is any aa, unknown, or other
MAASALHQTTSFLGQALVSRAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGKGSTGVPPARLRPAGPPRRPXTRAELKVRSSRRPALHXLMFGFSCRHRHRKAPSRTLRHVATXRNTAGIAKNSSRHY

SEQ ID NO: 74889 - DNA, 892 bp, Zea mays
  misc_feature: Ceres CLONE 1559292
  misc_feature: Encodes the peptide sequence at SEQ ID NO. 74890
ctggagctccccgcggtggcggccgctctagaactagtggatcccccgggctgcaggaattcgtctcacccctagaaaaaggcatgttcgcttccatctgccggcggcggctcttccgcctctgtcaaatccccttcggcaccggcgcaatccctagcgacgccctcccccactgccactccttagcaaccatcgcggacgctcccgtctccgagccctgtgctgcccttgtctcttgagggctctcccccgccgccgcggtcgcccacaagctcccaatccgctccaccgccaaggccgacgccgtccgtgcgctcctccgcagctacggcttcaccgacgcggaggtcgccgacctagtccgccgattatcgcagatcctcagcgtcgaccccgaccggatccgccccaagcttgacctcttcgcctccctcggcgtcaagccgcggcggctcgccagatatcctgccctcctcacgcgcagcctcgacaagcacctcgtcccctgcatccagttcctccgcaacattctcagcaccgatgaggacgtctgcctcgccatctcgcgcaccccgcgcgccctctcggctggcctggagaagatcatgcggcccgccgtggacaccctccgccgtcttgggctccccgatgagtctatctcgaagttagtagtcatccagatgggcgtgctcatgatgtcgcccaacgcatatgacagatcttcgaggccctcaagagttcggcttgcgcgtacccgaaaagcgctttgcctacggaatccgcgcctgtgctgcattaatagggagaggggctgcctagggtgccctttaccggagcctcgggtgtccgaggtgaactgcaagagcggtccagaacaacccatattgttact

SEQ ID NO: 74890 - protein, 95 aa, Zea mays
  misc_feature: Ceres CLONE 1559292
MRPAVDTLRRLGLPDESISKLVVIQMGVLMMSPNAYDRSSRPSRVRLARTRKALCLRNPRLCCINRERGCLGCPLPEPRVSEVNCKSGPEQPILL

SEQ ID NO: 74891 - DNA, 907 bp, Zea mays
  misc_feature: Ceres CLONE 1559293
  misc_feature: Translation starting site: 307
  misc_feature (839)..(839): n is a, c, t, g, unknown, or other
ctggagctccccgcggtggcggccgctctagaactagtggatcccccgggctgcaggaattcgtctcacccctagaaaaagctggagatgagcttattcactcattcggaccaagacgacgaacttcgaatttcctcaattttcacgcgagcacctgtttgtatcgccggcggatcggatatattttctcggttcctgctactcctttctttctcgcctgcatccatggtctcgctgctccctcgcgctccctctctcgccttcctcgctaagtccgcctcctcgcagcggccgcctgcgccatccatgtcgtctcccttctccgccgcttccgtggccgcggggtcagaggcggcagccggcacgaggaagctgcctgtgctcctgttcgacgtcatggacaccctcgtccgggacccgttctaccaacacatccccggcttctttcaaatgtccatgaaggaactactagaaagcaagcatccaacggcttggtcagaatttgagaaaggactgattgatgagaatgagatggccaaaaagctcttcaggatggcagatcgtttgatttgcaaggtctaaaagagtgcatggtgagagcatatgaatacattgatggcgtcgaagatattctttgctgtttgaagaaaataattatgaaatgcatgcttgtacaatttaatcagtatgggtacaaatatattgaagataagctaaagctctcaaagtatttatctaggacattttgttcttggacaactggaaagcgaaaaccttcgcccgaattttatccttcagcggcaaatcaactcaccgttgatcaacaggctgcgttttantgacgaccggatgatagacatcgaaccacccctaatgataggatgggtggcgttccaatttaaaagct

SEQ ID NO: 74892 - DNA, 888 bp, Zea mays
  misc_feature: Ceres CLONE 1559294
  misc_feature: Translation starting site: 100
  misc_feature: Pfam Name: Utp12 Pfam Description: Dip2/Utp12 Family
  misc_feature: SWISSPROT Homolog: EC 2.7.11.7 [Myosin heavy-chain] kinase
ctccccgcggtggcggccgctctagaactagtggatcccccgggctgcaggaattcgtctcacccctagaaaaagttcagtgtggggaaagatcgcactatgaagtactgggatgctgataaatttgagttattgttaacacttgaaggacatcatgctgaagtttggtgcctcacactcagcagtcgcggtgattttgttgtaacaggttcacatgatcgttccattcggcgttgggatcgtactgaagaacaactgttcattgaggaagagaaggagaaaagattggaagaaacctttgaggctgatttagaaacgataatgactatagatatgggcagaaagatgatgcccctgatgaaggttctgtgggtgttcctggtaggaaacaaaagagacagtaacttctgctgatgcaatcatggatgcacttgacactgctgaggaggaactaaaacgcattaatcaacataaaatgggaagacaaatttactgccgaagcagctaaattttcaacctaatgttataatgcaagggccatcacccttcagattatggttctgaatgtaggttccagccatcggtccaaatgatctggaacaggccctctttgggatttgccgttccccaatgcaccaaaagcccatggtctaccttgaaagattgggcctttggttccctccaaagggtgaacctttttttaaaggttttccttaaggcccctttcaaacccttcaaattcatttaccgcccccgccccccccaaaaccctttttaaaaaaacaaaggaagatcccttccctgaaaaaaaaaaatggcgggatctttaagggttccacccgcccccaaggaaaaataaaaaaaattggggggttgaaaaaaaacccc

SEQ ID NO: 74893 - DNA, 1001 bp, Zea mays
  misc_feature: Ceres CLONE 1559295
  misc_feature: Encodes the peptide sequence at SEQ ID NO. 74894
  misc_feature (381)..(381): n is a, c, t, g, unknown, or other
  misc_feature (442)..(442): n is a, c, t, g, unknown, or other
ctggagctccccgcggtggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagtttcccggcgactacngctgggacaccgcggggctgtcccgcgtacgggatgacttcggccagaaccgcgagctggnagtgatccactgccgctggggcatgctgggcggcgctcgggtgcgtgttccccggagctgcctcgcccgcacggggtcaaaattcggcaaggcccgttgggttcaaggcccggggcccaaattttccacaagagggggggtttgaaaacctcgggaaccccaaaccttgttcccggccaaaaaaatccgggcccttttggggggcccaggggggtccccattgggccccctaagggggccccccatcccccgggggccccccccgggggaagggggccaaccccttgtgcccccgggggggagttttacacccctggggggccccaaaaaaaacagagatgttcccaaaaccttggggggagaaaaaaaaaaagcgccccccccccgagtccccaggtggggcgttttttggggggccgccccccgcggagggggcgcgtttataacccccccaacaccctgtttgtgtgtttaaaaaaaggggggggggacaaaaatattttgcgcccgagaagggaggagaaaatttatggtgtgggcgcgacaaaaaaattttttt

SEQ ID NO: 74894 - protein, 139 aa, Zea mays
  misc_feature: Ceres CLONE 1559295
  misc_feature (72)..(72): Xaa is any aa, unknown, or other
  misc_feature (92)..(92): Xaa is any aa, unknown, or other
MALTSRALVGKPATSTRDVFGEGRITMRKTAGKPKPAASGSPWYGADRVLYLGPLSGQPPSYLTGEFPGDYXWDTAGLSRVRDDFGQNRELXVIHCRWGMLGGARVRVPRSCLARTGSKFGKARWVQGPGPKFSTRGGV

SEQ ID NO: 74895 - DNA, 951 bp, Zea mays
  misc_feature: Ceres CLONE 1559296
  misc_feature: Translation starting site: 110
  misc_feature: SWISSPROT Homolog: EC 2.4.1.121 Indole-3-acetate beta-glucosyltransferase
  misc_feature (721)..(721): n is a, c, t, g, unknown, or other
  misc_feature (722)..(722): n is a, c, t, g, unknown, or other
  misc_feature (729)..(729): n is a, c, t, g, unknown, or other
ctggagctccccgcggtggcggccgctctagaactagtggatcccccgggctgcaggaattcgtctcacccctagaaaaaagaaacgctcgctcacgacggcagcagccatggcagcatcgtgcggcggccgcgtggtggtcttcccgttcccgttccagggccacttcaacccggtgatgcgcctggcccgcgcgctgcacgcccggggcgtcgggatcaccgtgttccacaccgccggcgcgcgggcgccggacccggccgactaccccgccgactaccgcttcgtgcccgtgcccgtggaggtggccccggagctgatggcgtccgaggacatcgccgccatcgtcacggcgctcaacgccgcctgcgaggcgcccttccgggaccgcctctcggcgctgctctccgccgccgacggcgaggcgggggaggcgggggggccgcgtccgctgcgtcctcaccgacgtcagctgggacgccgtgctgtcggcggcccgcggcctcggcgtgcccgcgctcggcgtcatgacagccagcgccgccacgttccgcgtctacatggcgtaccgcaccttggtcgacaagggatacctgccggtgagagaggagcgcaaggacgacgcggtcgccgagctacccccgtaccgcgtgaaggacctgctgcggcacgagacgtgcgaccctggaggagttcgcggacctgctgggccgcgtggtcnncgcggcncggctgtcctcggggctcatcttccacacgttccccttcatcgaggccggcacgctgggcgagatccaggacgactggtcggtgcctggtgtacgccgtggcgccgctcatctagctggtgccggcggccacgccagccttgcacgggaggtgcaagcggaacggggctgcctgcccttgctggaccccaacgggcccctccgtgctgacggaagctcggga

SEQ ID NO: 74896 - DNA, 975 bp, Zea mays
  misc_feature: Ceres CLONE 1559297
  misc_feature: Translation starting site: 180
  misc_feature (597)..(597): n is a, c, t, g, unknown, or other
  misc_feature (805)..(805): n is a, c, t, g, unknown, or other
  misc_feature (806)..(806): n is a, c, t, g, unknown, or other
  misc_feature (954)..(954): n is a, c, t, g, unknown, or other
gctggagctccccgcggtggcggccgctctagaactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccaccgtggcgtgcttcctgctccgcttctcgacgggcgggcaggccacgggcaccttcgggctgacgggcgtgtccngtgtgggaggcgctggtgctggagatcgtgatgaccttcgggctggtgtacacggtgtacgccacggcggtggacccgaagtaaggcagcctgggcaccatcgccccccattgcatcggcttcatcggggggcaaattccccgtgggtgggcggcgccttcgaacgcgcgtcaatgaaacccccgcgtgtctttcggccccggcctgnntaagctgggaggggggctaccaagggggggtactggggtcgggccccctcatcgggggggggcctcgcgggggtcattctagaagctgctcttcatctcccaaccccacgaggaggtcccctccccggactactaaaagcgaggcgcnaccccccctggggtgcccagg

SEQ ID NO: 74897 - DNA, 975 bp, Zea mays
  misc_feature: Ceres CLONE 1559301
  misc_feature: Encodes the peptide sequence at SEQ ID NO. 74898
  misc_feature (543)..(543): n is a, c, t, g, unknown, or other
  misc_feature (544)..(544): n is a, c, t, g, unknown, or other
  misc_feature (561)..(561): n is a, c, t, g, unknown, or other
  misc_feature (564)..(564): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (926)..(926): n is a, c, t, g, unknown, or other
  misc_feature (928)..(928): n is a, c, t, g, unknown, or other
ctggagctccccgcggtggcggccgctctagaactagtggatcccccgggctgcaggaattcgtctcacccctagaaaaaaggccacttacctgcagtcaccactcccaagccagtacccacagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacagtcgcgccgcctgcaactgcctcaagaacgccgccaggggcgtcagcagcctcacgcctgcaacgccgccagcatcccctccaagtgcggcgtcagcattcccctcaccatcagcaccctcaccgactgctccaggggtgaactaaaacctannacacgcgcgacgacggncgncttgatcgatcgaccatccattcccgcgtccccgccgggccggattattcggtgggccccatgatggaaatccttccaatctaccgcgggatgatccgagggctaccttggcccccggctttgaaccaccaaaaaaaaatcctccccccgggggggggacccttcccccctcccttgggcgtgggaacaatttcaaaatacaaaccccccactttataaagtgggggaacggggaaaacggacaaaaagaaagagaaaacaggttccttccaaaaacggcccgccccctttgggggcggggggggtattccacccaccacctttgtggtgatgaaaaaaaattttctgcggggcnnnnnntntnaagggagacaaaaaaatttcccatacgagaagtccccaaccgtgggg

SEQ ID NO: 74898 - protein, 121 aa, Zea mays
  misc_feature: Ceres CLONE 1559301
  misc_feature (32)..(99): Pfam Name: Tryp_alpha_amyl Pfam Description: Protease inhibitor/seed storage/LTP family
MARTQSAVAVAVVAAVLLLAAAATTSEAAITCGQVSSAIAPCLSYARGTGSGPSASCCSGVRNLKSAASTAADSRAACNCLKNAARGVSSLTPATPPASPPSAASAFPSPSAPSPTAPGVN

SEQ ID NO: 74899 - DNA, 954 bp, Zea mays
  misc_feature: Ceres CLONE 1559302
  misc_feature: Translation starting site: 231
  misc_feature (542)..(542): n is a, c, t, g, unknown, or other
  misc_feature (698)..(698): n is a, c, t, g, unknown, or other
  misc_feature (898)..(898): n is a, c, t, g, unknown, or other
ctggagctccccgcggtggcggccgctctagaactagtggatcccccgggctgcaggaattcgtctcacccctagaaaaaaaacaaaccactcttcgcttcgactcccactcccactctccctttccactctcaggctcccactccccccctaccggctaccctacccatcacacacaaacagccactcctcacctcccccgtcctccggttcatgtcctgctgctccccatgtcgcccccactcgacctcgactacataggcctctcgccggcggcggctgccgccgctgcccacgacgacctgaagggtaccgagctccgccttggtctgccggggtccggttcgccggaccgccgtgttgtggctgccaccgcaaccaccctggacctgctcccggctaaaggcgccaagcgcgggttttctgacgaggcgccgacgccatcgcccggtgcagcttccgggaagggaaagaaggtagcggaagaggaggacgacaagaaggttgcagcgacgccgcagccggtcgcaaaagctcaggtnggtgggatggccaccaatccgaagctaccgcaagaacacgatgtctaccacccagctgaagggcagcaaggaggatgctgacggcaagcaggaccaggggttcctgtacgtcaaggtcagcatggatggcgcgccgtacctcaggaagatggaccntcagaactacaagaaactacaggacctgtcgactgcgcttgaaaagatgttcagtggctgcagtactggcaaggatggctttatctgagtaccggcaggaatggtgaaatatgttctgacttacgaagaccaggatggagattggatcgcttgttcgcgaagtaccatgggagatgttccctgactcttgcccaggctcnggatcatgaaaagatccaatgcatttggacctgctccaaggcagctgataatccaa

SEQ ID NO: 74900 - DNA, 965 bp, Zea mays
  misc_feature: Ceres CLONE 1559303
  misc_feature: Translation starting site: 265
  misc_feature (838)..(838): n is a, c, t, g, unknown, or other
  misc_feature (839)..(839): n is a, c, t, g, unknown, or other
  misc_feature (885)..(885): n is a, c, t, g, unknown, or other
ctggagctccccgcggtggcggccgctctagaactagtggatcccccgggctgcaggaattcgtctcacccctagaaaaagagccagggcccaggccgagcaacctggtgctccgcccctcgccgttacagcggcgcctcggcctccggttccacagcgtctgcctgcctgcgcggccctgtgaccgtgaggcgacacgacgccgagagatcacccgccccccgcatcgtgtccgccccgcttgggattgtgaggtaaagcgtgatggcagcgccgccggcgagggctcgagccgactacgactacctaatcaaactgctcctcatcggagacagcggcgttggaaaaagttgcctcctgttacggttttcagatggatcattcaccactagcttcattaccactattggcattgacttcaagataagaactgttgagttggatggcaaaaggattaagttgcagatctgggatactgcaggccaagaacgtttccgcacaattaccactgcctactacaggggagcaatgggcatcttacttgtgtatgatgtcacagacgagtcatctttcaataacataagaaattggatcagaaacattgaacaacatgcttcagataatgtgaacaaaattctgggtggggaataaagctgatatggatgaaagcaaacgggctgtgcccacttcaagggacaagctctcgcagacgaatatggggataaagttctttgaaacgagcgcaaagacaaacctgaacgtcgagcaggttttcttttctatagcaagggatatcaaacagagactttcagagactgattccaagcctgaggatcgnnactatcagaatcaggctgaaaggggaactgatgcacaaaagcccanaaatcagctggctgcgcctcttgaacggttgtgggcccagaatatttccatatttttattctttgccagcaagcctttct

SEQ ID NO: 74901 - DNA, 920 bp, Zea mays
  misc_feature: Ceres CLONE 1559304
  misc_feature: Encodes the peptide sequence at SEQ ID NO. 74902
  misc_feature (754)..(754): n is a, c, t, g, unknown, or other
attagctggagctccccgcggtggcggccgctctagaactagtggatcccccgggctgcaggaattcgtctcacccctagaaaaaatcctactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccaaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaaggaggtcgctgccgcggcggccgtcggcgccggcggctacgtattccacgagcaccacgagaagaagaaggaccacaaggacgccgaggaggctagcggcgagaagaaacaccaccacctcttcggctgaccgtagtaccggccggcgcgcgaccgagctagctagctccggcgcacacaaccacacacctgtttaattctgtactgcatgcgtgtgtaatttgatggttcacaataatgagtccctctccggaccttggtagctgcttgcttgtggtgagtgagagtggagactganggagaaaaggtgggtgggcctggggctacctccaaaagaggcgtggtcctgtactcgcttcgttttctctgcatgcgtgtataattgtgttcaatataaatgaaaaccggtggggatgtgtggcctccctttgtcaggctccaggggtatccgttattgaatcccg

SEQ ID NO: 74902 - protein, 120 aa, Zea mays
  misc_feature: Ceres CLONE 1559304
  misc_feature (41)..(115): Pfam Name: ABA_WDS Pfam Description: ABA/WDS induced protein
MSEEKHHHFFNHHKKDEEQPAGEYGYSETKVVTATGEGEYERYKKEEKEHKHKQHLGEAGAIAAGAFALYEKHEAKKDPEHAHRHKITEGGRCRGGRRRRRLRIPRAPREEEGPQGRRGG

SEQ ID NO: 74903 - DNA, 876 bp, Zea mays
  misc_feature: Ceres CLONE 1559307
  misc_feature: Encodes the peptide sequence at SEQ ID NO. 74904
  misc_feature (820)..(820): n is a, c, t, g, unknown, or other
tggagctccccgcggtggcggccgctctagaactagtggatcccccgggctgcaggaattcgtctcacccctagaaaaaacgccacacaccaccaccggacgctagctcaccaccaacctcagcacatcgaggagaagaggagtggccaatggcttcgtcggtggccgccgcggcgagcacattcctgggcacccgcctggcggacccggtgccgcagaacgggcgcatcgtggcccggttcgggttcggcggcggaaagcccaaggctgccgtcccgaagaaggtggcgaagacgtcgatctcctctgaccggccgctgtggttccccggcgccgtggcgcccgactacctcgacggctcgctggtcggcgactacgggttcgacccgttcgggctcgggaagcccgtggagtacctgcagttcgaactggactcgctggaccagaacctgggccaagaacgaggccggcggcatcatccggcacccgggttcgagtccctccgacgtctagttccaccccggttccaacccttaaagggaggtggttccggcccctccaagggtttccccccgaaggggaaaatcctttcccccggggcaaaaggggcccatttttttcccccccccccctgggggcccccccccccccttgtaaaaagggggtccccccgggggggccccccctcgggggagaaaaaccctccccaaaaaggggggaaaaccccgggtgggaggggggggggccccccccccccccaggggggggggccccctccgccgcgccttttttttgtgccccacccccctttggggtgggnttccctcctcttttttatgtagaaaaaaaaaaaaatgttggtgtgtgttttcccct

SEQ ID NO: 74904 - protein, 230 aa, Zea mays
  misc_feature: Ceres CLONE 1559307
  misc_feature (224)..(224): Xaa is any aa, unknown, or other
MASSVAAAASTFLGTRLADPVPQNGRIVARFGFGGGKPKAAVPKKVAKTSISSDRPLWFPGAVAPDYLDGSLVGDYGFDPFGLGKPVEYLQFELDSLDQNLGQERGRRHHPAPGFESLRRLVPPRFQPLKGGGSGPSKGFPPKGKILSPGAKGAHFFPPPPWGPPPPLVKRGSPRGGPPSGEKNPPQKGGKTPGGRGGGPPPPQGGGPPPPRLFFVPHPPLGWXSLLFFM

SEQ ID NO: 74905 - DNA, 930 bp, Zea mays
  misc_feature: Ceres CLONE 1559308
  misc_feature: Encodes the peptide sequence at SEQ ID NO. 74906
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (819)..(819): n is a, c, t, g, unknown, or other
  misc_feature (822)..(822): n is a, c, t, g, unknown, or other
  misc_feature (823)..(823): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (924)..(924): n is a, c, t, g, unknown, or other
ctggagctccccgcggtggcggccgctctagaactagtggatcccccgggctgcaggaattcgtctcacccctagaaaaaacctgcttggtccatcagcagcgagcgaacagggaaaaaggagaggccgagaagcgctttagcgataagactggtgcacccgtagcggcacggcatggcggccacggcgtactccgtggcgctcctcggcggcgcacgcctgccggccgccctcctccctcggcgcagcagcgtgtgccaccagcagcttcgcctccaagacgcgccgaggctctccctgcaccgtgccagggccgcttccgaggacacgtcggcctccggcggcgacgagctcatcgaagacctcaaggcaaagtgggacgccgttgaggacaagcccaccgtcctcctgtacggcggcggcgccgtcgtggcgctatggttgacgtccgttgttgtcggcgccatcaacgccgtgccgctgctccccaagatcctggagctcgtcggcctcggctacaccggctggttcgtgtaccgctacctcctcttcaagcaaagcaggaaagagctggtcgacgacattgagaccctcaagaaaaagattgctggaacggcggaataagcgctagctctcgtggaaagctttagaccaacgacgagaggggcccgtttcttctttgcaaattaaatatcaaaccgaggaacgtacaatgcagctactgtccgccatgtgttgtgtgatgcataccttaccttctgtatactaacgaaataaagaggagagcattttgccttgccagccatttctcnnnnnaanaannaannnnaaannnnnnnaaannnnnnnnnnnnnnnnnnnnnnnnnnnnnnnnnnnnnnnnnnnnnnnnnnnnnnnnnnnnnnnnnnnnnnnccnnnnnaaanagaaaa

SEQ ID NO: 74906 - protein, 149 aa, Zea mays; identical to SEQ ID NO: 59406
  misc_feature: Ceres CLONE 1559308
  misc_feature: SWISSPROT Homolog: EC 6.1.1.9 Valine--tRNA ligase

SEQ ID NO: 74907 - DNA, 908 bp, Zea mays
  misc_feature: Ceres CLONE 1559310
  misc_feature: Encodes the peptide sequence at SEQ ID NO. 74908
  misc_feature (791)..(791): n is a, c, t, g, unknown, or other
aaagctggagctccccgcggtggcggccgctctagaactagtggatcccccgggctgcaggaattcgtctcacccctagaaaaactcgcgcaccaccccaccagcagcaagcgcccactaattccgcaccacaacgcgcactctccggcaccaccgccgtcctcgcgccgtcacatagtacgcattacgcactcgcgcgcgcgcgtacattgatttacgcagcgatgagctcgagaacgcaccacccctgctttgcgtctgtggagtcatgggagcaagcggcgatggcgcacgacggcttcctcggcgatcttgcctgcccgctcccgctcgctcacgctgcaaccgcggcgccgttcgacccgctgcgggtacatgtggcgcaagcgctcacgggcgccggcgcggggtgggaacacgacgccgcgacgggcgcgctcgtgccgtcgcggccgcgaccgctgtcgccgtcgtcgctcgcggcggccaccgccgtagtagttggaggaggaggagacgccgtggaggccgccctgatggagcagcttgcgagcaggctcggcgtcagcgtgccttcgccgccgccatcgcggtacgcgtcctgccacggcacgccggcgggctcccccttcagccggcggcgccgtgggtgctggccggggacgcggcgcctgcggagcgcgccacagggctcccgtgcttcccggcctcctgtggggagctctcgcgcgtgcccagctgccagtcgtcgcttctcggcgagcacgcaccgactccggcgcccgcggcgnttgctggcgctgctaaacacacgcaagccaagggtcctgcaacgatggcccctgccgaaaacgaaaggctcgggcgcaaggcccagggactggtcacaacggcaaacccaatcccgt

SEQ ID NO: 74908 - protein, 228 aa, Zea mays
  misc_feature: Ceres CLONE 1559310
MSSRTHHPCFASVESWEQAAMAHDGFLGDLACPLPLAHAATAAPFDPLRVHVAQALTGAGAGWEHDAATGALVPSRPRPLSPSSLAAATAVVVGGGGDAVEAALMEQLASRLGVSVPSPPPSRYASCHGTPAGSPFSRRRRGCWPGTRRLRSAPQGSRASRPPVGSSRACPAASRRFSASTHRLRRPRRLLALLNTRKPRVLQRWPLPKTKGSGARPRDWSQRQTQSR

SEQ ID NO: 74909 - DNA, 955 bp, Zea mays
  misc_feature: Ceres CLONE 1559312
  misc_feature: Encodes the peptide sequence at SEQ ID NO. 74910
  misc_feature (788)..(788): n is a, c, t, g, unknown, or other
  misc_feature (880)..(880): n is a, c, t, g, unknown, or other
ctccccgcggtggcggccgctctagaactagtggatcccccgggctgcaggaattcgtctcacccctagaaaaaagttccagagccctccagagcaaaaaaaatattatcgaatactaaagcattttcctcgtcgatagaatatagaattttaaaaagggagcgaaataggtttttcctttttgcagctccgtcgtccaccaacctcctccgatccggccgccgcagcgtagccgaattgtcccctcgctagcttctccggccggctagaggctgtttcaggcggcctcgatctcctccgcgcggctgaggaaggagatcacgcggttgctcaggggctggggcgtgcatgatgggattttggttgattccgatggagactccggcgaggcttctgtggagcacgagcttcttccgccacaagatcgccgccatgctcgcctcctcctcctgcttcttatagatcccaccccctcgccgtcgtcgtcggcacggcagctagctcgctagcttctgtacataggtcgacgcgccatatagatactagtctcggattaagcgataattaaggcaaagaatctccaagtttgcttcgctcttgcattgaaccatggagtctggacggctcatcttcaacgcgccgggctctggcgccgggcagatgctcttcctcgactgctgcgcatgcggcggtcccgggcgcggcttgttccatcgagtgacgaatgcgggagaccgatgcttgggccttgagaatggcgcggcgtataacggcctttcttcactcgncagagagctcctcgaggagagtactacgacgagcacttgccggtagaatatcgccgcctcaccccgaacaggtgctctgcctgagaagagcntcgaggagaagacaagctggacccggaacccataacgaactggcgcccaactgggcttgcaccctcgcacagtgt

SEQ ID NO: 74910 - protein, 74 aa, Zea mays
  misc_feature: Ceres CLONE 1559312
  misc_feature (60)..(60): Xaa is any aa, unknown, or other
MESGRLIFNAPGSGAGQMLFLDCCACGGPGRGLFHRVTNAGDRCLGLENGAAYNGLSSLXRELLEESTTTSTCR

SEQ ID NO: 74911 - DNA, 967 bp, Zea mays
  misc_feature: Ceres CLONE 1559313
  misc_feature: Encodes the peptide sequence at SEQ ID NO. 74912
ctggagctccccgcggtggcggccgctctagaactagtggatcccccgggctgcaggaattcgtctcacccctagaaaaaaagcagcagcgaggcggcaccaatgcggcgccggagaagtccgacaagaagtacgcgcacgtcccgacgccgctccaccacggccaccgcggcgccagcaagaaggcaccccgcgggggcaagggcggcgacgttgccgaccccgcggcgtacgtcgcggcggtgtcctgctcggactgccgcttcaagcagcgcgccctcgcgccggcgtcgcccggcgccgtcatccgctcgctgttcgtctccctcacccgccgctccaccccgcgctcgtcgccgtcggcctcgggaggcgccgccgacgccggggacgtcgagcagtggcgcctcgccgcggccgacctctcccgccgtctcgccgcggccacgcgcacgcgggacgaggcgctggaggagaccacgcgcctgaagcactccctcgccgagctggagctcaagctcgcgcgcgtcgaggcgcgcgtgctcccgccccccgccttccccgtcgactccttcctccgcgccgtctcgacctcgcgcgccgccgtgcggaacctcgcgcgcggcgctgtccacccacctccgcagcccctccagccaaggagcctcgagggcttcctcaaccgcgccttccacgccgacttcgagctggacaccgacgccgggatccacacccggacccggcgggccggggcaggccaacctcgcggcgtacaacggccgtccggtgctcaccttgggaggaggtcctgctccaccgcacccagcactacagggaggggctcagccgcttctgcgacgcaagatgaacgagtgtgtccccccccccttgggggggcccgccccccccccggggcctgagcccctgctgaagagctttcttcttggggccaaggggcggtgggggt

SEQ ID NO: 74912 - protein, 305 aa, Zea mays
  misc_feature: Ceres CLONE 1559313
GAPRGGGRSRTSGSPGLQEFVSPLEKKQQRGGTNAAPEKSDKKYAHVPTPLHHGHRGASKKAPRGGKGGDVADPAAYVAAVSCSDCRFKQRALAPASPGAVIRSLFVSLTRRSTPRSSPSASGGAADAGDVEQWRLAAADLSRRLAAATRTRDEALEETTRLKHSLAELELKLARVEARVLPPPAFPVDSFLRAVSTSRAAVRNLARGAVHPPPQPLQPRSLEGFLNRAFHADFELDTDAGIHTRTRRAGAGQPRGVQRPSGAHLGRRSCSTAPSTTGRGSAASATQDERVCPPPLGGARPPPGA

SEQ ID NO: 74913 - DNA, 964 bp, Zea mays
  misc_feature: Ceres CLONE 1559315
  misc_feature: Encodes the peptide sequence at SEQ ID NO. 74914
  misc_feature (687)..(687): n is a, c, t, g, unknown, or other
  misc_feature (872)..(872): n is a, c, t, g, unknown, or other
ctggagctccccgcggtggcggccgctctagaactagtggatcccccgggctgcaggaattcgtctcacccctagaaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggcctgccaggtcgtgctcatgggcgccatcgagggggtaccgcgtcgccggcggcccgctcnagagaggtcgtcgacccgctctaccccggcggcatcttcgacccgctcggcctcggcgacgaccctgaaggcctcgccggagctcaaggtgaaggactcaaaaacgggccgcctcgccatgttctccatgttcggggtcttcgtccaggccatcgtcaccggcaaggcccgcttgagaaacttgncgaacaacttggcgaccggtaaaaaaaagaagggccttagcccccacttttgccgcaaaaatgtgggggggtggaagcccccccccccccgc

SEQ ID NO: 74914 - protein, 274 aa, Zea mays
  misc_feature: Ceres CLONE 1559315
  misc_feature (64)..(233): Pfam Name: Chloroa_b-bind Pfam Description: Chlorophyll A-B binding protein
  misc_feature (182)..(182): Xaa is any aa, unknown, or other
  misc_feature (244)..(244): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAIEGVPRRRRPAXERSSTRSTPAASSTRSASATTLKASPELKVKDSKTGRLAMFSMFGVFVQAIVTGKARLRNLXNNLATGKKKKGLSPHFCRKNVGGWKPPPPR

SEQ ID NO: 74915 - DNA, 921 bp, Zea mays
  misc_feature: Ceres CLONE 1559316
  misc_feature: Encodes the peptide sequence at SEQ ID NO. 74916
  misc_feature (663)..(663): n is a, c, t, g, unknown, or other
  misc_feature (696)..(696): n is a, c, t, g, unknown, or other
  misc_feature (748)..(748): n is a, c, t, g, unknown, or other
  misc_feature (753)..(753): n is a, c, t, g, unknown, or other
  misc_feature (755)..(755): n is a, c, t, g, unknown, or other
  misc_feature (756)..(756): n is a, c, t, g, unknown, or other
  misc_feature (763)..(763): n is a, c, t, g, unknown, or other
  misc_feature (764)..(764): n is a, c, t, g, unknown, or other
  misc_feature (808)..(808): n is a, c, t, g, unknown, or other
  misc_feature (828)..(828): n is a, c, t, g, unknown, or other
ctggagctccccgcggtggcggccgctctagaactagtggatcccccgggctgcaggaattcgtctcacccctagaaaaagccgcctgcgtccacctccgctcgccgctctccccgcgtatccctctcatacgcagctcgcccaggtaagatgtcgtccgtggcgtcgaaggtggcggtgccggagtctgtgctccgcaagcggaagcgcgaggaacagtgggccaccgagaagaaggagaaggccctagtcgagaagaagaagtccatcgagagccgcaagctcatcttcacccgcgcaaagcagtacgccgaggaatacgatgcccaggagaaggaactggtgcagcttaagcgtgaggcccgtttgaagggtggtttctatgtcagtcctgaagcaaagctgctctttgtggtccgcatccggggtattaacgccatgcaccctaagaccaggaagatcttgcagcttctgcgattgaggcagatcttcaatggtgtgttcctcaaagtcaacaaggcgactattaacatgctacgcagggttgagccatatgttgcatatgggtacccaaacttgaagagtgtcaggggagttgatctacaagaggggctatggaaagctgaacaagcagaggatccctctgtccaacaaccaagtcantcgagagggcttgggcaagcacaacatcatctngcattgaggatcttgttcacgagatcatgactgttgggccacacttcaaggnagccnanncacttcnntgtggcattcaagttgaaggcgcccgctgggaagccctgagaanagaagaaccactttttgganggcgggtgatgcccggtaccgcgagactacatcatgagctcatcaaaagatgaattagtcccgataagctcattgatagaccctgggctctaa

SEQ ID NO: 74916 - protein, 191 aa, Zea mays
  misc_feature: Ceres CLONE 1559316
  misc_feature (13)..(83): Pfam Name: Ribosomal_L30_N Pfam Description: Ribosomal L30 N-terminal domain
  misc_feature (85)..(136): Pfam Name: Ribosomal_L30 Pfam Description: Ribosomal protein L30p/L7e
  misc_feature (171)..(171): Xaa is any aa, unknown, or other
MSSVASKVAVPESVLRKRKREEQWATEKKEKALVEKKKSIESRKLIFTRAKQYAEEYDAQEKELVQLKREARLKGGFYVSPEAKLLFVVRIRGINAMHPKTRKILQLLRLRQIFNGVFLKVNKATINMLRRVEPYVAYGYPNLKSVRGVDLQEGLWKAEQAEDPSVQQPSXSRGLGQAQHHLALRILFTRS

SEQ ID NO: 74917 - DNA, 887 bp, Zea mays
  misc_feature: Ceres CLONE 1559317
  misc_feature: Encodes the peptide sequence at SEQ ID NO. 74918
  misc_feature (644)..(644): n is a, c, t, g, unknown, or other
  misc_feature (775)..(775): n is a, c, t, g, unknown, or other
ctggagctccccgcggtggcggccgctctagaactagtggatcccccgggctgcaggaattcgtctcacccctagaaaaagctcgcactcgcggagatcgaagagaagcgcaggaggccccagcactagcgccgccccgccgccgcatcagacatggcgctggccgctcgcctcgtctcgcgctcccgtcagctatacaagccgcaccgcaattagccgcgaccctccgcagaatcggctcacgtttccgatccagaggtccagactgttccccgagttttcctcgcgagtcccggcgaaccgcgaacatgtgccccactggaaggtacctggggctcgacctctccggcgctggcggcgacctgaggccggcgttcgacgtgcttgacgcggaccgggacggccgcatcagccgggacgacctcaagtccttctacgccgccgcggggcccgccgccggcgaccggttcgacgacgacgacctcgcggccatgatcgcggccgccgacgccgaccgcgacggcttcgtgcagtacgacgagttcgagcgcctgctggccggccgcgccgcggcggccgccgccgcgggaggcgctgggcgccgcccgccatggagggcgccttccggctcatggaccgtgacngggactgcatggtcggcttccatgacctcaggcctacctcgactgggccgggatgcccgcgccggaacaagatgtccgcgccatgatccgcgtcgctgggcgatgggacggcggtgaaggcttggggctcnagccgctagcggtatgcctccggtcgaccgggaaggcatcgcttttgatttgaaaatccccagggaaattttgtgcggatactgtatctcttttcctgggggtttcgggtgg

SEQ ID NO: 74918 - protein, 150 aa, Zea mays
  misc_feature: Ceres CLONE 1559317
  misc_feature (58)..(86): Pfam Name: efhand Pfam Description: EF hand
  misc_feature (18)..(46): Pfam Name: efhand Pfam Description: EF hand
MCPTGRYLGLDLSGAGGDLRPAFDVLDADRDGRISRDDLKSFYAAAGPAAGDRFDDDDLAAMIAAADADRDGFVQYDEFERLLAGRAAAAAAAGGAGRRPPWRAPSGSWTVTGTAWSASMTSGLPRLGRDARAGTRCPRHDPRRWAMGRR

SEQ ID NO: 74919 - DNA, 1060 bp, Zea mays
  misc_feature: Ceres CLONE 1559319
  misc_feature: Encodes the peptide sequence at SEQ ID NO. 74920
  misc_feature (323)..(323): n is a, c, t, g, unknown, or other
  misc_feature (328)..(328): n is a, c, t, g, unknown, or other
  misc_feature (338)..(338): n is a, c, t, g, unknown, or other
  misc_feature (339)..(339): n is a, c, t, g, unknown, or other
  misc_feature (351)..(351): n is a, c, t, g, unknown, or other
  misc_feature (920)..(920): n is a, c, t, g, unknown, or other
  misc_feature (939)..(939): n is a, c, t, g, unknown, or other
  misc_feature (999)..(999): n is a, c, t, g, unknown, or other
  misc_feature (1002)..(1002): n is a, c, t, g, unknown, or other
  misc_feature (1033)..(1033): n is a, c, t, g, unknown, or other
  misc_feature (1036)..(1036): n is a, c, t, g, unknown, or other
  misc_feature (1043)..(1043): n is a, c, t, g, unknown, or other
gctggagctccccgcggtggcggccgctctagaatagtggatcccccgggctgcaggaattcgtctcacccctagaaaaaagcccgacgccggcgccggcgccgctgctcgcctgctcgtcacatttcctggtgcccgccaagccccgcgacctgggctccccagctccatccatcaaccgcctgcagccgcggaaatggcagcgccgacgacgctgcgctcggcggcggcgcgggcgcgcgcgcgcgcagcggagctcgtgagagggcggtggccgcagcggcgtctggggacgacgtccgcggcggagacgagacaaaaanaatangggagatganngagagggggccngggtgggaactctcggcgggcgcggagtactacgactaccgcaagtctatctacggggacgtcacggaccgggcccctctcgtcgacgccagtcggcaccctcgtcgtcccccgcccagcccaccgggaaagggggataaagagcatttggtgaaaaaagttgggaagggaaaataccccggaaaaccaaaaccccggaatgaaataccgggcgggggaaaaaaaacaacccagggggggggaatcccccccaaggtatggggaattaaagggaaaaaacccttttgggaaccaaaaaagcccccttttttttcccagaggagttttaaaaaaacccaaaaactttttggggagaaactcttttcaatatcctttaaggaaaaaaaaaaagccgggggagattttggtggcccccccatcccccaaaaggggttttttaaaaacttttaaaaaaaacacgcgggttaaaaaccgcccgccccccccaaaattaaaaaaccacctctaatagcccaccccccgggggggccctcaaaaaaaacacccccggtgggtggagcggggggccnccccccgagaaaagggggncgacaaaaaaaaaaccccacaaaaaatattttttttcccggccgggttttttgttggcgnggncacccaccaaaaaaaagaaggcccggcgcgnccnccccccnaaaaaaatatatggggg

SEQ ID NO: 74920 - protein, 46 aa, Zea mays
  misc_feature: Ceres CLONE 1559319
  misc_feature (43)..(43): Xaa is any aa, unknown, or other
  misc_feature (44)..(44): Xaa is any aa, unknown, or other
MAAPTTLRSAAARARARAAELVRGRWPQRRLGTTSAAETRQKXXGR

SEQ ID NO: 74921 - DNA, 965 bp, Zea mays
  misc_feature: Ceres CLONE 1559321
  misc_feature: Encodes the peptide sequence at SEQ ID NO. 74922
  misc_feature (680)..(680): n is a, c, t, g, unknown, or other
  misc_feature (787)..(787): n is a, c, t, g, unknown, or other
gctggagctccccgcggtggcggccgctctagaactagtggatcccccgggctgcaggaattcgtctcacccctagaaaaaaaaaccaacaaaatgttgttcgaggcgttcccctcctccacgcaaccttctcccctccagatccaggattgccgggctccttgactcgttacctcgcgcgccctcggtgagctactttgtttcgatttagcgacaaatcagtttgcttcatgttgcgcaggcttagatctgttcttcgtcttacggcttgaatcgagctgggaggccgtggatctgagcacgggagatacaacaaatccgcgtgtatgacgagttggatcggcaccggttctagagctagcgaaatcgcaaggctattagggttccgttcggagcgcgtctgaagcgatgatggctgaagacggcggcgggatcgggatgatgaatctgctgcgctgataattattggatgaatttcgataattattagatctaagagatgcgccgacttgaagaggcgaggtaaggtgcaacaggtataagacgtgacatgctatagaggcctttgccatggtgggtgcgctcgcatggcatgccacggtaataaaagaagatatttttgtgtcctggggggtggagatcgcacggggggattgttttttttggccccggagtctccntccctcgtgggggtccggggtccctgggtgcattggtcttttgcgtgggttgcgatctcagctcacctacacgctttgggatttttgcatcttacacggagatctancacaaaaacaaacatggagctacagcgacattcttaaagtacaatcggttatttagggtaccattaagtttcttttctcatctctgacccccgatttgtatcctatgtccccctctgcccattcaagaaccgtttaaccccttgaatatgacatccgcgccccctttgcccaactggt

SEQ ID NO: 74922 - protein, 90 aa, Zea mays
  misc_feature: Ceres CLONE 1559321
  misc_feature (37)..(37): Xaa is any aa, unknown, or other
  misc_feature (73)..(73): Xaa is any aa, unknown, or other
MVGALAWHATVIKEDIFVSWGVEIARGDCFFWPRSLXPSWGSGVPGCIGLLRGLRSQLTYTLWDFCILHGDLXQKQTWSYSDILKVQSVI

SEQ ID NO: 74923 - DNA, 877 bp, Zea mays
  misc_feature: Ceres CLONE 1559323
  misc_feature: Encodes the peptide sequence at SEQ ID NO. 74924
ctccccgcggtggcggccgctctagaactagtggatcccccgggctgcaggaattcgtctcacccctagaaaaaagcgcacctcatctcgctccaagcacaccaccactccacagtgcacttcactctctacagcaacagaaaagtgagcagcagacagcagcagctgctgccatggaggcgtggagatctctcctcgcgagcttcgtgctcgccgtgctggccgcgcaggccttggtggccgtggtcgagtccaggaccggtcccgtggagcaggcgagcgaaggtgacgacgtgaagaagccggactgcgtgccggggatggacccgcgctcgttcccggggaccggcggcggccacggcatcacgcccgtgacgccatcgcacggaggctccagctccccgacgccgtcccacggcggcggcggcgggtacgttccaacgccgtcgcatggcgggacgctgcctttcccgtcccacggcggctccggctccggctcctctccgacgtcgccctccaccggcggcggcgcgtacggtgggtctccgtccacccccggcggtggcgcgtacggtgggtctcctccgtccacccccagcggcggcggcgcgtatggtgggtctccgtctactcccagcggtggcggcgcctacggaggcgggtccccctcgcctgctcatggtgctggtggcgcctatgggagctctccgacgcccgcgatcggggattcccccttgcagggcgggatccgggactcgtcaccgaagacatttgttcccatggacccccacagcctccggacctgggacaacgggaggccgacccggatggaaatctggtcggggggcggccggccgtttcccaacaactgctcgcg

SEQ ID NO: 74924 - protein, 234 aa, Zea mays
  misc_feature: Ceres CLONE 1559323
MEAWRSLLASFVLAVLAAQALVAVVESRTGPVEQASEGDDVKKPDCVPGMDPRSFPGTGGGHGITPVTPSHGGSSSPTPSHGGGGGYVPTPSHGGTLPFPSHGGSGSGSSPTSPSTGGGAYGGSPSTPGGGAYGGSPPSTPSGGGAYGGSPSTPSGGGAYGGGSPSPAHGAGGAYGSSPTPAIGDSPLQGGIRDSSPKTFVPMDPHSLRTWDNGRPTRMEIWSGGGRPFPNNCS

SEQ ID NO: 74925 - DNA, 921 bp, Zea mays
  misc_feature: Ceres CLONE 1559324
  misc_feature: Encodes the peptide sequence at SEQ ID NO. 74926
  misc_feature (817)..(817): n is a, c, t, g, unknown, or other
  misc_feature (820)..(820): n is a, c, t, g, unknown, or other
  misc_feature (834)..(834): n is a, c, t, g, unknown, or other
  misc_feature (835)..(835): n is a, c, t, g, unknown, or other
  misc_feature (837)..(837): n is a, c, t, g, unknown, or other
  misc_feature (866)..(866): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (907)..(907): n is a, c, t, g, unknown, or other
ctggagctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgtgacaccgcgtggctgtcggcggacccggagacgttcgccaagatccggtagctggtagtgatccactcccgctgggccatgctgggcgcgctcggctgcgtcttcccggagctgctcgcccgcaacgggcgtcaagttccggcgagggccgtgtgggtcaaaggccggctccccaaatctccaagggaggggggactgggactaactccggggaaacccagaacccctttccacgggccaaaaaaatcccccccccatttggggcccctgcccaggtgtgtggtctcatggggccccctccaaaaagggtaaaacaattttccccggggggggcccccttttggggagagaaagttcgtgaaacaacccctttttttatttgggggggggggggggttttttttaaacccccgtgggcggggccgccccntcnttccaaaaaaaaanntncccgacgccccccgccccccccccccttntnnnnggggggggggggggggggggaggggggagannnncnccaaaacccccccc

SEQ ID NO: 74926 - protein, 96 aa, Zea mays
  misc_feature: Ceres CLONE 1559324
MASSTMALSSTAFAGKAVNVPSSSAFGEARVTMRKTAGKAKPAAASGSPWYGPDRVLYLGPLSGEPPSYLTGEFPGDYGCDTAWLSADPETFAKIR

SEQ ID NO: 74927 - DNA, 973 bp, Zea mays
  misc_feature: Ceres CLONE 1559325
  misc_feature: Translation starting site: 165
  misc_feature: SWISSPROT Homolog: EC 3.2.1.14 Chitinase
  misc_feature (387)..(387): n is a, c, t, g, unknown, or other
  misc_feature (443)..(443): n is a, c, t, g, unknown, or other
  misc_feature (468)..(468): n is a, c, t, g, unknown, or other
  misc_feature (557)..(557): n is a, c, t, g, unknown, or other
ctggagctccccgcggtggcggccgctctagaactagtggatcccccgggctgcaggaattcgtctcacccctagaaaaaaaatcacctcacaacaagctgccccgcagcaacgaacacgaaccttggcagaacgaagctgaagtagttcgttgtgaacccagtatggcaaacgcgccgaggatcctggccctcggcctgctgctagcgctcctgtgcgctgccgccggcccggccgccgcgcagaactgcggctgccagcctaacttctgctgcagcaagttcggctactgcggcacgaccgacgactactgcggcgacgggtgccagtcgggcccgtgccgctcgggcggcggcggcggcggcggcggaggcggaagcagtggcngtgcgaacgtggctaacgtggtcagcgacgcgttctttcacgggcatcagaaccangcccgggagcgggtgcaagggcaantacttctacaccccggagcgcgttccctgagcgccgtcaacaagtacccggggcttcgcccatggccgggacggaaggggaagggcaanccccaaattcccggcctttttcgcgcacgttaagcacgaaaccggaaattttccgctacttccagcgaatcaacagagagcaccccctagggggaaccaaaaaaaaggaaatgggccctgcccccgggggcaaaaaattctaagggggccggccccccggaaatttcccgggaaaccaaccccggggccccccggggggaaaactgttttaaaggggtccccccaaccccaagggggggggaaggaccccccttttccctttaaaaaggcgcctttttttttagaagaaaaacaacccccccctttggtatccccgggggttttccccccccccctggggggttctagcggcccctctagagggggaaaaccccccccgcagaagaggggcgcgccgtgctataaaaagagcgggc

SEQ ID NO: 74928 - DNA, 947 bp, Zea mays
  misc_feature: Ceres CLONE 1559326
  misc_feature: Encodes the peptide sequence at SEQ ID NO. 74929
  misc_feature (787)..(787): n is a, c, t, g, unknown, or other
tggagctccccgcggtggcggccgctctagaactagtggatcccccgggctgcaggaattcgtctcacccctagaaaaagcgccaatcaactcaccctcccctccggcttccgcggaactaggagctgccatgcagcccgacgccaacgctccctcgcaccgcctcgcccgcgtcgccgcgcacctaaacccccagcggccgcagatggaggaaggcgcgtccgcactgaggcccgtggtgtgccgcgccaagggcggcgcgccggggttcaaggtcgcgatcctgggcgccgcgggcgggatcggacagccgctgtcactgctcatgaagatgaatcctctcgtgtccgtgctgcacctctacgatgtcgtcaacacgcccggggtcacggccgatgtcagccacatggacaccagtgctgtggtccgtggcttccttggggcacagcagcttgatgccgcacttacaggaatggaccttgtaatcatacccgctggactccctaggaaaccaggaatgacaagagatgatttattcaacaaaaatgctgggattgttcgtacactctgtgaaagcgttgcaagatgctgtcctaatgcaattgtgaatctgatcagcaacccagtgaactcaactgtccccattgctgctgaggttttcaagaaagctggaacttatgatcccaagcgggcttcttggagtgacaacactcgatgttgcgagggctaacacctttggtggccgaagtctttggagttgatcaagagatgtcagtggtcccttgtngttggagggcatgctgggataactatagtgcccctccctctccaggttaccctcccgagctcatccctcaggatgaaaccggatattgacagaccccatacgatggttggccaatagttgtggaggcaaaggctgaacaggctcgcgacctggcaagggt

SEQ ID NO: 74929 - protein, 199 aa, Zea mays
  misc_feature: Ceres CLONE 1559326
  misc_feature (47)..(190): Pfam Name: Ldh_1_N Pfam Description: lactate/malate dehydrogenase, NAD binding domain
  misc_feature: SWISSPROT Homolog: EC 1.1.1.37 Malate dehydrogenase
MQPDANAPSHRLARVAAHLNPQRPQMEEGASALRPVVCRAKGGAPGFKVAILGAAGGIGQPLSLLMKMNPLVSVLHLYDVVNTPGVTADVSHMDTSAVVRGFLGAQQLDAALTGMDLVIIPAGLPRKPGMTRDDLFNKNAGIVRTLCESVARCCPNAIVNLISNPVNSTVPIAAEVFKKAGTYDPKRASWSDNTRCCEG

SEQ ID NO: 74930 - DNA, 960 bp, Zea mays
  misc_feature: Ceres CLONE 1559327
  misc_feature: Encodes the peptide sequence at SEQ ID NO. 74931
  misc_feature (919)..(919): n is a, c, t, g, unknown, or other
aaagctggagctccccgcggtggcggccgctctagaactagtggatcccccgggctgcaggaattcgtctcacccctagaaaaactgaagctaccgatctctccggtcgcgtttgcatccgtattcctcacatggatattgtagccccagccccgcttcaagatccagctagctctctatcaagcatccggcggatcgagcagcggggggctcggcgagagagaacatgaagcggaagacgcgggaacaagatcatcgtatggacactggccgtggctgcagtggcgattctggtgggcggcacgattgcgctggtgctcacggcggggacgtggaaggccaacataaagaagtcgcaggagaagatctgtaacaaggggtgggagtgctcggggagcaagtactgctgcaacgacaccatcaccgacttcttcaaggcgtaccagttagagaacctcttcgccaagcgcaacacccccgtggcgcacgccgtctggttctgggactaccaggccttcatcacagccgcggccctcttcgagccccaggggggttgctgcagcaccggcggcaagcagatgcagatgatggagctctgcgccttcctcgggcacgtcggcgccaagacttcatgtgcgtacggcgtggcgaccggcgggccgacagcatgggggctgtgctacacccacgagatgagccccgaccagacctactgcgactagacctacgcccagtacccctgcgtcgagggcgccgagtactacggccgatgcgcgattcctgtctactggactacactacggcgctgcccgtgacgggaatcaggcggatctgctccaccaccagagtacctggagcaaacgcgacgctgcatccatggcggcaaagtgccggtggatacccctatcagaaaagcaancttgggggaagacccttcgtgggcattgaagcccaccatac

SEQ ID NO: 74931 - protein, 47 aa, Zea mays
  misc_feature: Ceres CLONE 1559327
  misc_feature: SWISSPROT Homolog: EC 3.2.1.14 Chitinase
MQMMELCAFLGHVGAKTSCAYGVATGGPTAWGLCYTHEMSPDQTYCD

SEQ ID NO: 74932 - DNA, 905 bp, Zea mays
  misc_feature: Ceres CLONE 1559328
  misc_feature: Encodes the peptide sequence at SEQ ID NO. 74933
  misc_feature (742)..(742): n is a, c, t, g, unknown, or other
  misc_feature (797)..(797): n is a, c, t, g, unknown, or other
aaagctggagctccccgcggtggcggccgcctcagaactagtggatcccccgggctgttggaattcgtctcacccctagaaaaaacctccgcacttccgctctccagaaccccgcgcgtcccctcgcatcgtccctctctccgccgactccaaaccctaacccgcgcgcttacctcctcgtcccctcaggccatggcgtcgtcccctacccccaagaaggtgctggtcccgatcgcgaatgggacggagccgatggaggcggtcatcaccatcgacgtgctccggcgcgcgggggccgatgtcgccgtcgcttccgtcgagccgggggcgacgtccgtagctgcctcatggggcatcaagcttaccgccgacgcgctcctcgccgacctcgcggacgatgagttcgatctcatctctctaccgggagggatgcctggttcttcgacttttggagagtgcaaagttttggagaaaatggtcaaaaaacatgtagagaagggcaagctttatgctgcaatttgcgctgcaccagcaatgactctaggaacttggggtttgctcaatggcttaaaggcaacatgttatccttcgttcattgataaacttccttcagaagtacatgctgtggaatcaagagtgcagattgatgggaaatgtatgaacagtcgtggaccggggaacagcatggagtattctgttattttggctgagcaactatatggaaaggaaaaagctaaagaangtgctggggccaatggttatgcgtcctcagcatggtgtgggaattctctatgaanaaggggaattcactagtgggaatggtgggtgaaaccccaatattctagtacaatcccctatgggaaagaggatatggaaccactatgaatattgacattttgcgaggc

SEQ ID NO: 74933 - protein, 200 aa, Zea mays
  misc_feature: Ceres CLONE 1559328
  misc_feature (36)..(176): Pfam Name: DJ-1_PfpI Pfam Description: DJ-1/PfpI family
  misc_feature (184)..(184): Xaa is any aa, unknown, or other
MASSPTPKKVLVPIANGTEPMEAVITIDVLRRAGADVAVASVEPGATSVAASWGIKLTADALLADLADDEFDLISLPGGMPGSSTFGECKVLEKMVKKHVEKGKLYAAICAAPAMTLGTWGLLNGLKATCYPSFIDKLPSEVHAVESRVQIDGKCMNSRGPGNSMEYSVILAEQLYGKEKAKEXAGANGYASSAWCGNSL

SEQ ID NO: 74934 - DNA, 994 bp, Zea mays
  misc_feature: Ceres CLONE 1559329
  misc_feature: Encodes the peptide sequence at SEQ ID NO. 74935
  misc_feature (490)..(490): n is a, c, t, g, unknown, or other
  misc_feature (555)..(555): n is a, c, t, g, unknown, or other
  misc_feature (648)..(648): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (778)..(778): n is a, c, t, g, unknown, or other
  misc_feature (810)..(810): n is a, c, t, g, unknown, or other
  misc_feature (811)..(811): n is a, c, t, g, unknown, or other
  misc_feature (918)..(918): n is a, c, t, g, unknown, or other
ctggagctccccgcggtggcggccgctctagaactagtggatcccccgggctgcaggaattcgtctcacccctagaaaaacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggagcagtgacaccctgccaatctacgagcctggtctcgatgatgttgtgaagcagtgcaggggcaggaacctcttcttcagcactgatgttgagaagcacgtcgctgaggctgacattatcntttgtcttcggtgaacacccccaccaagacccgtggggcttggagctggcaagggctgccgaccntcacctactggggagagcgctgcccgcatggaatgcggatgttctccaagtctgggcaagattgtttgttgagaaagtccaactgtcccctgntcaagaccggctgaagctaatttgagaacagatcttgaccccacacagcaaggggcatcaactaccagatccttttccaaacccagagttcccttggcggagggcactnnnccattgaggacctgttcanggcctgacgaattgccttatcggttgcccggnnagaacctttgagggtcaagaaggccgtcaggccccctcaggatgtgtacccctcactgggtccccgaagacagatccttcaccacccaacttgttggtctgctgagntctcaagcttgcggtgcaagcgttccggggaaaaaagatctccctgtggaacccatctccgccctctggagtcccc

SEQ ID NO: 74935 - protein, 86 aa, Zea mays
  misc_feature: Ceres CLONE 1559329
  misc_feature (2)..(86): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature (83)..(83): Xaa is any aa, unknown, or other
MVKICCIGAGYVGGPTMAVIALKCPDIEVVVVDISKPRIEAWSSDTLPIYEPGLDDVVKQCRGRNLFFSTDVEKHVAEADIIXCLR

SEQ ID NO: 74936 - DNA, 950 bp, Zea mays
  misc_feature: Ceres CLONE 1559332
  misc_feature: Encodes the peptide sequence at SEQ ID NO. 74937
  misc_feature (831)..(831): n is a, c, t, g, unknown, or other
  misc_feature (940)..(940): n is a, c, t, g, unknown, or other
ctggagctccccgcggtggcggccgctctagaactagtggatcccccgggctgcaggaattcgtctcacccctagaaaaaaccaacctcagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttcggcctccagcggttccgcgagtgcgagctcatccacggccgctgggccatgctcgccaccctcggcgccctctccgtcgagtggctcaccggcgtcacctggcaagacgccggcaaggtggagctgggtggacgggtcctcctacctgggccagccgctgccgttctccatctcgacgctcatctggatcgaggtgctcgtgatcggctacatcgagttccagcgcaacgccgagctcgacccggagaagagctgtacccgggcggctcctacttcgacccgctccgcttgggcgccgaccctgagaagaaggacngctgcagctggcgagatccagccgcgcgcctcgccatggtcgccttcctcggcttcgccgtgcaaggcgccgccaccggcaaggggcgctcacaactgggccacccccntgacgacccc

SEQ ID NO: 74937 - protein, 276 aa, Zea mays
  misc_feature: Ceres CLONE 1559332
  misc_feature (63)..(260): Pfam Name: Chloroa_b-bind Pfam Description: Chlorophyll A-B binding protein
  misc_feature (237)..(237): Xaa is any aa, unknown, or other
  misc_feature (273)..(273): Xaa is any aa, unknown, or other
MASSVAAAASTFLGTRLADPAPQNGRIVARFGFGLGGKAKPAPKKVAKTSTSSDRPLWFPGAVAPDYLDGSLVGDYGFDPFGLGKPVEYLQFELDSLDQNLAKNEAGGIIGTRFESSEVKSTPLQPYSEVFGLQRFRECELIHGRWAMLATLGALSVEWLTGVTWQDAGKVELGGRVLLPGPAAAVLHLDAHLDRGARDRLHRVPAQRRARPGEELYPGGSYFDPLRLGADPEKKDXCSWRDPAARLAMVAFLGFAVQGAATGKGRSQLGHPXDDP

SEQ ID NO: 74938 - DNA, 971 bp, Zea mays
  misc_feature: Ceres CLONE 1559333
  misc_feature: Translation starting site: 144
  misc_feature (395)..(395): n is a, c, t, g, unknown, or other
  misc_feature (600)..(600): n is a, c, t, g, unknown, or other
gctggagctccccgcggtggcggccgctctagaactagtggatcccccgggctgcaggaattcgtctcacccctagaaaaactcgctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatnggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgagtccaaggtgaacgagactaaagcnacccgtcaaggtccagcttcaagaggtctttttgcctgggggtggttcgccttggcaaactcgggcgatttgagaagaagcagatcccgcagaacatcccagatgagcgtccaacttgcttggtttcccttcctgagaagaaactggccaattgtgagatgctctaccttcaagacccccatgggaagcccattcggggggtcctaagttgccccctttgggaaaacctgctagttcctggcccaaaggttaattgattaaccttttgttaaaaatatggttttgaacaaccctaatttcccccgggcctccattgttttcaaaagggggacacaacataagtccccggcccttagtaaaaaaaaaaaaaa

SEQ ID NO: 74939 - DNA, 911 bp, Zea mays
  misc_feature: Ceres CLONE 1559334
  misc_feature: Encodes the peptide sequence at SEQ ID NO. 74940
  misc_feature (785)..(785): n is a, c, t, g, unknown, or other
  misc_feature (837)..(837): n is a, c, t, g, unknown, or other
  misc_feature (867)..(867): n is a, c, t, g, unknown, or other
ctggagctccccgcggtggcggccgctctagaactagtggatcccccgggctgcaggaattcgtctcacccctagaaaaaagggagatggagagagcggcccccgtgaggagctcccacacctcgacggctggcctgctcgcgtggcctcaccccgatggcgccgggtcgctgccagcacgccggcctaaccagccgacggaggaattcaggaatgtggtgtttggggggcagctcacggagggggccgacggcctcaacaagacgaagaggaagacgggctcctcgcccaaggggaaggagacaacagggaccgggatatccaaggccgagagcgccgtcgcaactgcctcccgtgatcgtcaggctagccagatcaccttttcccaggacgggaccgttcctaccaggaaggcaacctcagtggctggggtggcaaggcagcgtgagcttagccataccgtcgagagtgagggggacagtaagatgaagaggcaggtgtccagtacgaaatccaaggagctcagtggtcacgacatctttgccgatcacgaagatcccaagcccaacaggtcaaggagatcagactatggcagctctgctgctcagtcaccagtgaaaaatgcaaatgtgagctccttctcgtttggagaggccgacattgacagcacagtgaaaacagcaaagaagaaagggtccagcagcttgtctactgatctgaacggcaagaccatgccaagaaggattcagcgtctgcagagaacagccctccgaacgtgcgatgcngtaaggaatgagtggcagcagcaattttgcagacgggaaggccctcactccnacacggagatcatgaaaggcgtcgtacccngcagccctctgcggcgacagcagcattttgctgggctagcgtgc

SEQ ID NO: 74940 - protein, 275 aa, Zea mays
  misc_feature: Ceres CLONE 1559334
  misc_feature (251)..(251): Xaa is any aa, unknown, or other
  misc_feature (261)..(261): Xaa is any aa, unknown, or other
MERAAPVRSSHTSTAGLLAWPHPDGAGSLPARRPNQPTEEFRNVVFGGQLTEGADGLNKTKRKTGSSPKGKETTGTGISKAESAVATASRDRQASQITFSQDGTVPTRKATSVAGVARQRELSHTVESEGDSKMKRQVSSTKSKELSGHDIFADHEDPKPNRSRRSDYGSSAAQSPVKNANVSSFSFGEADIDSTVKTAKKKGSSSLSTDLNGKTMPRRIQRLQRTALRTCDAVRNEWQQQFCRREGPHSXTEIMKGVVPXSPLRRQQHFAGLAC

SEQ ID NO: 74941 - DNA, 951 bp, Zea mays
  misc_feature: Ceres CLONE 1559335
  misc_feature: Encodes the peptide sequence at SEQ ID NO. 74942
  misc_feature (596)..(596): n is a, c, t, g, unknown, or other
ctggagctccccgcggtggcggccgctctagaactagtggatcccccgggctgcaggaattcgtctcacccctagaaaaaattatccccccggagctggtgcgcgagtcggagctggtgcagggtcacccttcccctcggcctcaagagctctgcggttgccgcggccaagggcgtccgtggagaagcgggagcaggtggcggcgatggaagagcaaggcggccaggcggcgctcggatgggcggccagggacgactccggcgtcctctccccctacagcttctccagaagggttcctaaagacgacgatgtcacgatcaaggtgctctactgcgggatctgccacaccgacctgcacgtcatcaagaacgactggcgaaacgccatgtacccagttgtcccggggcacgagatcgtgggcgtggtgaccggcgtcggcggcggcgtcacgcggttcaaggccggcgacacggtcggcgtgggctacttcgtggggtcctgccgctcctgctacagctgcggcaagggggacgactactactggcgcggggatcgtgctcacctccaacggcgtcgaccacgcgcacggcggcgcngccaccatgggggggattctccgacgtcctggtcgcgagcgagcactacggtgttccgcgtccccctactgcctggcgctggaacgcaacgggccgctgctctgcgcccggcgtcaccttgtacagccccatgatgcgcccggcctcaactagccgggaagaaccttggggtcctcggccccgggggcccgggcacattgccgtaagttcggaaagcccttcgggatagaaggtaccgttattaaaccgtcccccaaaaaaggccagaaggcctttgagaacccgggggcgggaaaattcccctaccccggggaaagaaaaaaataaaggggcgcaggggacatgggggggcttt

SEQ ID NO: 74942 - protein, 174 aa, Zea mays
  misc_feature: Ceres CLONE 1559335
  misc_feature (33)..(171): Pfam Name: ADH_N Pfam Description: Alcohol dehydrogenase GroES-like domain
  misc_feature: SWISSPROT Homolog: EC 1.1.1.195 Cinnamyl-alcohol dehydrogenase
  misc_feature (131)..(131): Xaa is any aa, unknown, or other
MEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFVGSCRSCYSCGKGDDYYWRGDRAHLQRRRPRARRRXHHGGDSPTSWSRASTTVFRVPLLPGAGTQRAAALRPASPCTAP

SEQ ID NO: 74943 - DNA, 931 bp, Zea mays
  misc_feature: Ceres CLONE 1559336
  misc_feature: Encodes the peptide sequence at SEQ ID NO. 74944
  misc_feature (648)..(648): n is a, c, t, g, unknown, or other
ctccccgcggtggcggccgctctagaactagtggatcccccgggctgcaggaattcgtctcacccctagaaaaaatccacacacacacgacacagcagagagattactacgatccaacagttctagagcaagagagaggaagacacaccgcagagttagcaggctaataacttgcaggagcagcacgaatggcggcgacgcgtcacctctcttgctttctcctcgccgtgcttctggcatgagtggccgctgccaccgccttcgacgaagcggctgctgccggcttcgggcttggccacagcgcgcgtttcgcgcgctagcttggacgtgctgccgctgagatgccccagccggagccacaacctagaactaagccggagccccatatgcagccactgccgcatccagaacctaaacctatacctatgcctcatccagagccaaagcctgaacctcaacgaaagccgaagacatgacctcaaccaatgctcaagtctcatacatgatcctaaccatagccattgcctagaccgaagcgtgaacctaagcccgattctaaagtcagacttaagtcccgaacttaatataaaaccagaggcaaaaacttgtaccataagcggagccgttgccagaacattaaccttgagntaaagccgagggtaaatccagacctaaacaagaggcaaattgccggcccaatccaaaatcgggaacctaagccggaaccaaaccccaaacccaaccggagcctaacccggaccccccaccgtgagccaacccctacccttggcccaaacgaggagaatgccctaaccctcgccaaagcctgatcctagagggaacaaaaccttttgccaacccaagagagggccgggccaaccctttgggggggcgggggccaccccgtgcttgggcgaaactcttccgttct

SEQ ID NO: 74944 - protein, 44 aa, Zea mays
  misc_feature: Ceres CLONE 1559336
MPQPEPQPRTKPEPHMQPLPHPEPKPIPMPHPEPKPEPQRKPKT

SEQ ID NO: 74945 - DNA, 961 bp, Zea mays
  misc_feature: Ceres CLONE 1559338
  misc_feature: Encodes the peptide sequence at SEQ ID NO. 74946
  misc_feature (645)..(645): n is a, c, t, g, unknown, or other
  misc_feature (647)..(647): n is a, c, t, g, unknown, or other
  misc_feature (651)..(651): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
ggagctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacagtgtcttcagctgaagaagccggggctgctgtcgagcaattcaacggttatacatttcaaggaagacctctgagggtgaactgcgggccaccgccacctagagatggatccgcacaagagcaccatggtggntntttnttggggggtgttttnnnnnnnntttttttcctttttggggaagaagggaaaccgggggtaacccggcggggtggtgttaaccactcggccttggcggaaaatccttaagggcatcaaggaaacgtcaagggaaggaaactcaataaacgggccgggtaaccacggttggccaaggtgggggttgtttcttccagcgcatgggtcccccggaaaaggggccccttggaaaaaattaaacaatcagctgggtcgaacccggtaaggaaaaacacatggggcctatgggccacaaaatttgttaccccggggt

SEQ ID NO: 74946 - protein, 205 aa, Zea mays
  misc_feature: Ceres CLONE 1559338
  misc_feature (79)..(150): Pfam Name: RRM_1 Pfam Description: RNA recognition motif. (a.k.a. RRM, RBD, or RNP domain)
  misc_feature (169)..(169): Xaa is any aa, unknown, or other
  misc_feature (170)..(170): Xaa is any aa, unknown, or other
  misc_feature (175)..(175): Xaa is any aa, unknown, or other
  misc_feature (176)..(176): Xaa is any aa, unknown, or other
  misc_feature (177)..(177): Xaa is any aa, unknown, or other
  misc_feature (178)..(178): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTVSSAEEAGAAVEQFNGYTFQGRPLRVNCGPPPPRDGSAQEHHGGXXLGGVXXXXFFLFGEEGKPGVTRRGGVNHSALAENP

SEQ ID NO: 74947 - DNA, 938 bp, Zea mays
  misc_feature: Ceres CLONE 1559339
  misc_feature: Translation starting site: 190
  misc_feature (649)..(649): n is a, c, t, g, unknown, or other
  misc_feature (650)..(650): n is a, c, t, g, unknown, or other
  misc_feature (653)..(653): n is a, c, t, g, unknown, or other
  misc_feature (798)..(798): n is a, c, t, g, unknown, or other
  misc_feature (834)..(834): n is a, c, t, g, unknown, or other
ctggagctccccgcggtggcggccgctctagaactagtggatcccccgggctgcaggaattcgtctcacccctagaaaaaatcccatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgatggtgatcgtgggcgccgggtccgcgggcctgtcctgcgcgtacgagctgtccaaggacccctccgtgagcgtcgccatcgtggagcagtccgtgtccccgggcggcggcgcgtggctgggcgggcagctgttctcggccatggtggtgcgcaggccggcgcacctgttcctgacgagctggggtggctcnnaanaaagggcccaaggactacgtggtgggtcagcacgcggcgctgttcacgtccaccgtgatgaagcggctcctggcgcgggccaacgtgagctgttcacgccgtggcgggggaggactgatcgtgcggccggggcgcgtccggcgcntgtcacaactggggcgctcgtgtcatgaacacgacngcagtcggcatggaccccactgatggaggcaaggtggtgtcagctctgcggcaccacgggcctttggcgcaccgggtaagagctccagaatccgcatgacaggc

SEQ ID NO: 74948 - DNA, 923 bp, Zea mays
  misc_feature: Ceres CLONE 1559340
  misc_feature: Encodes the peptide sequence at SEQ ID NO. 74949
  misc_feature (740)..(740): n is a, c, t, g, unknown, or other
  misc_feature (756)..(756): n is a, c, t, g, unknown, or other
  misc_feature (758)..(758): n is a, c, t, g, unknown, or other
  misc_feature (764)..(764): n is a, c, t, g, unknown, or other
  misc_feature (794)..(794): n is a, c, t, g, unknown, or other
  misc_feature (814)..(814): n is a, c, t, g, unknown, or other
  misc_feature (840)..(840): n is a, c, t, g, unknown, or other
ctggagctccccgcggtggcggccgctctagaactagtggatcccccgggctgcaggaattcgtctcacccctagaaaaaattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagaccttcggagtttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggtttagaccgtcgtgagacaggttagttttaccctactgatgaccgcgccgcgatagtaattcaacctagtacgagaggaaccgttgattcacacaattggtcatcgcgcttggttgaaaagccagtggcgcgaagctaccgtgtgccggattatgactgaacgcctctaagtcagaatccaagctagcaaccggcgcctctgctcgccgcccgccccgacccatcgttagggcgttcgcgccccaagggcccgtgcccattggctcagcccgcccggccgacgcgcccggggcggggcgccntcgaagctcccttccnancgggcnggcgtgctgaatcctttgcagacgactttnaacgcgacggggcatgtttnttgggcaggtgggcctttgctgcacnatcacctgagatccagccccgcgtcgcacggattcgaaaatcggcgccggccaacactagtaacgtactgaaaacctgaaaca

SEQ ID NO: 74949 - protein, 39 aa, Zea mays
  misc_feature: Ceres CLONE 1559340
GAPRGGGRSRTSGSPGLQEFVSPLEKIVRWGVWLGRHIC

SEQ ID NO: 74950 - DNA, 879 bp, Zea mays
  misc_feature: Ceres CLONE 1559341
  misc_feature: Encodes the peptide sequence at SEQ ID NO. 74951
  misc_feature (741)..(741): n is a, c, t, g, unknown, or other
  misc_feature (750)..(750): n is a, c, t, g, unknown, or other
ggagctccccgcggtggcggccgctctagaactagtggatcccccgggctgcaggaattcgtctcacccctagaaaaaggatatctcgtctcggtcagttcgcttcgtgagttatctttatctcctctcgatcgatcgcttcctccatcgaggcggtaaagcgccgcccagatcgccggaagcaagcggcgacctcaccagctccgagcagcagcagggaggctcgtggaaccattagtcgttttctggcagcggcatggaggggctgagctggagaacggtgtgttgtttatcggtgctctgtgccgtgctgttcttgcgcccggccgagggcatccgcttcgtgatcgatagggaagagtgcttctcgcataacgtggaatacgagggggatactgtccatgtatccttcgtcgtcatcaaggctgacaccccgtggcattacagcgaggagggcgtcgatcttgtggttaaggatcctaatggcgctcaagtccgtgattcccgagataagactagtgacaagtttgagttcatagttcagaagagagggcgtcatcggctctgcttcacgaacaaatccccatatcacgaaacgatagacttcgatggtcatgttggccatttttcatatttcgagcagcatgcccaagatgagcattttgcacactttttgagcaaataggccagttggatgaagcactttacaatattcagttcaacagcactggctaggagccnagactgacngtcaagcaatattgaacgagacatgagcaggagggcagtccttaggcgctcttcgattaagggggctgattgccccagggtattccaagttacttcctggccgggtcttgaaggccaagtggggacttc

SEQ ID NO: 74951 - protein, 142 aa, Zea mays
  misc_feature: Ceres CLONE 1559341
  misc_feature (58)..(121): Pfam Name: EMP24_GP25L Pfam Description: emp24/gp25L/p24 family/GOLD
MEGLSWRTVCCLSVLCAVLFLRPAEGIRFVIDREECFSHNVEYEGDTVHVSFVVIKADTPWHYSEEGVDLVVKDPNGAQVRDSRDKTSDKFEFIVQKRGRHRLCFTNKSPYHETIDFDGHVGHFSYFEQHAQDEHFAHFLSK

SEQ ID NO: 74952 - DNA, 926 bp, Zea mays
  misc_feature: Ceres CLONE 1559344
  misc_feature: Encodes the peptide sequence at SEQ ID NO. 74953
  misc_feature (557)..(557): n is a, c, t, g, unknown, or other
ctccccgcggtggcggccgctctagaactagtggatcccccgggctgcaggaattcgtctcacccctagaaaaaatcaacactctctacctgtgtccgtgtgctcttctcctctgcaccaccaaccaaccagtgctgtcctccgccgatccactgacctaccgcgagcgccaatggcgaccgccgcggtcctcgccgccacattagcgctgttcctcggcgccgccgccgcaacggccgcgacggctgcggcggaggcggaccggatcggcaggctgccgggccagccgccggtcaacttctccatgtactccggctacgtcaccgtggacgcggcggcggggcgggccctcttctactggttcatcgaggcggccggcgtgcccgcggagtccgcgccgctcgtgctgtggctcaacggcgggcccgggtgctcctccgtcggctactgcgcgtcagaggagctcggcgccttccggatcaacgccgacggcaggacgctctacttgaacccctacccctggaatatagtggcgaacatgctgttcttggactcgncggccggggtcggctactcatactgcaactccacctccgatctgtacactgccggtggacacaagacggcccatgactcgtacaatttcttggtgaactggcctgggacggttccaacaatacaagcatcgcgatttctccatcacaggaaaaagctacgcaggccactacgtggcccagttgtttcagctagtctacggaaccaccaaggcttcgatagcccatccaaacctcaaaggctcttggttgggaatgcgggatttaaaattacaccaatttctggacaattaaatacttgggaaccccgggtttattcttaaaaaaccaaaaaaaacgcggttgcccccccttaaaattttgaaacgggcc

SEQ ID NO: 74953 - protein, 234 aa, Zea mays
  misc_feature: Ceres CLONE 1559344
  misc_feature (36)..(235): Pfam Name: Peptidase_S10 Pfam Description: Serine carboxypeptidase
  misc_feature: SWISSPROT Homolog: EC 3.4.16.6 Carboxypeptidase D
  misc_feature (129)..(129): Xaa is any aa, unknown, or other
MATAAVLAATLALFLGAAAATAATAAAEADRIGRLPGQPPVNFSMYSGYVTVDAAAGRALFYWFIEAAGVPAESAPLVLWLNGGPGCSSVGYCASEELGAFRINADGRTLYLNPYPWNIVANMLFLDSXAGVGYSYCNSTSDLYTAGGHKTAHDSYNFLVNWPGTVPTIQASRFLHHRKKLRRPLRGPVVSASLRNHQGFDSPSKPQRLLVGNAGFKITPISGQLNTWEPRVYS

SEQ ID NO: 74954 - DNA, 901 bp, Zea mays
  misc_feature: Ceres CLONE 1559346
  misc_feature: Encodes the peptide sequence at SEQ ID NO. 74955
  misc_feature (644)..(644): n is a, c, t, g, unknown, or other
  misc_feature (674)..(674): n is a, c, t, g, unknown, or other
  misc_feature (705)..(705): n is a, c, t, g, unknown, or other
ctggagctccccgcggtggcggccgctctagaactagtggatcccccgggctgcaggaattcgtctcacccctagaaaaaatcggggcttcggcgtcggcgaccagaacaatcaccaccgtccgtccgtccgtccgtcccgttcctcttctcgcaggttggacccgtcagtcacacctccgaagtccgaacctccctgccccaacacaatggcctcctccctcgccgcgcgccgcctcctctcccgcgcagccgccgtgcgccgtttccccgtccccttcgcctccgccccagcccccgcgatggctccccgcagtttctccgccgacgcgggaccgcctccgccgctcccgccaccgccgctgcagcccgtcgtcgagccgcccacgtcggagggcgcgggtgcctcgtcctcctccaccaccgctggtgccggaggggcccacaggtcgtcgccgggagccgcggcgggggcgcggcgccagggtggtgccggctacgaggaggagcaggagaaggtcctccgcgcgtcgctgctccacgtgccgcgcatggggtggagcgagtcggccatggtcgcgggggcgagggacgttggcgtgtcccctgccatcgtgggcgcatttccaaggaaggaggcgcccnttgtggagttttcatggatgactgcctccnacaatgatggatcgaattgatgctggagaanggagagcagtgaagacttgatactgagtgaggactctcaaaacttgttcggatgaggctggaaatgcaggcactttaatatcctagtggcctcagcactgagtatcagtctcaacagcaacgtctcaacagctgaagcaccagcttccgggtgaatgaaatgcatgctgctgaaaatctggtcaaatatgatgggt

SEQ ID NO: 74955 - protein, 161 aa, Zea mays
  misc_feature: Ceres CLONE 1559346
  misc_feature (146)..(146): Xaa is any aa, unknown, or other
  misc_feature (156)..(156): Xaa is any aa, unknown, or other
MASSLAARRLLSRAAAVRRFPVPFASAPAPAMAPRSFSADAGPPPPLPPPPLQPVVEPPTSEGAGASSSSTTAGAGGAHRSSPGAAAGARRQGGAGYEEEQEKVLRASLLHVPRMGWSESAMVAGARDVGVSPAIVGAFPRKEAPXVEFSWMTASXNDGSN

SEQ ID NO: 74956 - DNA, 913 bp, Zea mays
  misc_feature: Ceres CLONE 1559348
  misc_feature: Encodes the peptide sequence at SEQ ID NO. 74957
ctccccgcggtggcggccgctctagaactagtggatcccccgggctgcaggaattcgtctcacccctagaaaaagaaccttcgctcgggtggtgcctcgggttcagccaacctcgcacatggcgcgctgctccgtcgcgaaaccgctctgcgccaccaccgcgactccccgccttacccgtcgctgccggcagctctccgcgaacgccaccaccccggccatggccaccagtaaagcacggttgccggccctaaacaaaccggccaaaccgccgccgcctctcctctcgcgtccgaagctccccgtccccaccaacaccgcgactgacaccactagcggcaaggattgcaccaagaaaccaccgccggaagctacggactcacatccgccctcgtccggcgccggcgacgtgctccgcctgatggacgcgctggtcatcccgcccgacgaggacatctacatatcccttctcaggtagtgcgccgacgcagcagatgtggcctccgtgcacgcgcacataaccgcccgtcgcgcctccgatgtactcccgtcgccggtcgcaaccgtctcctgcttctttacgccggtgtggggactcgtagctgcccgccgggtatcaacggatgcccaccctaacggtttgcctgggcaacatgggggccgcataccggatggctgcccccccgtgaacgatgctctgttccccccatgtccctggaaaccccgtcccggaagggaatggccccccagcctttggggccggggggggttttgacccgggagggaaacctctttcgggaaaaggaacaccccccctcccaaaaaagggggaccccgggaattggggcccccccgtgaattttcccgaaagagggggttttaaaaaagcggggggttttccccaaaaaaaaat

SEQ ID NO: 74957 - protein, 119 aa, Zea mays
  misc_feature: Ceres CLONE 1559348
MARCSVAKPLCATTATPRLTRRCRQLSANATTPAMATSKARLPALNKPAKPPPPLLSRPKLPVPTNTATDTTSGKDCTKKPPPEATDSHPPSSGAGDVLRLMDALVIPPDEDIYISLLR

SEQ ID NO: 74958 - DNA, 894 bp, Zea mays
  misc_feature: Ceres CLONE 1559350
  misc_feature: Encodes the peptide sequence at SEQ ID NO. 74959
  misc_feature (786)..(786): n is a, c, t, g, unknown, or other
  misc_feature (795)..(795): n is a, c, t, g, unknown, or other
tggagctccccgcggtggcggccgctctagaactagtggatcccccgggctgcaggaattcgtctcacccctagaaaaaatcagtggtggagcggtggctgggcctgtcagaaccggcaagctcaggccgtgtctgccgtccacgctctctccgtattccctggagtgcacggatctataggcggagctccggctcttcctatgggagggtctcatagcccgcatggtgcccatcaccgacaccgacatctactggtacatcgtcaacaacacggtcgccgcagagaaacaagcctccggggacccagtgaacaccctgcgcgaggtgaccgactacctgcacaggctcatgccacccggattatctggacgtggtgcaccattcctaccacgggaacctctctgtgggagccgctcctgtaccggaactcggtgtccgtccatctgagcccctatgctcacgtgaccatgaccgtcgccggcatactcgttcaccccatgacccccgacatggagacggtcggtgctcggcactgtagaccccgatgatgctctcccggggtctgtgacggtgcgcaacccccgccgaaggccttgtccactacgtggcgaatccgaagggccctgccgcctgacttggcgccggggccaccttccgagggggcccccccagaagggacaaatccggggccttgggggaaccttgttaagggtcccggaaatggccttccagggtcgggttccccccttcccggaaaaccccttgttttaacccggggaactttnaacaccccnaaaaaaaatttaggggttgcacaaaccccccaccccaagaggggccggaacccggggggggaatttaggtgtatactacgggggggggacccccggttt

SEQ ID NO: 74959 - protein, 74 aa, Zea mays
  misc_feature: Ceres CLONE 1559350
MVPITDTDIYWYIVNNTVAAEKQASGDPVNTLREVTDYLHRLMPPGLSGRGAPFLPREPLCGSRSCTGTRCPSI

SEQ ID NO: 74960 - DNA, 958 bp, Zea mays
  misc_feature: Ceres CLONE 1559354
  misc_feature: Encodes the peptide sequence at SEQ ID NO. 74961
  misc_feature (921)..(921): n is a, c, t, g, unknown, or other
ctggagctccccgcggtggcggccgctctagaactagtggatcccccgggctgcaggaattcgtctcacccctagaaaaagcgtgcatcgcggctcccgctcccacactcgcctccctcatcagtggcagctagtagcggcagcacccgcagctcgcaggagagagagagagagagagagagagagagagagcagccatgaaccacggaggcggagccgacaacggtgtgagccccggcaacgtcccggtgtgctactacggcgcggcggggcgcgtgccggcggcgctggagcggcgggtgcgcgccgcggagctgttcatgcggtgcgcggcgtgcgggctcgcggtgctcgccgcggcgctgctgggcgccgaccgccagacccgcaccttcttctccgtggagaaggcggcccggttcaccgacatgcagtcgctcgtattcctggtgatagcaaacgggatggcagcgtgctacagcctgctgcagggcgggaggtgcctggtgagcatcctcacaggtggtggcgtactaatcaacaggcccatggcatgggccatcttctcctgcgatcaggtcatggcgtacttcacgatctcggcggtggccgtggcgatggaggcggcgatgatcggcaagtacgggtcgcagcagttccagtggatgaagacgtgccacctctacaagcgtttctgcgcgcatgcgggtggcgccgtgggctgtgcggtggcggccagcctgaacatggtcggcgtctcgctcgtctcggcgttcaacctcttccggctgtacggcagcggcaaagggagggagtgatctcccttcggcctgccactaaggaacaatgggccggcatccgccgcccctgtgcctggaatttctccttaggtttttacacccagttgggaaccttaccccngggagtgggagggatggccccctcctccttctccggg

SEQ ID NO: 74961 - protein, 206 aa, Zea mays
  misc_feature: Ceres CLONE 1559354
  misc_feature (32)..(183): Pfam Name: DUF588 Pfam Description: Domain of unknown function (DUF588)
MNHGGGADNGVSPGNVPVCYYGAAGRVPAALERRVRAAELFMRCAACGLAVLAAALLGADRQTRTFFSVEKAARFTDMQSLVFLVIANGMAACYSLLQGGRCLVSILTGGGVLINRPMAWAIFSCDQVMAYFTISAVAVAMEAAMIGKYGSQQFQWMKTCHLYKRFCAHAGGAVGCAVAASLNMVGVSLVSAFNLFRLYGSGKGRE

SEQ ID NO: 74962 - DNA, 922 bp, Zea mays
  misc_feature: Ceres CLONE 1559358
  misc_feature: Translation starting site: 138
  misc_feature (292)..(292): n is a, c, t, g, unknown, or other
  misc_feature (308)..(308): n is a, c, t, g, unknown, or other
  misc_feature (309)..(309): n is a, c, t, g, unknown, or other
  misc_feature (337)..(337): n is a, c, t, g, unknown, or other
  misc_feature (343)..(343): n is a, c, t, g, unknown, or other
  misc_feature (369)..(369): n is a, c, t, g, unknown, or other
  misc_feature (385)..(385): n is a, c, t, g, unknown, or other
  misc_feature (386)..(386): n is a, c, t, g, unknown, or other
ctggagctccccgcggtggcggccgctctagaactagtggatcccccgggctgcaggaattcgtctcacccctagaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgcctacgccaccacctctgggcgcgtcacatgtccgcggagtggatgcccggncatgcacggcctgccnnactcgacggctcctctcccggggactcngcttcnatccgcttgggctcgcgaccgtgccngaagacctcgagcggnntcaggagtcagaggggtacccactgcggctgggccatgctttgcctcccccgaattcctgtggccggaaacccttgggccgtgcgaactgggtgaaaagggcctgaatggggcggccctcccccgggggggagggcccatttcccggggccccccggtggccggggggggacccctccccacacaccccggggaaacaaattcccggggccaccccctcttcccgaaaaccaccgcccccccgtggaaaaagaccccccccaaaaaaaaattattccccgggggggcccctttaaacccctcgggttttttttcaagaacccccccccagtttgtggaagaaaaaaccccccgggaaaaaataaaaaggggccccccccccccgggggggggtctcttgggggttttttgtccaaaaaaaagggggggtaccccccccccccccccccccggtaaaaaaaaactcccccccccctcgaaaaaggggggggaaaaaaaactggggggaaaattttccccccccaaataaatcccccc

SEQ ID NO: 74963 - DNA, 889 bp, Zea mays
  misc_feature: Ceres CLONE 1559359
  misc_feature: Encodes the peptide sequence at SEQ ID NO. 74964
  misc_feature (740)..(740): n is a, c, t, g, unknown, or other
  misc_feature (801)..(801): n is a, c, t, g, unknown, or other
  misc_feature (810)..(810): n is a, c, t, g, unknown, or other
  misc_feature (811)..(811): n is a, c, t, g, unknown, or other
ctggagctccccgcggtggcggccgctctagaactagtggatcccccgggctgcaggaattcgtctcacccctagaaaaattgggagctcactcgctggtcgttgcctgctgcggattgcccccaggcggccccactcactccgctgttgatatttcgtttggttctcctttccgtcttgtccgtctccgaggccttcttcccctcgctccccagctccagcaggcagatcagatccatccaaccacgaacaggaaggaaggtaggaggcctgaggggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgcctggttccgcgaccactggtcccgcgagcacgcccacctggacgagatagccgagcagctcgagttggtcgccctccttgcctacgatgaggatgaggacctcttctacggcgagcaggcccccgccgccgccgcccttaagacagattcggtgctcaaggcgctgaacttgggttccccgaagagcggcgacgccccctcgggggttgcctggagaaacccaggcactccgagaagccgtacaagtacgccggctgccccaagagcagcgctcctcgcgtgatccaccagcctcgctaggttcgctggccggcccctgatggggactcngtgactcacatggaaagctgctgcctctctagcagcatctgctactggctgcagctgccgntcggcgtcnntggtctgtctgtcaaagcgaagtaaaaaaacctgagtagttgaactaccggtagaagtttcttttggttagcatgcct

SEQ ID NO: 74964 - protein, 133 aa, Zea mays
  misc_feature: Ceres CLONE 1559359
MSAVAVSSSLNPNAPLFIPAALLQVEDFSPQWWDLITTTAWFRDHWSREHAHLDEIAEQLELVALLAYDEDEDLFYGEQAPAAAALKTDSVLKALNLGSPKSGDAPSGVAWRNPGTPRSRTSTPAAPRAALLA

SEQ ID NO: 74965 - DNA, 1155 bp, Zea mays
  misc_feature: Ceres CLONE 1559360
  misc_feature: Encodes the peptide sequence at SEQ ID NO. 74966
atgctgtagctcaacgtcgatgacggccgctctagaactagtgtatcccccgggctgcaggaattcgtctcacccctagaaaaaacgccacacaccaccaccggacgctagctcaccaccaacctcagcacatcgaggagaagaggagtggccaatggcttcgtcggtggccgccgcggcgagcacattcctgggcacccgcctggcggacccggtgccgcagaacgggcgcatcgtggcccggttcgggttcggcggcggaaagcccaaggctgccgtcccgaacaaggtggcgaagacgtcgatctcctctgaccggccgctggggctccccggcgccgttggccccgactaccccaggggggggtgggcggggaactcagcttttacctttttttgtttcccccccccgcgaagtcgattccctgcgccacgtcatcgggtgggcccgtaagcccgctggggctatggggcccccccttgccggaccccccccgcggaggggtgtccatgtgccattgttcgcactccccactaccacccataatagtgttgttggccgatctccctaatgtttattacctcttggtgcatccgggctggcccgtctgtggccgtcctactccttctcgcaccgctgctccgcatcgcctcccggacagtcgcgtgctcctcgcccctgtgcacccgctcaatttctgtatccctaagacctcaagcgttacgcgctctacttatcgtttgttagggcctcactaagatggcgggtgtctatggctacctgacctgacgcgattgtggtagtcgttgttcgacggtattagccggcccctgtacggccgctccgttttgcgtatatcccccacccgtcgcgttccaactctctacgccactagtgttactgcgtcggctcattctatttgatgccacctcttgtacgcagcccgccgtgtggacatatctcgtaccgcagttattccttccccgctcactatgcattggcccgctgttacggtgtcgtgctgctcggccccgtctggatatgccggtggacactgtcctctgcgattctcgccacttattatatgtccacctgtcgtttgtcgttctcgttcgcattatgtgactagtcttatatttgtttatctccattcg

SEQ ID NO: 74966 - protein, 99 aa, Zea mays
  misc_feature: Ceres CLONE 1559360
MASSVAAAASTFLGTRLADPVPQNGRIVARFGFGGGKPKAAVPNKVAKTSISSDRPLGLPGAVGPDYPRGGWAGNSAFTFFCFPPPRSRFPAPRHRVGP

SEQ ID NO: 74967 - DNA, 954 bp, Zea mays
  misc_feature: Ceres CLONE 1559363
  misc_feature: Encodes the peptide sequence at SEQ ID NO. 74968
  misc_feature (260)..(260): n is a, c, t, g, unknown, or other
  misc_feature (360)..(360): n is a, c, t, g, unknown, or other
  misc_feature (433)..(433): n is a, c, t, g, unknown, or other
  misc_feature (434)..(434): n is a, c, t, g, unknown, or other
  misc_feature (496)..(496): n is a, c, t, g, unknown, or other
  misc_feature (497)..(497): n is a, c, t, g, unknown, or other
  misc_feature (519)..(519): n is a, c, t, g, unknown, or other
  misc_feature (520)..(520): n is a, c, t, g, unknown, or other
  misc_feature (539)..(539): n is a, c, t, g, unknown, or other
  misc_feature (605)..(605): n is a, c, t, g, unknown, or other
  misc_feature (613)..(613): n is a, c, t, g, unknown, or other
  misc_feature (639)..(639): n is a, c, t, g, unknown, or other
ctggagctccccgcggtggcggccgctctagaactagtggatcccccgggctgcaggaattcgtctcacccctagaaaaacatcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtncgtcgtcctcccgcgggccggccccgctccgcgcgtccaccgaggaggcggtggaggcgcccaaaggggttcgtggccccgcagctggaccccagcacgnccgtccccgatcttcggcggcagcacgggcgggctgctccgcaaggcgcagggtggaggagttctacgtcatnncacgtggacgtcccccaaagggagcaggggtgttcgagaatgcccaccggcgggcgccgccnnatcatgcgggaagggccccaanncctcttgaagctggcgcgncaagggagcaggtgcctggcgctcgcggcaccaggttgggcgctccaagtaacaagattcacctanccaggttnctaccccgcgtcttcccccaaacggncgaagggtgcagtacctccaacccccaagggacggcgtctaaccccccggaggaaggtcaacccccgcccaggggaaagcgttcgggccagaaccttcccgcagcattcggcaaagaacgtcaaacccattcgaaaaatcaagtcacccgggcaggccaaccttcgactatttcacacttcacgtacgccgcagccccccagccggatccaaaattaaggaaactctcttctataaattacagaaattgtatttacccccccggaacggggtggccagattgaaatgggcaaaagaaccctggggattttaattc

SEQ ID NO: 74968 - protein, 124 aa, Zea mays
  misc_feature: Ceres CLONE 1559363
  misc_feature (36)..(36): Xaa is any aa, unknown, or other
  misc_feature (94)..(94): Xaa is any aa, unknown, or other
  misc_feature (115)..(115): Xaa is any aa, unknown, or other
  misc_feature (122)..(122): Xaa is any aa, unknown, or other
  misc_feature (123)..(123): Xaa is any aa, unknown, or other
MAMATQASAATRHLLAAAWAPAAKPRQLSSQLALPXVVLPRAGPAPRVHRGGGGGAQRGSWPRSWTPARPSPIFGGSTGGLLRKAQGGGVLRHXTWTSPKGSRGVRECPPAGAAXSCGKGPXXS

SEQ ID NO: 74969 - DNA, 964 bp, Zea mays
  misc_feature: Ceres CLONE 1559364
  misc_feature: Translation starting site: 121
  misc_feature: SWISSPROT Homolog: EC 1.6.5.3 NADH dehydrogenase (ubiquinone)
  misc_feature (697)..(697): n is a, c, t, g, unknown, or other
  misc_feature (729)..(729): n is a, c, t, g, unknown, or other
  misc_feature (803)..(803): n is a, c, t, g, unknown, or other
  misc_feature (823)..(823): n is a, c, t, g, unknown, or other
  misc_feature (829)..(829): n is a, c, t, g, unknown, or other
  misc_feature (832)..(832): n is a, c, t, g, unknown, or other
  misc_feature (834)..(834): n is a, c, t, g, unknown, or other
  misc_feature (841)..(841): n is a, c, t, g, unknown, or other
  misc_feature (847)..(847): n is a, c, t, g, unknown, or other
  misc_feature (848)..(848): n is a, c, t, g, unknown, or other
  misc_feature (855)..(855): n is a, c, t, g, unknown, or other
  misc_feature (868)..(868): n is a, c, t, g, unknown, or other
  misc_feature (873)..(873): n is a, c, t, g, unknown, or other
ctggagctccccgcggtggcggccgctctagaactagtggatcccccgggctgcaggaattcgtctcacccctagaaaaaatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatctcgcaaaagattggaatgctgtgtttgaaaggagcatcaatacattgtttttgactgaaatggtccgtggcttaatgctaactctcaagtacttctttgatagaaatgtcacaattaactatccgtttgagaagggtcctctgagcccccgcttccgtggtgagcacgctctcagacgttatgaatctggggaagagcgctgcattgcttgtaaactatgcgaagctatatgcccagcgcaggcaattacaattgaggctgaagaacgtgaagatggcagtcgccgaaccacaagatatgatattgacatgaccaaatggcatttactgtgggttctgtcaagaggcttgcccagtcgatgctattgttgaggggcctaactttgagtttgccactgagacacacgangtactactgtacgacaaggagaaattgcttgnagaatggtgatcgctgggagactgagattgctgaagaaactgagatctgagagcctctatcgctgaatctgtcntcccatgatggtggataaanctgggntcntnccatttncatatnntgctcanctagctgatgaantagcnaacgatgtatcataccctaaggtaccaatgttttgtaccttggggaccattctgtgtgttttggtcatgtgccttgctaaaggtggcacct

SEQ ID NO: 74970 - DNA, 887 bp, Zea mays
  misc_feature: Ceres CLONE 1559365
  misc_feature: Encodes the peptide sequence at SEQ ID NO. 74971
  misc_feature (809)..(809): n is a, c, t, g, unknown, or other
tggagctccccgcggtggcggccgctctagaactagtggatcccccgggctgcaggaattcgtctcacccctagaaaaaacggttcctctctgacgactcctctcctctcctctcgccggcgcatcgcccgactgtcggtcatgctcagccatggccgcgtatgaggagcatggcttccgcccgctggacgaggcgtccctgctctcctacttctaggcctcgccggcgctcgcctcccgcctcggcggcggtggcagtctagactccgtccagatcaaggaggtcggcgactgcaacctcaacttcgtctacatcgtgcagtccgaggccggcgccatcttcgtctagcaggcgctcccgtacgtgcgctgcgtgggggactcgtggcccatgtcgcgggagcgcgcctacttcgaggcctccacgctgcgggagcacggccgcctgtgcccggagcacacccccgaggtgtaccacttcgaccggaccttgtcgctgatggggatgcgctacatcgagcccccgcacatcatcctcctgaagggcctcgtcgccggtgtcgagtacccgctgctcgccgaccacatgtccgattacatggccgagacgctcttcttcacctccctcctctataactataccacggatctgaagaacggcagttgcttgtactctgcgaacgtggagacgtgtatgctcaccgcatcaagttgtagtctgcggaccattagcgtgtttccaaatttatgctgtgacctcgacttatctcgacaatatgcctgagcaggtcgccgagatgatgcactcnattcggaagtactgggcctgaatccatgtttttcgacagagctcaagctctggattcaggggatcccccaactgggtt

SEQ ID NO: 74971 - protein, 130 aa, Zea mays
  misc_feature: Ceres CLONE 1559365
  misc_feature: SWISSPROT Homolog: EC 2.7.1.100 S-methyl-5-thioribose kinase
MSRERAYFEASTLREHGRLCPEHTPEVYHFDRTLSLMGMRYIEPPHIILLKGLVAGVEYPLLADHMSDYMAETLFFTSLLYNYTTDLKNGSCLYSANVETCMLTASSCSLRTISVFPNLCCDLDLSRQYA

SEQ ID NO: 74972 - DNA, 987 bp, Zea mays
  misc_feature: Ceres CLONE 1559366
  misc_feature: Encodes the peptide sequence at SEQ ID NO. 74973
ggagctccccgcggtggcggccgctctagaactagtggatcccccgggctgcaggaattcgtctcacccctagaaaaaagcctcactctcgcgccggctcaaggtacattgcgtgtcctagccaagacacgcagctcatctcagcctcacacgcacagcaagagcgaggcgtgattcgccatgggcggcctcactatggaccaggctttcgtgcaggcccccgagcaccgccccaagcccatcgtcaccgaggccaccggcattcctctcatcgacctctcgcctctggccgccagcggcggcgccgtggacgcgctggccgccgaggtgggcgcggcgagccgggactggggcttcttcgtggtcgtggggcactgcgtgcccgcagagaccgtggcgcgcgcgacggaagcgcagcgcgcgttcttcgcgctgccggcagatcggaaagccgccttgcggaggaactaggcggacccgctcgggtactaacaatcggaccccaccaagaaccggagggactggtaagaagggggacaaccccccccccgccaagccccccccccccggaaaccctggccaaagggaaaccccgtttcaaaaaaaaaggggcccccagaatttcccggggttaaaaaagggcccggggggggtcccccaaaccctgggaaaaaccggggtttaaaaccgggggaaaagttaccccccgggcccttaaatatagaaccccacccggggtgcggggttttttaggagaaaaaaaaacccccccggggggaaaaaaaacccccctgggcggaaacacccagtggtgcccctcgggggggaagaaaaaaaaaacacccgcccccctcaccctttcttaaaaaaaaaatggggggggtcacaaaaggggggggcccccaaaaaaatggagggggccccgagacccccccccccctttttttttttaatgggggggcaccccccttgggggaaacacaaaaa

SEQ ID NO: 74973 - protein, 96 aa, Zea mays
  misc_feature: Ceres CLONE 1559366
  misc_feature: SWISSPROT Homolog: EC 1.14.11.9 Flavanone 3-dioxygenase
MGGLTMDQAFVQAPEHRPKPIVTEATGIPLIDLSPLAASGGAVDALAAEVGAASRDWGFFVVVGHCVPAETVARATEAQRAFFALPADRKAALRRN

SEQ ID NO: 74974 - DNA, 979 bp, Zea mays
  misc_feature: Ceres CLONE 1559367
  misc_feature: Translation starting site: 129
  misc_feature (407)..(407): n is a, c, t, g, unknown, or other
  misc_feature (445)..(445): n is a, c, t, g, unknown, or other
  misc_feature (499)..(499): n is a, c, t, g, unknown, or other
ctggagctccccgcggtggcggccgctctagaactagtggatcccccgggctgcaggaattcgtctcacccctagaaaaaaggagccccgatcatctcccgctcccttccttcctcctcctcctcctcatggctctgtcgtccgccggctcgttcgtggcctgcagcctccggccaagcggagctagcatccatgccccgaggtcgccgccgcacctgaagccgggtgctgcggcggcgtcgttcacgaggacgccgcagcgccgggcgaacgcgaccaagggcggcgtgtccaccgtgtgcgagccgctgggccccgacaggccgatctggttccccggcagctcccctccgccgtggctcgacggaagcctcccagagactttgggattgaccctctcggactangttcggagccggagctgctgcggtggttcgcgcaggcngagctgatgcaccggccgtggccaatgctggccggcgcgggcatcctggttccngacctgcttggcccggtggggcttcctcaaaccggggtttcccttgtttcaaccccgggccccgacagaacttcgggaacccccggaaacctgtttgtgttccaaaaggcccttaataggggtgggcccaaagggccccccttgggccgaaaaacctgaaggcccgggggtggtggaaaaattgaaccccctttcccaaaaaccaaaaaaccgggggccccacatgggggggcccccggggggggggtgttttataaggggccaaaggggggcgcggtcccccagaaactgtagtgggttgccccccaaaaaaaaaaaaaagggggggggccccacccccccccccggggtttttttttccccggtttaaaaggggggggccccctaaaaaatgtggggggcccggacacgccgcggcgaaatattttgtggggtggccccacaaaaattttttttttagtggggagaaaaaaaaaaaaa

SEQ ID NO: 74975 - DNA, 904 bp, Zea mays
  misc_feature: Ceres CLONE 1559368
  misc_feature: Encodes the peptide sequence at SEQ ID NO. 74976
  misc_feature (475)..(475): n is a, c, t, g, unknown, or other
ctggagctccccgcggtggcggccgctctagaactagtggatcccccgggctgcaggaattcgtctcacccctagaaaaaaaaggacgttgggaaaagccaggtcacagtcccttgtttggatatgacttctggtaccagcctcgccacaagacgatgatcagttcctcatggggagcccctgcagcctttaggacaggtttcgatcttcaacatgtccaggatggcctgtatggaaggcacctgcatgtgtacgactggcctggcggtgagctcaagcagacacttgatctaggtgacactggactccttccccttgaggtgaggtttttacatgatccatcaaaggacactggctatgttggctgtgctttaacaagcaacatggtgagatttttcaagaccgcggatggatcgtggagccatgaggttgctatctctgtgaaacactgaaggtccgcaactggattctgccngaaatgcccagatgataactgattttgtcatctctcttgatgaccgttatctctactttgtaaactgggctcatgcgatattagcagtacaacattgaggatcccgccaaagccttcctgggctggacaagtatgggttgggtggtcttcctccaaaaggggatgaatgccgcctatgttccggatgaggggcaggaccgccttttaatgggccccaagcaaggggcaccacctttaaggtgggcccacaataattttccttaacttgatgggaaaaagaattccgggaaaaacccctttttcccccaggggaaaaaaatttttcggggaaatatttttcaaaaagggcccccctgtttgaaatttttttcccccaaaaaagggcgggtggttacccccctcttttttgttttttggcccacccccgtg

SEQ ID NO: 74976 - protein, 149 aa, Zea mays
  misc_feature: Ceres CLONE 1559368
  misc_feature (1)..(150): Pfam Name: SBP56 Pfam Description: 56kDa selenium binding protein (SBP56)
GAPRGGGRSRTSGSPGLQEFVSPLEKKGRWEKPGHSPLFGYDFWYQPRHKTMISSSWGAPAAFRTGFDLQHVQDGLYGRHLHVYDWPGGELKQTLDLGDTGLLPLEVRFLHDPSKDTGYVGCALTSNMVRFFKTADGSWSHEVAISVKH

SEQ ID NO: 74977 - DNA, 952 bp, Zea mays
  misc_feature: Ceres CLONE 1559372
  misc_feature: Encodes the peptide sequence at SEQ ID NO. 74978
ctggagctccccgcggtggcggccgctctagaactagtggatcccccgggctgcaggaattcgtctcacccctagaaaaatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggccctgcaggtcgtgctcatgggcgccgtcgagggctaccgcatcgcctgcggcccgcttcggcgaagtcgtcgaacccgctctatcccggctgcagctttcgacccgctcggccttcgcgacgtacccggaggcctcgctgagctcaaggtgaagagctcaagaaacggccgctcgccatgtctccatgttcggattcctcgtcaaggcatcgtcaccggggaaggcccgctccgagacccgcttgacaaaatggccgacccgtcaaaacaacgcttggggctacgccaacaactttttccccgggaaattaagggagggcc

SEQ ID NO: 74978 - protein, 269 aa, Zea mays
  misc_feature: Ceres CLONE 1559372
  misc_feature (65)..(221): Pfam Name: Chloroa_b-bind Pfam Description: Chlorophyll A-B binding protein
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWALQVVLMGAVEGYRIACGPLRRSRRTRSIPAAAFDPLGLRDVPGGLAELKVKSSRNGRSPCLHVRIPRQGIVTGEGPLRDPLDKMADPSKQRLGLRQQLFPREIKGG

SEQ ID NO: 74979 - DNA, 961 bp, Zea mays
  misc_feature: Ceres CLONE 1559373
  misc_feature: Encodes the peptide sequence at SEQ ID NO. 74980
  misc_feature (742)..(742): n is a, c, t, g, unknown, or other
  misc_feature (793)..(793): n is a, c, t, g, unknown, or other
  misc_feature (796)..(796): n is a, c, t, g, unknown, or other
  misc_feature (799)..(799): n is a, c, t, g, unknown, or other
  misc_feature (804)..(804): n is a, c, t, g, unknown, or other
  misc_feature (807)..(807): n is a, c, t, g, unknown, or other
  misc_feature (915)..(915): n is a, c, t, g, unknown, or other
ctggagctccccgcggtggcggccgctctagaactagtggatcccccgggctgcaggaattcgtctcacccctagaaaaagtggcaactacggccacaactccaggacctgcggactaggactaggactaggacacagagaaataatgctctgcgaaggtggcgacgacaataatggccgcagcggcctaaggctcttcggagtgcaggtccgtatcggcggcggcggtggcgcagggtcggcgtccatgaagaagagctacagcatggactgcctgcagctcgcggctcctcatgcttgttcgtccctcgtctcgtccccgtcgtcgtcgtcgttgtgctcgtcctcgtccccgtcgtcgctgctgctgtcgattgatgatgggttgcagagaagggcggccgatggatacctgtctgatggacctcatggcagagctgtgcaggagaggaagaaaggagttccatggagcgaggaggagcacaggcagttccttgccggcctggacaagctgggcaagggcgactggcgaggcatcgccaggagctacgtgccgacgaggaccccgacgcaggtcgccagccacgcgcagaagttcttcctccggcagagcagcatggggaagaagaagcgccggtccagcctcttcgacatggtgccgatttgcgagaacagtgcgggcatctccgatccgctggacgtggcacgccatggcgtcgcctcggcagactccgagagggcngccgtggacctgatgaatttcgacgacgagggtgacgacgcaggagcaggnacntcntgtcntcngcgtcaggtgcaaggaccgcactgcggttcccggcagcggcagctcagacggagcactgcatccttcgtcgtcgcatggccatgggcggcggccccactggctctccnttggacccggaaactggggatgtccttggcccgccccatccgtggt

SEQ ID NO: 74980 - protein, 272 aa, Zea mays
  misc_feature: Ceres CLONE 1559373
  misc_feature (105)..(152): Pfam Name: Myb_DNA-binding Pfam Description: Myb-like DNA-binding domain
  misc_feature (220)..(220): Xaa is any aa, unknown, or other
  misc_feature (221)..(221): Xaa is any aa, unknown, or other
  misc_feature (257)..(257): Xaa is any aa, unknown, or other
MLCEGGDDNNGRSGLRLFGVQVRIGGGGGAGSASMKKSYSMDCLQLAAPHACSSLVSSPSSSSLCSSSSPSSLLLSIDDGLQRRAADGYLSDGPHGRAVQERKKGVPWSEEEHRQFLAGLDKLGKGDWRGIARSYVPTRTPTQVASHAQKFFLRQSSMGKKKRRSSLFDMVPICENSAGISDPLDVARHGVASADSERAAVDLMNFDDEGDDAGAGTSCXXRQVQGPHCGSRQRQLRRSTASFVVAWPWAAAPLALXWTRKLGMSLARPIRG

SEQ ID NO: 74981 - DNA, 976 bp, Zea mays
  misc_feature: Ceres CLONE 1559374
  misc_feature (531)..(531): n is a, c, t, g, unknown, or other
ctcccgcggtggcggccgctctgaactagtggatcccccgggctgcaggaattcgtctcacccctagaaaaaagccgcatcccttctttcattcgccgccgccgcctgctctctgctgccgtcgccatggggagaaggcctgcgagatgctatcgccagatcaagaacaagccataccccaagtccggtactgccgtggtgtcctgaccccagatcaggactacgatgttgcatgaagaaaaggtgttgatgattcccctactgtgtgcacctgtctcttgggagaaagaaaatgtctccgtgaggcccttaaggtgccccttttgcctgcccccccccctgaccgggggggggggaaagggtcccttccccctttggggcccgggttccacccctccatgtgtctttttataaaaaaaaaagccttttttgggtgtggggggcctcattggcccccaacacgaaaagagggggggggcttttccacaccccccgcggggccccctgttccttgtgggccccccccccccnccagggcccccttctttttgttttcaccccccccaaatcacaatttttttgcccacggtaccaccactaaatatctccccccgcaagtgcgggactgtgtttataccttcccctcccgccgcgccaacaaaatttatctgtgaggtacaacttacgacgcgggggtctctccctcctatttttcctgcgcctcgcggttcatatcttcgcttattttctttcacagcgcgggggcgtcgcttgttccgccccagattcggtcgccccacactccacctatcgcggctcaccccgcctcatcgttttcttcgccccagttctcatgtttgggcgtcttccacctctcactccgttctccccgttgaccccatctcctcttcttcggttttgtcgcgcattactacccgccctcgctctgtcatacctcacttacttctattctccg

SEQ ID NO: 74982 - DNA, 1052 bp, Zea mays
  misc_feature: Ceres CLONE 1559375
  misc_feature: Encodes the peptide sequence at SEQ ID NO. 74983
  misc_feature (394)..(394): n is a, c, t, g, unknown, or other
  misc_feature (1003)..(1003): n is a, c, t, g, unknown, or other
  misc_feature (1005)..(1005): n is a, c, t, g, unknown, or other
  misc_feature (1039)..(1039): n is a, c, t, g, unknown, or other
ggagctccccgcggtggcggccgctctagaactagtggatcccccgggctgcaggaattcgtctcacccctagaaaaaatggccccatccccatatatacgtgcatgcaagccgagaggttcctcagtcgacgcgacgctcgacggcacggcaacagagaaagccaacagcatggctccaccaccatggccggtcgtagcgctgctgctctgcgccgcgctagcgttcgcggcgcggccgagctcggccgtggacccggtgggcacgtactgcgccaagaacttcacgggagcgcagacgcaggcgagcatcgcccaggtcctggccgcgctggtgccgcgcgcctccgccgcctactaatcgagggcgagggggcggggctgcatctgctccnccaccctctgggggccgggcgcaatgccacgggcaacatcccggggtcccgaattggccgcccttcttggggagcggcggtgccggcaagaggccggcctccttgccacgggccaagtaagaacactcttgggccaggagacaaaatactggcattccgtccgccttcgaaaacaacccgtaattaatttggggccccccgcggataccccgggaaagcgcccttcttcgcccccggaagcacccgggggagaggcccctcgatatcccgtccacggttgtttgacagagaagcctgtatgtaagagggcttttaataggggagggcgttggagttgttacccaaccacgcccgagaagcccatccacgggcccctgaggctatgaggggcgcagaaaatacacgtccggccccagtcggtcgttgggataactaatacccattgtgtctgagcgcgtccccccgctgggtgacccgcatacacccttcgtcttcgaggagcggcgggccgtgatgtgtattgtgagaagaagttagtgtcgacgtctcttctttacccggagattcccgcggtctgctcagggtcgatcacacagaaggaatagacancncctgcgatgtggcttccggaatgctgcatttacnagatatgtctgcg

SEQ ID NO: 74983 - protein, 62 aa, Zea mays
  misc_feature: Ceres CLONE 1559375
MAPPPWPVVALLLCAALAFAARPSSAVDPVGTYCAKNFTGAQTQASIAQVLAALVPRASAAY

SEQ ID NO: 74984 - DNA, 878 bp, Zea mays
  misc_feature: Ceres CLONE 1559377
tctggagctcaccgcggtggcggccgctctagaactagtggatcccccgggctgcaggaattcgtctcacccctagaaatttagtagctgtctgaagtttagtagctgtctatcttgtttttcagggatctagaataacaggagcctgatggaagcatgaagattttttaggctcctctgctcctggagctggacatgatgggccaagtcatttatattggggctaacgacaaaggtgattcctgaccttgccatctcttaactactttgctgctactgagcacatatatgaactgcatagccaggttcatttatgttaggctaataatgcatataatcatctgctaataatgacaaaagtctgacaggtttctcttaccacattggtaacatagaagttggatatgacaaaagtcactaataatgcatataattatctgctacacatttgcaaatctgcatcagtagagttgaccatttctcagtattgtgagatgcatcttacatggtcaagaagataattcctattctgaactacttgctcgtgtacaagtctccttatcatgtcctcctttcaagccagtctattctttgcttgattcatcacgggtgcacattattgtaattagaatcttcagagtactcgaaggatagttaaagctgtttggctagtccttcatattactgaaaatatgagtaagaacatttgtattttgctatttcatttcaacagacaactttttgggggatgatgcttttctttataaagcaatcagtattttcttagctagttctagctataagtctgcatgacatgctatgcccatgatattctgacagattgctccactcctttccagttgaccagttttgcctat

SEQ ID NO: 74985 - DNA, 966 bp, Zea mays
  misc_feature: Ceres CLONE 1559378
  misc_feature: Encodes the peptide sequence at SEQ ID NO. 74986
ggagctccccgcggtggcggccgctctagaactagtggatcccccgggctgcaggaattcgtctcacccctagaaaaaagggttctccctttgctgtcgcccccgcctccgtattcagcgatgataacccaccatccctccatgctcctcccatctgtcatcaccctccgagccaacatactgcgtcggcgcccaacactgcacaccgtgctcctccgcgccacctctccgattgtggtctttacacgccacctccgacggaacttcacccataactcgctgatggaggaaaacgcgctgtgccgcttcccaagcatagagcccaccctgctccgcttcgcgcctagcaacttcctcccgcttgctctcatcgatgagatcatattgagtactctagatcctactcttgtatgccgtgctcacaagtactccatgtcagagtacagcacttttgggatattcgtaatctcaagactgatcctgcgcaccaaggagcttggtgcactgctagaagctcgacctgctggactctatggactaggttagctatgttttgctgcatgccacaacactatcgagtgaagtcacaaaaacacacctgttagccggaactctgcccttctgctggcaaagacagtggcttcaaatttactggacttacattgaaccaatgtcgggtcgaaaataaatttgcaagggggttgggtttcctctgccaccgcccaaaaatataaagtcctgggccaaccccgaaaccctttatttattggaaggtccccccaaaaccccaaagattttgcgatatttctttagaaacaccacgggttttaattgaaagcttgttctccccccccccccctttttttctatagaaaaaaaaccccccatttttttggaaaaaaaccttttctgggaggaggaagaaggtgttcccacaacttgtttggtttttagggaagagggggt

SEQ ID NO: 74986 - protein, 141 aa, Zea mays
  misc_feature: Ceres CLONE 1559378
MITHHPSMLLPSVITLRANILRRRPTLHTVLLRATSPIVVFTRHLRRNFTHNSLMEENALCRFPSIEPTLLRFAPSNFLPLALIDEIILSTLDPTLVCRAHKYSMSEYSTFGIFVISRLILRTKELGALLEARPAGLYGLG

SEQ ID NO: 74987 - DNA, 938 bp, Zea mays
  misc_feature: Ceres CLONE 1559379
  misc_feature: Encodes the peptide sequence at SEQ ID NO. 74988
ctggagctccccgcggtggcggccgctctagaactagtggatcccccgggctgcaggaattcgtctcacccctagaaaaaaaaaaccgccaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttcccggcgacttcggctttgatccctggggcctcggatctgacccggagagcctgcggtggaacgtgcaggcggagctggtgcactgccagtgggcgatgctcggcgcggcgggtatcttcatcccggagttcctgacgaagatcggcgtcctcaacacgcccctctggtacaccgcctgcgagcagcaatacttcaccgacacaacaccctcctcatgatcgagctcatcctatcggcggggcccaaggcccccgttggccctaaatcattcagcccgggaggggcaaacccgatcccatcttcccaagaaaaagctcaccgggcccaacttcgggaccccgggtggcctggggttttaccccccggctgggggcccccgttccccggagaaaatcaggaccgccccccaaggaaaaaaaaaggagcccctcccacacccccccccttgggcccttgtgtccggggaaaacacccgcccggcgccctataaaaatttttcccccccccccgcaaacggggccacccaaattttttggtgttccccccaaaaaggt

SEQ ID NO: 74988 - protein, 154 aa, Zea mays
  misc_feature: Ceres CLONE 1559379
  misc_feature (73)..(155): Pfam Name: Chloroa_b-bind Pfam Description: Chlorophyll A-B binding protein
MALVSASSSSTTAVAALPRNGQQRASSSLFSSSSSSSFLVGKTLLRQAEAARPSFAVRAAADSDRPIWFPGSTPPPWLDGSLPGDFGFDPWGLGSDPESLRWNVQAELVHCQWAMLGAAGIFIPEFLTKIGVLNTPLWYTACEQQYFTDTTPSS

SEQ ID NO: 74989 - DNA, 935 bp, Zea mays
  misc_feature: Ceres CLONE 1559381
  misc_feature: Encodes the peptide sequence at SEQ ID NO. 74990
  misc_feature (673)..(673): n is a, c, t, g, unknown, or other
  misc_feature (779)..(779): n is a, c, t, g, unknown, or other
ctggagctccccgcggtggcggccgctctagaactagtggatcccccgggctgcaggaattcgtctcacccctagaaaaacgcgctcggggccgtcgatgccgccatggacgtcgtggccaagcgaggcggggagcagccagctctcgcgcgcagactcgtcatgctgctcgttaacctaacccacgttgagtccggcgtcgccgcgctcctccaggttggggatgagaaggtgcaaggcttgtatgttgcaaagcttgtgcgatcattctgtaggtcatccagtgattctgaagaggaagacatttttgagtacgttgcctccacacttgtcaatatatctaaggttgaagctggaaggagaatattgttggagcctaagagaggtcttctgaagcagattattcgacaatttgattcaacaaatcaacttagaaagaaaggggttgctggtacaattcgtaactgttgctttgaggctgatactcagcttctgagtttgctttctttagcagaatatctttggccagctctacttttgcctgtagccggaaagaagttgcccgactagctagtcgagacacctgagcgaccaggcgactaatcgcgatgaatcgacgattaggtcgactaatcgggtcctagtcgacctgggcgtccctactggttctccntgcatatttacagatatatagtgaagagacagatcaaaaatgccacttggagctatcgagtgcactctctcttgaaacgggaagttgttgaggattctgaaattcngcagcaggcattagaggctattttatatgatcgtattttgcagatggtgggccgaaagtcctttttggtcagttatgggccacgcattcctgcagggttggtatgaagatgaaaaggacccgaaggatggaggctattggaacttttgggtcccgg

SEQ ID NO: 74990 - protein, 154 aa, Zea mays
  misc_feature: Ceres CLONE 1559381
  misc_feature (1)..(155): Pfam Name: DUF383 Pfam Description: Domain of unknown function (DUF383)
MDVVAKRGGEQPALARRLVMLLVNLTHVESGVAALLQVGDEKVQGLYVAKLVRSFCRSSSDSEEEDIFEYVASTLVNISKVEAGRRILLEPKRGLLKQIIRQFDSTNQLRKKGVAGTIRNCCFEADTQLLSLLSLAEYLWPALLLPVAGKKLPD

SEQ ID NO: 74991 - DNA, 881 bp, Zea mays
  misc_feature: Ceres CLONE 1559383
  misc_feature: Encodes the peptide sequence at SEQ ID NO. 74992
ctggagctccccgcggtggcggccgctctagaactagtggatcccccgggctgcaggaattcgtctcacccctagaaaaaactcgcatccaccacagttccgcaccgcgccgtgccgtcccgagagaacaagcgagtcagtcgtcaaagagaaggaaagcggaaggcgagccacccgccccgcccaccacctaccgcgaaggcttgaccgtggcaacatcatccatgtcctcgtcgtcgtcgtcgtcgtcgtcgatgggaggctccctcgcgctcgccgcggccacggccgtcgcgttctccggctctctcgtcatcttctcgctctgccgcgcgcacctctcccatgtccccgagccggagccggagccggatgcctgaggagggcgcgccggagcacgccctgcgcccctgtctcttgtcgtcagagaggcggccgcgcggggcgaaggcgaaggcgaaggcgaggagacgcaggggcgagaagcgcgtgcggttcgcgcccgacgtcgtcgacaatgagggcgccccgcgcccgaccaggtcctccgcgcccgccaccgccgctgcgtcgtcgtcgtctgcggccacctgcatggacgcggcggggtcggaggatcgtatgatgcctgccaaccgtgaggcgctctaccgcggcatgctccgggtacgctccgcgcaccgggtcacctgctcctactgacgtacctctacgccgcccgggcgcggccagcctccgcgcgccgtttcgtccgcggcgggagagctcgatcggttggatcctctttgtttcgtccgccgtttagcgttagcgtccggtacccgggcggtggacttccgggaggtcatcccttcccaaaccgaggatttgttaatatagat

SEQ ID NO: 74992 - protein, 118 aa, Zea mays
  misc_feature: Ceres CLONE 1559383
MSPSRSRSRMPEEGAPEHALRPCLLSSERRPRGAKAKAKARRRRGEKRVRFAPDVVDNEGAPRPTRSSAPATAAASSSSAATCMDAAGSEDRMMPANREALYRGMLRVRSAHRVTCSY

SEQ ID NO: 74993 - DNA, 1016 bp, Zea mays
  misc_feature: Ceres CLONE 1559384
  misc_feature: Encodes the peptide sequence at SEQ ID NO. 74994
ctggagctccccgcggtggcggccgctctagaactagtggatcccccgggctgcaggaattcgtctcacccctagaaaaagtgcgagggaggaagggagacaaaaaggggagcccgatccaatcccaatcccaatcccctcccgccgcgtcacatctccgccgtcctcgtgccccgttacctctaaaaccctagcggggagccggggatgaagatccagtgcaacgcgagctgggccgcggagacgcaagtgctatgctgcacggacgaagccccgctctgcatctcctgctacgagtacgtgcacgccgccaacaagctcgcctggaagcaccagcgggtgactctcctgacggacgccgccgtcgctgcagccgcggctgccccggacgtgcccaagtgcgacatctgtcagggagctactggatacttctttctgccagcagaacgtgcactactttacagaagacggtgacgttgccatacacacattgggattccgttggtttcagtaactcaaaaattcctgcctaacgggattcccggggggggcctgatcccccctgatccaggccccaccatttggggaaaaagccccctaaaagccgcgggggggcaccccccaaacgaaccccgggaaaaattcccccaaaatttaatacccacaaaattcttttttcccgcttaaaggaagaaccctcccttcccccccaaaaaaaaggacacacatgggaattttttcaaaagaaaaaatttttcccccaccccccagggaaaaaaaaggtggtttgggccccataaaataattcaatttgggggggaaaacccccccccaaaaatcttttgaaggaaacccccccttttttatatttgtgaaaacacaaagttttccccccattttttgtccccatggggggggcccccctttttcccgcgggggtttggaaaaaaccccaccaaggggggggagaaggcccccccaaaaaaaaaaaaattgcccccccaaggtgttgaaga

SEQ ID NO: 74994 - protein, 88 aa, Zea mays
  misc_feature: Ceres CLONE 1559384
MKIQCNASWAAETQVLCCTDEAPLCISCYEYVHAANKLAWKHQRVTLLTDAAVAAAAAAPDVPKCDICQGATGYFFLPAERALLYRRR

SEQ ID NO: 74995 - DNA, 1020 bp, Zea mays
  misc_feature: Ceres CLONE 1559385
  misc_feature: Encodes the peptide sequence at SEQ ID NO. 74996
ctggagctccccgcggtggcggccgctctagaactagtggatcccccgggctgcaggaattcgtctcacccctagaaaaaacaagccgcaccgcaattagccgcgaccctccgcagaatcggctcacgtttccgatccagaggtccagactgttccccgagttttcccactgtgtcctctcctcgcgagtcccggcgaagcaggcgaaccgcgaacatgtgccccaccggcaggtacctggggctcgacctctccggcgctggcggcgacctgaggccggcgttcgacgtgcttgacgcggaccgggacggccggatcagccgggacgacctcaagtccttctacgccgccgcggggcccgccgccggcgaccggttcgacgacgacgacctcgcggccatgatcgcggccgccgacgccgaccgcgacggcttcgtgcagtacgacgagttcgagcgcctgctggccggccgcgcccgcggcggcccgccgccgccgcggggaggcgctggggcgccgcctccgcccctggaaggggccccttccggcctcatgggaccgggaacgggtgaccggtttgggtccgccttccaaggacctccaaggccctaccccccaacggggcccgggattccccccggcgggaaaaaaggaaggcccccccccctttaacccgcgtccccctggggggaaaggggaacggccgggtaaaaagcgttgggggcctccaaggccccttcccggagaagggttcccccggccccacccgagaaaggacccccccccttttattttttagaaaaaaccacgggggggggggtgcggagagaaaacgaattctttttttcctggggggtttcccggggggggagaggggggggggctctcccccaaaatattttggggggtgaagggggggcccccgggacccccctcaaaaagaaaaaaaaatccccccccgagggcgccttttatataatttttttcgcgccaaccccatttttttttatgttggtggtt

SEQ ID NO: 74996 - protein, 151 aa, Zea mays
  misc_feature: Ceres CLONE 1559385
  misc_feature (58)..(86): Pfam Name: efhand Pfam Description: EF hand
  misc_feature (18)..(46): Pfam Name: efhand Pfam Description: EF hand
MCPTGRYLGLDLSGAGGDLRPAFDVLDADRDGRISRDDLKSFYAAAGPAAGDRFDDDDLAAMIAAADADRDGFVQYDEFERLLAGRARGGPPPPRGGAGAPPPPLEGAPSGLMGPGTGDRFGSAFQGPPRPYPPTGPGIPPGGKKGRPPPL

SEQ ID NO: 74997 - DNA, 851 bp, Zea mays
  misc_feature: Ceres CLONE 1559386
  misc_feature: Translation starting site: 130
  misc_feature: SWISSPROT Homolog: EC 5.1.3.1 Ribulose-phosphate 3-epimerase
  misc_feature (785)..(785): n is a, c, t, g, unknown, or other
  misc_feature (825)..(825): n is a, c, t, g, unknown, or other
ctggagctcaccgcggtggcggccgctctagaactagtggatcccccgggctgcaggaattcgtctcacccctagaaaaaactactctgccaccaatccggggaggaatcaacctagcggtaagcggacatggcggcggcgaagatagcgccgtcgatgctctcgtcggactttgccaacctcgcttcggaggctgagcgcatggtccgcctaggcgccgactggctacatatggacatcatggatgggcacttcgttcctaacctgactattggggctccggtgatccagagcttgaggaaacataccaaagcatatttggactgccatcttatggtcacaaagccttcagattacgtagaaccatttggaaaggctggcgcttctggattcacattccatatagaagttgctagagacaactggcaagatctcatccaaagcattaaatcaaagggtatgcgagcctggtgtatcattgaggccaggtactccagtggaggaagtttttcccctggtggaagcagaaaatccggtagaattggttcttgtgatgacagtcgagcctggttttggtggtcagaaatttatgccagatatgatggataaggtgcgcacactgagaaagaagtacccttcccttgacatagaagttgatggtgggtctaggtccttcaaccatagacgtggccgcatctgctggggccaattgcatcgtcgctggaagctctatatttggcgctgcggacccagagccatcatatctgtgctggagaagaacgtcnagggctctcatacaaaaacggattttggtgtttccgctgnaaaagacctcccctccgtttttttat

SEQ ID NO: 74998 - DNA, 943 bp, Zea mays
  misc_feature: Ceres CLONE 1559387
  misc_feature: Encodes the peptide sequence at SEQ ID NO. 74999
  misc_feature (709)..(709): n is a, c, t, g, unknown, or other
  misc_feature (834)..(834): n is a, c, t, g, unknown, or other
ctggagctcaccgcggtggcggccgctctagaactagtggatcccccgggctgcaggaattcgtctcacccctagaaaaagtattcttccgcaggtataggatatgcattggcaaggaaatttctggaggctggtgataatgttataatctgctcgagatcagctcaaaaggtagaatctgtggtcggtgacttgaaggaggagtacggagagcaacatgtgtggggaactgtctgtgatgttagaaatggaaaggatgtaaaggcacttgtggagtttgcacgtgacaaacttaagcatattgatatatggatcaacaatgctggatcaaatgcatatacatacaaaccactagtggagacctctgatgaggctctcatggaaatcatcaccactaacacccttggattgatgatatgttgtcgtgaggcaataaatatgatgaggaaccaacctcgaggtggtcacatattcaaccttgatggtgctggttctgatggaaggcaactccaaggtatgtgtttccaaattccaaatacctagtgtaatttaatgtggacacaggctgaggaatatgctactactccctccgttctcgaatatttgtcgccggctagttcatttttgaactaaaacgcgccagataaaaaagaacggaaggagtacatgattttatcttcctttgattcacaatgataagacactgtgnttctgtagtgtataatatcctcttgatttttaacgctggctggatcaaaactctatcgtcctcttcccttaggggtggtatgttgtatttgacactatatgacacgacattggaagtgggtcagntacttgggaataagtgaaaatccgttggtgaacagaaacagattgcagcaaagattaacacattttgatttttgggggcaaatattagggtgaattaccgaaaattgaa

SEQ ID NO: 74999 - protein, 54 aa, Zea mays
  misc_feature: Ceres CLONE 1559387
MEIITTNTLGLMICCREAINMMRNQPRGGHIFNLDGAGSDGRQLQGMCFQIPNT

SEQ ID NO: 75000 - DNA, 879 bp, Zea mays
  misc_feature: Ceres CLONE 1559388
  misc_feature: Encodes the peptide sequence at SEQ ID NO. 75001
  misc_feature (726)..(726): n is a, c, t, g, unknown, or other
ctggagctcaccgcggtggcggccgctctagaactagtggatcccccgggctgcaggaattcgtctcacccctagaaaaaaccccatccaaggccctcccaaagtcccaaaggccgccgccgcccgccagcccaccatggccgcgcagtccttcctcctcgccgccactgccgccgccaggtcccccgcggtcttcgccgctccctattcctccgcacgccctttccactcggtccacttcgtcgccggcccgtggggcgccgccgccgccagggcgctcgtcgtcgcggacgccactaagaaggccgtagccgtcctcaagggcgcgtctgaggtcgagggcgtggtcacgctcacgcaggacgacgatggacctacaactgtgaatgtccgtatcactggacttacccctggacttcatggcttccacctccacgagtttggtgatactaccaatgggtgcatatcgacaggaccacattttaatccaaacaatctgacgcacggtgcaccagaagacgaagtccgtcatgcgggtgacctgggaaacattgttgcaaatgctgaggtagccgaggcaaccattgttgatacccagattcctttgactggcccaaattcagttgttgggagagcatttgtggttcatgagcttgaagatgattggggaaagggggccatgagctcagcctctctactggaaatgctggtggaagactggcatgntggtgttgttggcctgactccattgtaggttgctcgccgggtgccccggtttgcagtgcagctaccctgttaattcctgccttgggttgaactttggcttcaatcgaggtattggggacagtgacctttttggatacttggatgcatccaggg

SEQ ID NO: 75001 - protein, 205 aa, Zea mays
  misc_feature: Ceres CLONE 1559388
  misc_feature (54)..(204): Pfam Name: Sod_Cu Pfam Description: Copper/zinc superoxide dismutase (SODC)
  misc_feature: SWISSPROT Homolog: EC 1.15.1.1 Superoxide dismutase
  misc_feature (197)..(197): Xaa is any aa, unknown, or other
MAAQSFLLAATAAARSPAVFAAPYSSARPFHSVHFVAGPWGAAAARALVVADATKKAVAVLKGASEVEGVVTLTQDDDGPTTVNVRITGLTPGLHGFHLHEFGDTTNGCISTGPHFNPNNLTHGAPEDEVRHAGDLGNIVANAEVAEATIVDTQIPLTGPNSVVGRAFVVHELEDDWGKGAMSSASLLEMLVEDWHXGVVGLTPL

SEQ ID NO: 75002 - DNA, 995 bp, Zea mays
  misc_feature: Ceres CLONE 1559390
  misc_feature: Translation starting site: 131
  misc_feature (947)..(947): n is a, c, t, g, unknown, or other
ggagctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagtacttcgccaagaaccgcgagctgggacgtgatccactcccgctgggtcatgctcggcgacctcagctgcgtcttccccgagctgctctcccccacggcatcaagttccgggaggccctcttgtttcaggcccgcctccaaaatctgaaccaaggggtggatggaatacccccgaaacccctgccggaccccggggaaaagatccctccccaattggcccctccaagggtggcccaggggccccctcaaagggtacccaatttccccggggcccctctggaaaaacccccaccccccttaaaccggggggagttttccaccccctgggcggccgaaaaacaccggggtcttcccaaaacccgggggaagggggcccaaaagccccgcccccgccttgttcccagggggaggttttttggggggggcctccccccggaaggcggccgccaaaaaaccccaggaaaaaaggggggacaccaaaaaaaagaatgggggcgaccccaaaaattcgccggggaaaaaaaaaagggggggggtacaccacttttttttttttttngaaaggagggggcgcccccctttataatttaaacaacgcaactttgtt

SEQ ID NO: 75003 - DNA, 825 bp, Zea mays
  misc_feature: Ceres CLONE 1559392
  misc_feature: Encodes the peptide sequence at SEQ ID NO. 75004
  misc_feature (590)..(590): n is a, c, t, g, unknown, or other
tggagctccccgcggtggcggccgctctagaactagtggatcccccgggctgcaggaattcgtctcacccctagaaaaagcacagagtggtaagcatggcgagcaccacagacaaccgtggcctcctcgtcgtggccgccgccaccgtcgtcctcgccgtggccgcggccccggcgcatacaccggggggcaatactgctacccctccgccgccgttccggacggtgtacgcgttcggcgactcgttcacggacacggggaacacgcggtcgacgacggggccctactcgttcggctacgtgtccagcccgccctacggcgccaccttcttccaccgctcgaccaaccgctactccgacggccgcctggtggtggacttcctggccgaggcgctggcgctgccgtcctacctcccgccctacctcgccgtgtccgtctccaacgccaacgccacggcggccggagccggcgtcaacttcgcggtggccggcgccacggccatcgagcacgacttcttcgcgcggaacacctcagcatcgacgtcacgccgcagtccatcatgacgcagctgggctggttcgacgcgcacntgctccgctccctccctctccgccgcgccgccgccgaagcgctcttctgggtgggcgagatcggcgccaacgactacgcctacacagtggtcgcccgcgaaaccatcctcccaagctcgtcggcaccatggccgtccagaggggcaccgcccttcttcaaaggcctgctggaaccaagcccccaattacgtattccttgcaggggctgcccccttaagggggggcctgcccctgg

SEQ ID NO: 75004 - protein, 155 aa, Zea mays
  misc_feature: Ceres CLONE 1559392
  misc_feature: SWISSPROT Homolog: EC 3.2.1.51 Alpha-L-fucosidase
MASTTDNRGLLVVAAATVVLAVAAAPAHTPGGNTATPPPPFRTVYAFGDSFTDTGNTRSTTGPYSFGYVSSPPYGATFFHRSTNRYSDGRLVVDFLAEALALPSYLPPYLAVSVSNANATAAGAGVNFAVAGATAIEHDFFARNTSASTSRRSPS

SEQ ID NO: 75005 - DNA, 848 bp, Zea mays
  misc_feature: Ceres CLONE 1559394
  misc_feature: Encodes the peptide sequence at SEQ ID NO. 75006
ggagctcaccgcggtggcggccgctctagaactagtggatcccccgggctgcaggaattcgtctcacccctagaaaaaactgctcgagctcagctcaagtaaccacagaaaatggcgtcacttctccgccctctcgtcctcgtgctcctgatcgcctcctgcacagcgcagcagtcaccgccggcgcagcccccgccaacgccgaacgcgccaccggccaactcgccgccccaggcgcctccagccggcaacccgccgccggcaggcaacccgccacccgcgcccaccgccactccacctccggccccgaccactccgcccccggccccgaccactcctcccccggctcccacaacgacgccgccggcgccgtacatctcacctccgggcccccacacgccggctgcagtcccatcaggggtggcaccgcacgtctccacaaatccgccacgttctccccctgtaaggccgacgaccgtttccggcagcccaggacccgtttccggccatggtgcccccattcgagcttgtcccgcttcaacgggcacccgagcgcaacggggggagcccaaggcgggcccccagatgtggcccctattccccgcgaccggggggaaaccgggtggggtcccccaaaagccacaataacccgaggcccccccccggggaagtccccgggggcccctcttcttcggccgggggcccccccacaaaaaaagaaaatgggggcaaaaacggcgcccgggggggggttcccccaaaggggtgaagttttgggggaaccccttcccccccccctttttttcttttaagaaaaaaacaacgaaatccctccccccggggaaaca

SEQ ID NO: 75006 - protein, 29 aa, Zea mays
  misc_feature: Ceres CLONE 1559394
MGAKTAPGGGFPQRGEVLGEPLPPPLFFF

SEQ ID NO: 75007 - DNA, 919 bp, Zea mays
  misc_feature: Ceres CLONE 1559397
  misc_feature: Encodes the peptide sequence at SEQ ID NO. 75008
  misc_feature (728)..(728): n is a, c, t, g, unknown, or other
ctggagctccccgcggtggcggccgctctagaactagtggatcccccgggctgcaggaattcgtctcacccctagaaaaaaccgcgctcaggagcattcgagaagccgaagaaaattcgaagacgaggaccagctacactgcggacggacttcgggcatggagggccagttccaggttggcaaggaggaggtcatccaagcatggtacatggacgacagtgaagaggaccagaggcttcctcatcatcgcgagcccaaagaattcattcctctcgacaaactttccgaactaggaatattaagctggcgcctaaatgctgatgattgggagaatgatgagaacctcaagaaaattcgtgaagccaggggttactcttacatggacatttgtgatgtgtgcccagagaagttgccaaattacgaggctaagataaagaaattctttgaagaacacttgcatactgatgaaaagatacgatattgcctttgagggtagcggctactttgatgtgagggaccagatgatcagtgggatccgtgtagcggaaaaaaagggggcatgatcgttttgcctgcagaaatgacctcccttttccttggaaagggcaactccttaagggaatgcctcttttttggggggaaccctccgggaaacctaaaatcgtccccatgaacactccccgcctagaaaggagtcctcaaaaaaaccccccccggggggaacccancccccaaaccctttaagggtgccccctaaatggcccccgcccccacacccttttttttttaccccaaaatcctttatccccaaaaaaaatttttttccaagaggcccctccccccccggggggcccaataaattttgcaaaacccccaaaaactccccaatattttttgaaaaaaaaaaaaggaggggtaa

SEQ ID NO: 75008 - protein, 110 aa, Zea mays
  misc_feature: Ceres CLONE 1559397
  misc_feature (14)..(111): Pfam Name: ARD Pfam Description: ARD/ARD' family
MEGQFQVGKEEVIQAWYMDDSEEDQRLPHHREPKEFIPLDKLSELGILSWRLNADDWENDENLKKIREARGYSYMDICDVCPEKLPNYEAKIKKFFEEHLHTDEKIRYCL

SEQ ID NO: 75009 - DNA, 923 bp, Zea mays
  misc_feature: Ceres CLONE 1559400
  misc_feature: Translation starting site: 200
  misc_feature: SWISSPROT Homolog: EC 1.8.1.4 Dihydrolipoyl dehydrogenase
  misc_feature: SWISSPROT Homolog: EC 1.16.1.1 Mercury(II) reductase
  misc_feature (713)..(713): n is a, c, t, g, unknown, or other
catagctggagctccccgcggtggcggccgctctagaactagtggatcccccgggctgcaggaattcgtctcacccctagaaaaaatccccggttcccccacgcccaccttttcttcttcccatctcgtctctctctcttcagcgcgcaaggatctcttcttcggggagagaggaccaaggaagcgcccgcggagagagatggcgctggcgatcctagcgaggcggcgggctgcagcggccgtgttgcggcggccgcagacggcggcgggggcggccgtgtccgcctggagggcgtacgcggcggcgggcgaggagagcgactggtggtggtgggcggcgggcccggagggtacgtggcggcgatcaaggccgcgcagctggggctcaagaccacctgcatcgagaagaggggcaccctcggcgggacctgcctcaacgtcggatgcatcccatccaaggctcttttgcattcatcacatatgtatcatgaagcaaagagttcttttgcacacccatggagttaagttttcaaatctggaagtggacctcccagccatgatggctcagaaagacaaagctgtggcaggactaacaaagggaattgaagggctctttaaaaagaacaaggtgacttatgttaaaggctttggaaaactgtcatccccctcagaagtgtcagttgatttgatttgatggtggtagcaccattgtncaaggaaaaacataataatggcactgggtctgatgtaaatcacttccaggaatacaaatgattgagaagaagttgttcatctactggtgcactgtgcttgtcaagatcccgaaaaaactggggtaatcgggagcaggtatattgccttggaatggttcagtctggaaccgcctgggtcaaaagtcactggttgtgaatttccccggatat

SEQ ID NO: 75010 - DNA, 890 bp, Zea mays
  misc_feature: Ceres CLONE 1559401
  misc_feature: Encodes the peptide sequence at SEQ ID NO. 75011
ctggagctccccgcggtggcggccgctctagaactagtggatcccccgggctgcaggaattcgtctcacccctagaaaaaaaccagccagtcagaagagtaacacctggagcggcagctgcagtggccgatgccggagcacgcaaggcatggatagataccaaagggtagagaagcctctgaatgacacaccaatcagccagaatgagattaggattactactcaggggaggatgaggaactatatcagctatgggatgtcgctgcttgaggaaaatggacacggtgagattagtatcaaggccatgggacaggccataaataagacagttatggttgttgaattgattaagagaagggttggaggtcttcatcagaacagtgccactgaatctgttgatatcacagacacatgggaacctttggaagaaggccttctcccagacaactcgccatgtgtcgatgatcactgtgacgctatcaaagaagcctctggatacatcatctccaggataccaaccacctatcccagctgaagaagtgaaacctgcttttgactatgaccatgaagattcgtatcctactggccgtggaagacgacgtggtgcgtgggagaaaagcaggaggaagatgtatgagcaatggtccccctccacccgctgatggtaaccatgcagtacgggaaggatggaaggacattgctataatataagacgtgggacagaggaaggtcccctggacgatgcatagtgcctggtggctacattgcaggtgggaacgcgtgaggggcacactaacgggcaatggtgcgagatgctggtactatgatgagcagaccaatgctatgatgatcctgtacaatatccccctgcaggcagttctttgggcgtt

SEQ ID NO: 75011 - protein, 128 aa, Zea mays
  misc_feature: Ceres CLONE 1559401
  misc_feature (17)..(87): Pfam Name: Alba Pfam Description: Alba
  misc_feature: SWISSPROT Homolog: EC 3.1.26.5 Ribonuclease P
MDRYQRVEKPLNDTPISQNEIRITTQGRMRNYISYGMSLLEENGHGEISIKAMGQAINKTVMVVELIKRRVGGLHQNSATESVDITDTWEPLEEGLLPDNSPCVDDHCDAIKEASGYIISRIPTTYPS

SEQ ID NO: 75012 - DNA, 968 bp, Zea mays
  misc_feature: Ceres CLONE 1559402
  misc_feature: Encodes the peptide sequence at SEQ ID NO. 75013
  misc_feature (644)..(644): n is a, c, t, g, unknown, or other
  misc_feature (758)..(758): n is a, c, t, g, unknown, or other
  misc_feature (798)..(798): n is a, c, t, g, unknown, or other
  misc_feature (820)..(820): n is a, c, t, g, unknown, or other
ctggagctccccgcggtggcggccgctctagaactagtggatcccccgggctgcaggaattcgtctcacccctagaaaaagtctctgaacagcactcataccttgctagccatggacgcggccatcgccgggcagcaggcgaggcgccggatccagccgccggaaccactcgtgatggccgggacgccgccaacgcccgcagcgttccggtgtccgatctcgcttgaggtgatgcggtcgccagtcagcctccccaccggcgccacgtacgaccgcgcgtccatacagcgttggctggactccggccaccgcacctgcccggccacgcggctgccgctggcgtccaccgacctggttcccaacctgctgctgcgccgcctcatccacctgcacgcggccacgctgccgccttccccgtcgcccgaggaggtgctgtcgcagctggccgccgcagacggggagcccgcggccgcggagaaggccgtgcggtcgctggcggccaagatcgcgccggagaaagggaagcgggcctcggtcgcgtccgcggtgtccgccgatctcgactccgcggtgccggcgctcctctcgttcgccaagggcggggcgggcgcctacgcgcgcgtggacgcggtgagggtccttgnctaccgtggccccggagctggtcccttacttgacgggggatggcacggagatcgcgacagggtgagtattggcggtggaagccctggccgccgtgctgcccgcggatgtatccncgtaagagccagggatgggctcgtccctgctcttgtcccntagatcctgggcgcgtcgtganaaccctgctcggggcggcgcgaaaggggccgcggcctttgaggcattctgaactcgggccccttgtacccggacccaaaaccgaatcgccgaaggggcggactgttcccgggacccgtggggatcctaaggacccccttccaagcggt

SEQ ID NO: 75013 - protein, 229 aa, Zea mays
  misc_feature: Ceres CLONE 1559402
  misc_feature (29)..(101): Pfam Name: U-box Pfam Description: U-box domain
  misc_feature (178)..(178): Xaa is any aa, unknown, or other
  misc_feature (216)..(216): Xaa is any aa, unknown, or other
MDAAIAGQQARRRIQPPEPLVMAGTPPTPAAFRCPISLEVMRSPVSLPTGATYDRASIQRWLDSGHRTCPATRLPLASTDLVPNLLLRRLIHLHAATLPPSPSPEEVLSQLAAADGEPAAAEKAVRSLAAKIAPEKGKRASVASAVSADLDSAVPALLSFAKGGAGAYARVDAVRVLXYRGPGAGPLLDGGWHGDRDRVSIGGGSPGRRAARGCIXVRARDGLVPALVP

SEQ ID NO: 75014 - DNA, 931 bp, Zea mays
  misc_feature: Ceres CLONE 1559403
  misc_feature: Translation starting site: 443
  misc_feature: SWISSPROT Homolog: EC 3.4.22.14 Actinidain
ctggagctccccgcggtggcggccgctctagaactagtggatcccccgggctgcaggaattcgtctcacccctagaaaaaatctgctctgctccggtccgttccgctccttcctccccctatctagctagccttcccgttcctgcatcgcggcggagatgggcgcctcctcctcgccgacgcgggcgtccactccttccgcctcgggctcaaccgcttctccgacctcaccaacgacgagtaccgcgccacctacctcggcgtcaggagcaagccgcagagggagaggaggctcggtgacaggtacctggccggcgacaacgaggacctgccggagtccgtctactggcgggccaagggcgccgtcgcggagatcaaggaccagggcagctgcgggagttgctgggctttctcaacaatagcggctgtggaacgcatcaaccatgattgttactggcgacatgatctccttgtctgaacaagagcttgttgactgtgacacttcatacaaccacggatgcaatggaggtctgatggactatcgcgtttgagttcatcatcaacaatgtcggaatcgacaccgatgatgattacccttacaagggcacggacggaccgatgtgatgtcaacaggaaaaacgccaacgttcgtactatcgacagctattgagatcgtccagcgaacagtgagaaaagctgcataaggcaggtgcgaacccagcccatcaatgtcgcaattgaagctgttggaaaacattccagcccaaaactcgggtatcttcccggaccggtggaaagctttggacttggtgcacggccgcagctccgccaaaaaacggcaaggacaccggtcttgaaaaatcttggggaccccctggggcaacccgctccctaagagaaccaaacataggtcccccgcaaagtggttcccc

SEQ ID NO: 75015 - DNA, 931 bp, Zea mays
  misc_feature: Ceres CLONE 1559404
  misc_feature: Encodes the peptide sequence at SEQ ID NO. 75016
gctggagctccccgcggtggcggccgctctagaactagtggatcccccgggctgcaggaattcgtctcacccctagaaaaaaggcaaagtataagcgcagatcgagtcatcaagctagctagcccggagcacgcctagacgccagcagcaatggcggctcagctggccgtcgcgttcctcgccttgttgtcctcctctgccttcttggccgtgtctggccagaagttcaacgccatcttcagcttcggcgactccatgtccgacaccggcaacctgtgcgtgaacggtccccccgccggcctgacgctcacccagccgccctacggcgagaccttctttggccgcgccacctgccgctgctccgacggccgcctcgtcgtcgacttcctggccgagaagttcgggctgccgctgctgaagccgtcgaagcagggcggctcagacttcaagcagggcgccaacatggcgatcattggcgcgaccaccatggactcgggcttcttccagtctctgggcatcgccgacaagatctggaacaacgggcccctcaacacccagatccagtggttccagcagctgatgccgtccatctgcggctcgacgcaggcctgcaagtcgtacctgtccaagtccctgttcgtgctgggcgagttcggcggcagcgactacaacgcgcagatcttcggcggctacaccccggagcaggcgagcgggcagagcgccaccatcgtggacgccatcggcaagggcgtggagcagctcatcagcctgggcgcatggtacctggtggtccggggcgtgctgcccgtggggtgctttccgatctacctgaagctgtacaggactccagcgccgcgactacaaccagtacggctgcctgaagcgcttcaacccctgtcgggccaacaaactcgtggggtgaggaccaggg

SEQ ID NO: 75016 - protein, 260 aa, Zea mays
  misc_feature: Ceres CLONE 1559404
  misc_feature (29)..(254): Pfam Name: Lipase_GDSL Pfam Description: GDSL-like Lipase/Acylhydrolase
  misc_feature: SWISSPROT Homolog: EC 3.2.1.51 Alpha-L-fucosidase
MAAQLAVAFLALLSSSAFLAVSGQKFNAIFSFGDSMSDTGNLCVNGPPAGLTLTQPPYGETFFGRATCRCSDGRLVVDFLAEKFGLPLLKPSKQGGSDFKQGANMAIIGATTMDSGFFQSLGIADKIWNNGPLNTQIQWFQQLMPSICGSTQACKSYLSKSLFVLGEFGGSDYNAQIFGGYTPEQASGQSATIVDAIGKGVEQLISLGAWYLVVRGVLPVGCFPIYLKLYRTPAPRLQPVRLPEALQPLSGQQTRGVRTR

SEQ ID NO: 75017 - DNA, 926 bp, Zea mays
  misc_feature: Ceres CLONE 1559405
  misc_feature: Encodes the peptide sequence at SEQ ID NO. 75018
  misc_feature (682)..(682): n is a, c, t, g, unknown, or other
  misc_feature (686)..(686): n is a, c, t, g, unknown, or other
gctggagctcaccgcggtggcggccgctctagaactagtggatcccccgggctgcaggaattcgtctcacccctagaaaaatctcaaaaggaagcaaaatcttgcccaactgcgtggatttttgaatttgaagcctatggctgccaatatcttgtggaataagatatttgtgtaatctggttgtggagatccatatgatctgccgttatccatctactcttctgttaagaagttttgtatgacagttccttcaaattatttgttccaacaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtcccggggatcctggtgccggaagctctgggcctgggcaaactggtgaaggcgcangaantgggcggccgtcccggcggggcaaggcacgtactggggcccccccgggtgcgtggggcacgctgccgaccctccgtgtggatcgagttcgtggccatcgcctttcgcgaagcacagcgcaccagggagaaggaccctcagaaagaaaagtaccccggcggccccctcgacccgctcggtttctccaaggacccgccaaagttcgagagtccagcccaggaaattaagaacgccccctccc

SEQ ID NO: 75018 - protein, 198 aa, Zea mays
  misc_feature: Ceres CLONE 1559405
  misc_feature (54)..(196): Pfam Name: Chloroa_b-bind Pfam Description: Chlorophyll A-B binding protein
  misc_feature (117)..(117): Xaa is any aa, unknown, or other
  misc_feature (119)..(119): Xaa is any aa, unknown, or other
MVMASSSGLRSCSAVGVPSLLAPSSRSGRLAPFCANATTSGRVTMSAEWMPGQPRPAHLDGSSPGDFGFDPLGLATVPENFERFKESEVYHCRWAMLAVPGILVPEALGLGKLVKAXEXGGRPGGARHVLGPPRVRGARCRPSVWIEFVAIAFREAQRTREKDPQKEKYPGGPLDPLGFSKDPPKFESPAQEIKNAPS

SEQ ID NO: 75019 - DNA, 904 bp, Zea mays
  misc_feature: Ceres CLONE 1559406
ctggagctccccgcggtggcggccgctctagaactagtggatcccccgggctgcaggaattcgtctcacccctagaaaaagtcacaccttacctcggtcgatgtcatattgtagcagccagctccatcgatcgctgtttaaaatcctagctaccctcttcttgccgatcactctcctttcatctgcattctaatggttgtccaacccgtcaggtcaacctacaagggctagtatatactaggtgcatcagggaatgaccaatgctagtgaagtattcgccagctgcactgcaataggcagcctcaattctttctatactcgacggagcacaagacaacgaagacccgactcaactaattgcgggagcggccgatgactgatcagagaagtcgaagagaagaattccgcagaaggagcctgctaagaaggctgaccagcctgacgcgaccaccgagttacataccaagaacactccgacctcgcatatggtacgggatgcacgctgcggcggcgcaaaaagtaatagaggctatggccgctggagaacaagatcctagaataggcggactgggatatggccagaaccgcgggctcatggtggacgatgaatatgacttccagagatgttagagcggccgaggctagggtgatggtgctgcaacatgtagatcggcaacgacaaaggatatagagactcttccccactacgtgccggaaacacagcttgaggatacggaatgttgatgctgctgatgactacgaccaggactccagaatactatgacgcccgacggtactgtcatgctagtatatgacaatattgtgcacgacggagtactgggccctgtcactatgactatgccctgatgcatagatcccttcaaagaagagctgctctgtgcca

SEQ ID NO: 75020 - DNA, 870 bp, Zea mays
  misc_feature: Ceres CLONE 1559407
  misc_feature: Encodes the peptide sequence at SEQ ID NO. 75021
ctggagctccccgcggtggcggccgctctagaactagtggatcccccgggctgcaggaattcgtctcacccctagaaaaaaccataccgtcccacgcggcctcccctactaaccctatcccccggcgaccgggaactggaaccgatggaccgcctcgtcgtcttctcccgccgccgccgccgctggatcctcctcgctgcggccggtgcggcggcggccgtcggcgcgtacaagatctaccaccaccctgccgtcgcggaacgtcgccgccgcctcgtgcgcctagccgccgccatcgcggcctttgctgatgccgccgcatcatccgccgacgccgtggccctggtgacatccgatctcgccgactttgtccgttccgacgcggacgaggtcccccgcagcgtcaagcagctggccaagctcgccgcctcccgtgaggtatccgccaccgtctccaccctatccgaggcagtaacctccgggatccttcgcgggtcgggatcctctagctccgggcccgcatccggcggtaccgtggccctctccgatcgtctcgtagacaggctcttctctgactcaggcgagcgccttgcgtccgcggttgccggcagcttcgcccgccatctcgtcctcgccttttactccgctccttcaccacaaggggaggcgtcctcctccccgacgatgtgggtcaacgtggttgcgactggaaagtgccggaaagcgataagcaactgggtttgagtcttcctgggggactgctgtgaggggagtcattgacaagaccatccacatcaacacctacgagcagctcttcgaatggctcaccatccgagacatgacgctaagtcaaggattggcttgtttcat

SEQ ID NO: 75021 - protein, 199 aa, Zea mays
  misc_feature: Ceres CLONE 1559407
MDRLVVFSRRRRRWILLAAAGAAAAVGAYKIYHHPAVAERRRRLVRLAAAIAAFADAAASSADAVALVTSDLADFVRSDADEVPRSVKQLAKLAASREVSATVSTLSEAVTSGILRGSGSSSSGPASGGTVALSDRLVDRLFSDSGERLASAVAGSFARHLVLAFYSAPSPQGEASSSPTMWVNVVATGKCRKAISNWV

SEQ ID NO: 75022 - DNA, 958 bp, Zea mays
  misc_feature: Ceres CLONE 1559408
  misc_feature: Encodes the peptide sequence at SEQ ID NO. 75023
  misc_feature (768)..(768): n is a, c, t, g, unknown, or other
  misc_feature (795)..(795): n is a, c, t, g, unknown, or other
  misc_feature (800)..(800): n is a, c, t, g, unknown, or other
  misc_feature (833)..(833): n is a, c, t, g, unknown, or other
ctggagctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgcaacggcgtcaagttcggcgaggccgtgtggttcaaggccggctcccagatcttcagcgagggcgggctggactacctcgggaacccgagcctcatccacgcgcagagcatccttgctatctgggcctgccaggtcgtgctcatgggcgccgtcgagggctaccgcatcgccggcggccccgctcggcgaggtcgtcgacccgctctaccccggcggcagcttcgacccgctcggcctcgcgtagaccccgtagccntcgccgagctcaaagtcaagagctcangaacngccgcctcggcatgttctccatgttcggattcntcgtcaagcatcgtccacgggaaggcccgctcgagacctcgctaaccacatggcgacccgtcacaacaagcttgggctacgccacacttcgtcccggtagtgaggagcgccccccggtactttag

SEQ ID NO: 75023 - protein, 242 aa, Zea mays
  misc_feature: Ceres CLONE 1559408
  misc_feature (65)..(214): Pfam Name: Chloroa_b-bind Pfam Description: Chlorophyll A-B binding protein
  misc_feature (207)..(207): Xaa is any aa, unknown, or other
  misc_feature (216)..(216): Xaa is any aa, unknown, or other
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPARRGRRPALPRRQLRPARPRVDPVAXAELKVKSSXTAASACSPCSDSSSSIVHGKARSRPR

SEQ ID NO: 75024 - DNA, 949 bp, Zea mays
  misc_feature: Ceres CLONE 1559409
  misc_feature: Encodes the peptide sequence at SEQ ID NO. 75025
  misc_feature (642)..(642): n is a, c, t, g, unknown, or other
  misc_feature (814)..(814): n is a, c, t, g, unknown, or other
  misc_feature (816)..(816): n is a, c, t, g, unknown, or other
  misc_feature (838)..(838): n is a, c, t, g, unknown, or other
ggagctccccgcggtggcggccgctctagaactagtggatcccccgggctgcaggaattcgtctcacccctagaaaaaaacatattgtctcctcttggactggaattcctgtggagaaagtgtcatcggatgagtctgaccgcctcctaaagatggaagagacgctgcatacacgtatcattggacaggatgaggctgtcaaagctattagccgtgctatccgccgtgctcgtgttggcctcaagaatccaaataggccaattgccagcttcatattctctggaccgactggagttggcaaatcagagcttgcaaaggccctggcggcctactactttggctcggaggaggctatgatcaggcttgacatgagtgagttcatggagcggcatactgtctccaaactcattggatcacctccaggttatgttgggtacactgagggaggccaactaactgaagcagtccgtcgccgcccgtacacagttgttctctttgatgagattgagaaggcacatccagatgttttcaacatgatgcttcagatcttagaagatgggcggttaactgatagcaaggggcgcacagttgatttcaagaacacactattgatcatgacatctaatgtcgggagcagtgtcnattgagaagggaggtcgcaagattgggttcgaccttgattatgatgagaaagacacaagctataacaggatcaagagccttgtgactgaggagttgaagcagtactttccggccagagttcttgaacagattggatgaagatgattgtattccggcagctgaactaattggnangtgaaagagattgcagacattnatgctgaaagaagtgtttgacaggctgaaggccagggcaattatctccagggggacggagaagttcccgagaagagttggttgacgagggtataacccgagcctatgtgcc

SEQ ID NO: 75025 - protein, 163 aa, Zea mays
  misc_feature: Ceres CLONE 1559409
  misc_feature (35)..(163): Pfam Name: AAA_2 Pfam Description: ATPase family associated with various cellular activities (AAA)
MEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSV

SEQ ID NO: 75026 - DNA, 905 bp, Zea mays
  misc_feature: Ceres CLONE 1559410
  misc_feature: Encodes the peptide sequence at SEQ ID NO. 75027
ctggagctccccgcggtggcggccgctctagaactagtggatcccccgggctgcaggaattcgtctcacccctagaaaaaccgcttcgctttccttcccttccctgccggctgccgccgctgctatttatccctcccactctctccctgcgactccaaccgctgcagcagagacgcccgaggcagcgcagagcagcagaccgcacgtcacacaccaccattgcagcaatggcgcgcgccggcgctctctgcctggcgctgctgtgcctcgtagccgtgcactcggccgtggcgcagaaatccaccccggccccggccaccgcaccggccgccaccaccaacccaccggcgaccccgtccaagaagacgcccgcgccagccgcggcgccgcccaccacccccgccaccctggccccggccgccgcgccgcccaccacccctgccacccccgcgcccgccgcgaccccgccagccaccctggctcccgccgcgtcaccgcccaaggcgtcccctcccgcgccggcgcccaaggccaaggccaccccgcccgcccccgccgcctccccgccggtggccgagctgccgcccgccgcctcgcccccggcccccgcccccgcctccccgcccaccaagcccgccgaagtccccgcgcccgcgccgtccaagaagaagaagaagccctcctcgtcctcgtagaacaagaagaagagtccaaggcccccgcccccgcccccgtcgtcgccgaggcacccaccgctccaagcactccaggctaaggcgccctcagcagcggagccgacgcgcccgcccggtcggcgacgccggcgccgcgacacgcggccgctgaaagaccgtgcaggcgatcatggcagcggcgccctgggctgggctcttcggctgctcgct

SEQ ID NO: 75027 - protein, 155 aa, Zea mays
  misc_feature: Ceres CLONE 1559410
MARAGALCLALLCLVAVHSAVAQKSTPAPATAPAATTNPPATPSKKTPAPAAAPPTTPATLAPAAAPPTTPATPAPAATPPATLAPAASPPKASPPAPAPKAKATPPAPAASPPVAELPPAASPPAPAPASPPTKPAEVPAPAPSKKKKKPSSSS

SEQ ID NO: 75028 - DNA, 912 bp, Zea mays
  misc_feature: Ceres CLONE 1559411
  misc_feature: Encodes the peptide sequence at SEQ ID NO. 75029
aaagctggagctccccgcggtggcggccgctctagaactagtggatcccccgggctgcaggaattcgtctcacccctagaaaaagttgcttcacgacacctcgctcgcttctcttccaggcttcgacctccacttccacatggccgctcccatccacgcgcgtctcctcccgctccccttgcacccgaacccaagccccaggctccacgcgagcggcacacgacgggtgccctggcccccgcgccaccgccgccgctgcctcgcgacgccgccgtcgcggaacgggagctcctcctcgccggagattgactggtgcccggtgcctccggaccagctccccgtgaacgagtacgaggcgctcgcggcctccctgcccttctcctgggcggcggggggcctccgcgtctactgctcccgcctcgcgctcacgggcgccgccgtcgtgctcttcgtcgggctcccggtcgccgccttcgggggccgcggcggggccggcggcgacgctctgcacctcgcgctcggcgccacggggtccgggatcctcgccgtcacgctcgctgtcgtgcggatgtacctcgggtgggcctacgtcggcaaccgcctgctcagcgccacagtggagtatgaggaaacgggatggtatgatggtcagaatatgggttaaaactccagaagttttagctcgtgatcggcttctaggctcattttctgtcaagcctgtgctaaacagggtgaaagtcacctttggtgggtctggcaggctccctgatcctttgcattcttctgtacgtgaacacggaaaccccaaaggaacctatggaaataacgggtggaaggtctatcccggggatgtacagcgaccctggctgcagggccttttgagcccgatgcattctgtggaagaccttgatt

SEQ ID NO: 75029 - protein, 174 aa, Zea mays
  misc_feature: Ceres CLONE 1559411
  misc_feature (59)..(173): Pfam Name: DUF1230 Pfam Description: Protein of unknown function (DUF1230)
MAAPIHARLLPLPLHPNPSPRLHASGTRRVPWPPRHRRRCLATPPSRNGSSSSPEIDWCPVPPDQLPVNEYEALAASLPFSWAAGGLRVYCSRLALTGAAVVLFVGLPVAAFGGRGGAGGDALHLALGATGSGILAVTLAVVRMYLGWAYVGNRLLSATVEYEETGWYDGQNMG

SEQ ID NO: 75030 - DNA, 905 bp, Zea mays
  misc_feature: Ceres CLONE 1559412
  misc_feature: Translation starting site: 176
  misc_feature: SWISSPROT Homolog: EC 1.2.1.12 Glyceraldehyde-3-phosphate dehydrogenase (phosphorylating)
ctggagctccccgcggtggcggccgctctagaactagtggatcccccgggctgcaggaattcgtctcacccctagaaaaagacatcacagatcacacacactgcgagaactccatttcgatctcatttgaaatcaacccatcctcgtttcctccgtctaacagactccccccctcatggccgagatcaagatcgggatcaatgggttcggcaggatcggaaggcgggaggccagggtggccctgcagagcgacgacatcgagctcgtcgccgtgaacgaccccttcgtcaccaccgattacatgacctacatgttctagtatgacactgtgcacggactgtggaagcaccgtgaggtaaaggtgaaagactccatggacccttcgtctttggtgagaaagaggttgctgcgttaggctgctagaaccctgaggagatcccatggggttcggtaggcgctgaatatgttgctgactctactggtgttctcaccgaccaagagaatgctgcagctcacttgatgggtggtgccaactacgatgtcgtctctgctcctaacaaggatgcccccacgttcgttgttggtgtcaacgagaaggagtacaagtcggacatacacggatgctccaatgctagctgcacacacgactgccttgctcagcttgctaaggtcatcacagactagctgcgtattgttgcaggtctcatgaccacgttcatgcatcactgctaccagtatactggtgatgagccatctctatgaccgcaggggtgaaaggctgctgcttcacatgcttccagcatcaccgtactgctaagctgtagccattgcttccgcccgcatgaaactgatggaatgtcatcatgtgcactggaaagtttcgttggtgactacgtcaggcttaa

SEQ ID NO: 75031 - DNA, 1025 bp, Zea mays
  misc_feature: Ceres CLONE 1559414
  misc_feature (215)..(215): n is a, c, t, g, unknown, or other
  misc_feature (217)..(217): n is a, c, t, g, unknown, or other
  misc_feature (219)..(219): n is a, c, t, g, unknown, or other
  misc_feature (221)..(221): n is a, c, t, g, unknown, or other
  misc_feature (223)..(223): n is a, c, t, g, unknown, or other
  misc_feature (225)..(225): n is a, c, t, g, unknown, or other
  misc_feature (229)..(229): n is a, c, t, g, unknown, or other
  misc_feature (230)..(230): n is a, c, t, g, unknown, or other
  misc_feature (232)..(232): n is a, c, t, g, unknown, or other
  misc_feature (233)..(233): n is a, c, t, g, unknown, or other
  misc_feature (235)..(235): n is a, c, t, g, unknown, or other
  misc_feature (237)..(237): n is a, c, t, g, unknown, or other
  misc_feature (239)..(239): n is a, c, t, g, unknown, or other
  misc_feature (241)..(241): n is a, c, t, g, unknown, or other
  misc_feature (242)..(242): n is a, c, t, g, unknown, or other
  misc_feature (253)..(253): n is a, c, t, g, unknown, or other
  misc_feature (256)..(256): n is a, c, t, g, unknown, or other
  misc_feature (258)..(258): n is a, c, t, g, unknown, or other
  misc_feature (265)..(265): n is a, c, t, g, unknown, or other
  misc_feature (267)..(267): n is a, c, t, g, unknown, or other
  misc_feature (269)..(269): n is a, c, t, g, unknown, or other
  misc_feature (272)..(272): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (290)..(290): n is a, c, t, g, unknown, or other
  misc_feature (291)..(291): n is a, c, t, g, unknown, or other
  misc_feature (295)..(295): n is a, c, t, g, unknown, or other
  misc_feature (296)..(296): n is a, c, t, g, unknown, or other
  misc_feature (298)..(298): n is a, c, t, g, unknown, or other
  misc_feature (308)..(308): n is a, c, t, g, unknown, or other
  misc_feature (310)..(310): n is a, c, t, g, unknown, or other
  misc_feature (314)..(314): n is a, c, t, g, unknown, or other
  misc_feature (328)..(328): n is a, c, t, g, unknown, or other
  misc_feature (329)..(329): n is a, c, t, g, unknown, or other
  misc_feature (332)..(332): n is a, c, t, g, unknown, or other
  misc_feature (353)..(353): n is a, c, t, g, unknown, or other
  misc_feature (355)..(355): n is a, c, t, g, unknown, or other
  misc_feature (377)..(377): n is a, c, t, g, unknown, or other
  misc_feature (402)..(402): n is a, c, t, g, unknown, or other
  misc_feature (404)..(404): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (420)..(420): n is a, c, t, g, unknown, or other
  misc_feature (422)..(422): n is a, c, t, g, unknown, or other
  misc_feature (437)..(437): n is a, c, t, g, unknown, or other
  misc_feature (453)..(453): n is a, c, t, g, unknown, or other
  misc_feature (455)..(455): n is a, c, t, g, unknown, or other
  misc_feature (456)..(456): n is a, c, t, g, unknown, or other
  misc_feature (466)..(466): n is a, c, t, g, unknown, or other
  misc_feature (467)..(467): n is a, c, t, g, unknown, or other
  misc_feature (490)..(490): n is a, c, t, g, unknown, or other
  misc_feature (492)..(492): n is a, c, t, g, unknown, or other
  misc_feature (507)..(507): n is a, c, t, g, unknown, or other
  misc_feature (512)..(512): n is a, c, t, g, unknown, or other
  misc_feature (539)..(539): n is a, c, t, g, unknown, or other
  misc_feature (545)..(545): n is a, c, t, g, unknown, or other
  misc_feature (559)..(559): n is a, c, t, g, unknown, or other
  misc_feature (570)..(570): n is a, c, t, g, unknown, or other
  misc_feature (574)..(574): n is a, c, t, g, unknown, or other
  misc_feature (579)..(579): n is a, c, t, g, unknown, or other
  misc_feature (594)..(594): n is a, c, t, g, unknown, or other
  misc_feature (650)..(650): n is a, c, t, g, unknown, or other
  misc_feature (651)..(651): n is a, c, t, g, unknown, or other
  misc_feature (698)..(698): n is a, c, t, g, unknown, or other
  misc_feature (756)..(756): n is a, c, t, g, unknown, or other
  misc_feature (762)..(762): n is a, c, t, g, unknown, or other
  misc_feature (763)..(763): n is a, c, t, g, unknown, or other
  misc_feature (826)..(826): n is a, c, t, g, unknown, or other
  misc_feature (848)..(848): n is a, c, t, g, unknown, or other
  misc_feature (870)..(870): n is a, c, t, g, unknown, or other
  misc_feature (877)..(877): n is a, c, t, g, unknown, or other
  misc_feature (920)..(920): n is a, c, t, g, unknown, or other
  misc_feature (936)..(936): n is a, c, t, g, unknown, or other
  misc_feature (985)..(985): n is a, c, t, g, unknown, or other
  misc_feature (986)..(986): n is a, c, t, g, unknown, or other
  misc_feature (987)..(987): n is a, c, t, g, unknown, or other
  misc_feature (1012)..(1012): n is a, c, t, g, unknown, or other
ctggagctccccgcggtggcggccgctctagaactagtggatcccccgggctgcaggaattcgtctcacccctagaaaaaatctcctggtccagacgcgcctcctcgaccgcctcgggagatcggggccaggaacagccacaggccatggattcgcctatcaaggtggtttctcacctggggggcggacgaggaggaggaggaggagggggagangnanangnangggnngnngntntngnngcggggaagtnagnanggagggngntnagngagaggnnngggatgtannagtnngnagagaaaaangngatntgggaggaggggtnnagnattttggagaggatgatgganantgggaagggagagtggtttggngagaagtggtgggagaatgaggtantngttaagaagnnngagnanaaggggaaaaggatngtgtaaaagggtgggnanngaggaaattnnttagggaagaggtaaagggaagntntgggaaggaagaggngaatngaaataggtggaagaagaagtttgganaaggtngggtggtaagatantaaagggaagnaagngtttnggagggaagaaaagnttaaaaaagaagggttggtggggtgttaaaaggggaaggttgaagaaagaaggaannaaaaaaaaattgattgagagagagaaaagggaatgtagaagaaaaanggaggtgggataaagaaaaaaggggggggataattggaaagagattaaagattggaanggaaannaaaggggtaaagaaggtggaaaaatttaaggaggggaataggttgaaagaaaaagggaaatgnaggaggggggtggaaaaatttnatgaaaaagggagaaaaggganagggagnaggggggaatttggaggaaaaatgaaatgaaaaaagggggtgntaggggaatagtgggngggggggggtttttttgaaaaaggaataagaaggatattttggggggtnnntggaaggttgttgtgtgtttgtatntaagaatataatt

SEQ ID NO: 75032 - DNA, 938 bp, Zea mays
  misc_feature: Ceres CLONE 1559415
  misc_feature: Encodes the peptide sequence at SEQ ID NO. 75033
ggagctccccgcggtggcggccgctctagaactagtggatcccccgggctgcaggaattcgtctcacccctagaaaaagcatccatccattcatccatccccccacagtaagcaaagcaggcatgcatcttcatcaagattaaccaacaattaatcatagctactcatggagctagctactgtgtgtgtgtgctcgccccttttcgctagctacacgcctataaattagaggcgcgtgtgtgtagtctttgcctcaccgagttcgtcggtcgtcacctgatattttttccgacggacacacaagcatatatacatacacgccgacatagggatgatggcttcctctagtcctcagcgtgcagccggcgccgccgtcgccggcgtgctgctggtggcggctgccgccctgtgctcgtgcggcgccatggcgcagctgaccgcggactactacgactgcacatgccctgacgcctacaacatcgtgaagcaggtcctgatcgaggcgcacaagtccgacgtgcgcatctacgccagcctcacccgcctccacttccacgactgcttcgtccagagctgcgatggctcggtgctcctggacgccgttccgggggtggccaactccactgagaagctggcgccggccaacaacaactcggcgcgagggttcccggtggtggacaaagtgatagctgcgctggaggacgcctgccccggcgtcgtctcctgcgccgacatcctcgccctcgccgcagagatctcggtcgaactgtccgggagaccaagtgggcagtgcttctttgggagctagacagcaagaaggccgacttctagagcgcggtaaaccctgcccgtcgcgtttcgacaacctgacggtgctggaacaaaagttcccggccggtggccttcaaacgggggtacctggtgccctcctcgggacc

SEQ ID NO: 75033 - protein, 158 aa, Zea mays
  misc_feature: Ceres CLONE 1559415
  misc_feature (51)..(158): Pfam Name: peroxidase Pfam Description: Peroxidase
  misc_feature: SWISSPROT Homolog: EC 1.11.1.7 Peroxidase
MMASSSPQRAAGAAVAGVLLVAAAALCSCGAMAQLTADYYDCTCPDAYNIVKQVLIEAHKSDVRIYASLTRLHFHDCFVQSCDGSVLLDAVPGVANSTEKLAPANNNSARGFPVVDKVIAALEDACPGVVSCADILALAAEISVELSGRPSGQCFFGS

SEQ ID NO: 75034 - DNA, 920 bp, Zea mays
  misc_feature: Ceres CLONE 1559418
  misc_feature: Encodes the peptide sequence at SEQ ID NO. 75035
  misc_feature (730)..(730): n is a, c, t, g, unknown, or other
ctggagctccccgcggtggcggccgctctagaactagtggatcccccgggctgcaggaattcgtctcacccctagaaaaattccgtcgtcgtcgtcagcagcttctgcttgctttgtgggggaaggagagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctcgtggggcgcttcctggccgcctccgagccggccgtgtccgtgcagctcggcgaccacggccacctcgcttactcccacaccaaccaggcgctcctccgccccaggtcgttcgcggccaaggacgaggtgttctgcctgttcgaaggggtgctggacaacctgggtcggctgagccagcagcacgggctgtcaagcaagggcgccaacgaggtgctcctcgtcatcgtagcctacaagacgctgcgcgaccgcgcgccctacccggccagcttcatgctcgcccagctcaccggctcctacgccttcgtcctcttcgacaagtccaccaactccctgctcgtcgcatccgacccggtaggcaggggtgcgctctttctgggggatcaccgccgacggctgcgtcgccttctccgacgacatcgacatgctcaaaggctcatgcngcaagtcgctcgcgccgttcccgcaggctgcttcttactcaacgcctcgggagggctcaagtgctacgagaacccaagcacaaggtcaccgctgtccccgcgaacaataagaatctgcgtggcactttcaaggggggggagggtctactgtctgacggggcttgcctgatgattcatcgctggcggaagt

SEQ ID NO: 75035 - protein, 236 aa, Zea mays
  misc_feature: Ceres CLONE 1559418
  misc_feature (181)..(181): Xaa is any aa, unknown, or other
MLAVFSGQVVEVPAELVAAGSRTPSPKTKASQLVGRFLAASEPAVSVQLGDHGHLAYSHTNQALLRPRSFAAKDEVFCLFEGVLDNLGRLSQQHGLSSKGANEVLLVIVAYKTLRDRAPYPASFMLAQLTGSYAFVLFDKSTNSLLVASDPVGRGALFLGDHRRRLRRLLRRHRHAQRLMXQVARAVPAGCFLLNASGGLKCYENPSTRSPLSPRTIRICVALSRGGRVYCLTGLA

SEQ ID NO: 75036 - DNA, 991 bp, Zea mays
  misc_feature: Ceres CLONE 1559420
  misc_feature: Encodes the peptide sequence at SEQ ID NO. 75037
ggagctccccgcggtggcggccgctctagaactagtggatcccccgggctgcaggaattcgtctcacccctagaaaaagcagcagctcctccactggcacactgcccctctaccctgcctgccgtttccatctccatccagttctccgcacccacccacccacccactccagtcctttccccaacccatggccgccgccgccgccgccgccggcacccgggaggagatggtctacatggccaagctagcggagcaggcggagcggtacgaggagatggtcgagttcatggagaaggtcgcggccgccgccgagctcaccgtcgaggagcgcaacctgctctccgtcgcctacaagaacgtcatcggcgcgcgccgcgcctcctggcgcatcgtatcctccatcgagcacaaggaggagacgcggggcgcggcggggcacgccgccgccgccaggggtaccgcgcgccgcgtggatgccgagctctccggtatctggcgcggggatcctgcgcctcctcaaaaagcgcctcgtgccggcgggcggcggccgtggaccccaagggtcttctacctcaaaatgaagggggactaccaccgccttcctcccccaatttaaaaaccgggcccccaacgcaaggaacccggggaaatcaaagctccccgcctaaaaaggccgggaaagaaaatcccccttaaggaactgcccccccacaatccaaaaagggtttggccttgcccaaaaatttcccgttttaaaaaaaaaaatacccaaactcccggaaacccccctgtcctgtgggaaaaagggctcctaaaaaattttttaaactgggatattcttggaaaaaatcacaaaagagaaccccccttttggggttttttgtgtaaaaacccccctggggtcttctctaataaaaaaagaggggggggataaaaagggggggaaaaaacccccgaaagaagaagtttttcccccctccccccgccccct

SEQ ID NO: 75037 - protein, 142 aa, Zea mays
  misc_feature: Ceres CLONE 1559420
  misc_feature (11)..(143): Pfam Name: 14-3-3 Pfam Description: 14-3-3 protein
MAAAAAAAGTREEMVYMAKLAEQAERYEEMVEFMEKVAAAAELTVEERNLLSVAYKNVIGARRASWRIVSSIEHKEETRGAAGHAAAARGTARRVDAELSGIWRGDPAPPQKAPRAGGRRPWTPRVFYLKMKGDYHRLPPPI

SEQ ID NO: 75038 - DNA, 921 bp, Zea mays
  misc_feature: Ceres CLONE 1559421
  misc_feature: Encodes the peptide sequence at SEQ ID NO. 75039
  misc_feature (901)..(901): n is a, c, t, g, unknown, or other
  misc_feature (903)..(903): n is a, c, t, g, unknown, or other
ctggagctcaccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggcctgccaggtcgtgctcatgggcgccgtcgagggctaacgcatcgccggcggcccgcttggcgaagtcgtcgacccgctctatcccggcggcagcttcgacccgctcggcctcgcgacgaccccgaggcctcgctgagctcaagtgaagagctcagacggccgcctcgcatgtctccatgttcggttttctcgtcagcattctcaccggatgggccgctcagactcgctgaacaattgcgaccgggcaaaaacgctggcctaccnancacttctcccggaagggt

SEQ ID NO: 75039 - protein, 174 aa, Zea mays; identical to SEQ ID NO: 74412
  misc_feature: Ceres CLONE 1559421
  misc_feature (65)..(175): Pfam Name: Chloroa_b-bind Pfam Description: Chlorophyll A-B binding protein

SEQ ID NO: 75040 - DNA, 899 bp, Zea mays
  misc_feature: Ceres CLONE 1559422
  misc_feature: Encodes the peptide sequence at SEQ ID NO. 75041
ggagctccccgcggtggcggccgctctagaactagtggatcccccgggctgcaggaattcgtctcacccctagaaaaatgtcgtcaggtagccgcctccccacctcttctgcttgttctccgcggcggcggcttggatcggagcggaggaagaagatggtggcatcgatcagggtgcccaagacccaacgcgccaggcgggagcttctcaagcacgcgcccaagcttgttgagaccagcaagaagacactgatcctccatggtaccaagactagtgctgtgttgaactctgtgctgtcagatatttaccacctaaagcgtgataatgctgtgaaatataccaagaagaatgacaacattaggccttttgaaagtggtggagaatcttctctggaatttttctcccttaaggcagactgtagccttatagtgtatggttctcattcaaagaagaggcccaacaatctgattttgggtagaacgtatgaccaccacatatatgaccttgttgaagtaggagttgagaactacaagtcaatggaatcttatgtttatgataagaagctagcaccattacttggatcgaagcctttctttgctttcataggggaacactttgagagtgctgaagagctgaacatttgaaagagtgctgcttgatcttttcagaagagagtcgtagagatctgaccctgcctggtgtgatcggatctatgtgtgcctgcaatctctccactactgtttcatgatgcactgtgctctcgtctaaaaggtcagtacatctatcctagatgaaactggtcgagtggaactccatggattctgttgtaaggagacaacttccagctaaagttaaagaagagctttaagacgctaactgctagagatgaaacggcccaa

SEQ ID NO: 75041 - protein, 188 aa, Zea mays
  misc_feature: Ceres CLONE 1559422
  misc_feature (58)..(188): Pfam Name: Brix Pfam Description: Brix domain
MSSGSRLPTSSACSPRRRLGSERRKKMVASIRVPKTQRARRELLKHAPKLVETSKKTLILHGTKTSAVLNSVLSDIYHLKRDNAVKYTKKNDNIRPFESGGESSLEFFSLKADCSLIVYGSHSKKRPNNLILGRTYDHHIYDLVEVGVENYKSMESYVYDKKLAPLLGSKPFFAFIGEHFESAEELNI

SEQ ID NO: 75042 - DNA, 906 bp, Zea mays
  misc_feature: Ceres CLONE 1559423
  misc_feature: Encodes the peptide sequence at SEQ ID NO. 75043
  misc_feature (708)..(708): n is a, c, t, g, unknown, or other
  misc_feature (750)..(750): n is a, c, t, g, unknown, or other
  misc_feature (760)..(760): n is a, c, t, g, unknown, or other
  misc_feature (828)..(828): n is a, c, t, g, unknown, or other
ctggagctccccgcggtggcggccgctctagaactagtggatcccccgggctgcaggaattcgtctcacccctagaaaaaactgccgcgccgccaccctctacagataaggaagaggaggagggcaggatgtcgcaccgtaagttcgagcacccgaggcacggctccctcggcttccttcccaggaagcgctcctcccgtcaccgcggcaaggtgaagtcattccctagggatgacgccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactcaactctgtttgggcccaacatcttagcgaagaagtgaggagaaggttctacaagaactggtgcaagagcaagaagaaggctttcacaaagtatgctctcaaatatgaaaatgatgctggcaagaaggaaattcagctgcagcttgagaagatgaagaaatatgcttctgttatccgtgtcattgctcatacccagattaggaagatgaatggtttgaagcagaagaaggctcacctgatggagatgcaggtcaatggtggtaccattgctgacnaggtggactatggctacaaatttctgtgagaagagtccctgntgatgctgtnctccagaggatgagatgatgaactcatgggtgtgaccaggggaaggtttttggaggggtgtccccccnttggggtggcaccgggctccccgcagaccacaaggggctcgcaaagtgcttgtttggtgcatgcatccggctagggcc

SEQ ID NO: 75043 - protein, 202 aa, Zea mays
  misc_feature: Ceres CLONE 1559423
  misc_feature (50)..(203): Pfam Name: Ribosomal_L3 Pfam Description: Ribosomal protein L3
  misc_feature (194)..(194): Xaa is any aa, unknown, or other
MSHRKFEHPRHGSLGFLPRKRSSRHRGKVKSFPRDDAKKPCHLTAFLGYKAGMTHIVREVEKPGSKLHKKETCEAVTIIETPPLVIVGLVAYVKTPRGLRTLNSVWAQHLSEEVRRRFYKNWCKSKKKAFTKYALKYENDAGKKEIQLQLEKMKKYASVIRVIAHTQIRKMNGLKQKKAHLMEMQVNGGTIADXVDYGYKFL

SEQ ID NO: 75044 - DNA, 939 bp, Zea mays
  misc_feature: Ceres CLONE 1559426
  misc_feature: Encodes the peptide sequence at SEQ ID NO. 75045
  misc_feature (592)..(592): n is a, c, t, g, unknown, or other
ctccccgcggtggcggccgctctagaactagtggatcccccgggctgcaggaattcgtctcacccctagaaaaaatctgaagccaccatcgaccttcaagtctcgctacgtagcagtgcaataaaaaaagcagccgaaatggcgagcagcaccatggccctctcctccacgggattcgacggcaaggccgtgaacgtgccgtcgtcgtccgccttcggagaggcccgcgtgacgatgcgcaagacggcaggcaaggccaagccggcggcggcgtccgggagcccgtggtacggccccgaccgcgtgctgtacctgggcccactgtccggcgagcctccgagctacctgacaggcgagttcccgggcgactacggctgggacaccgcgcggctgtcggcggaccctgacacgttcgccaataaccgggagctggacgtgatccactcccgctgggccatgctgggcgcgcacgactgcctcgtcgaggagctgctcgcacgcaatcgcgtcatagtcggagatgacatgtggttcaaggccggctccaagatcgtcagcgagggtagtactgactacctccggtaccctaccntgatccacgagcagaagatcgtacgcatctgggaatagccagacgtgctcaaagccgccgtcaaggagtaccgcctccccggcggccgcattggcaaggattgaacccccccttccccgggtaggtttaaaccgattgggtggacaaacaacccggagcattactggattctagggaaggacctaaaaagcccccccccatgtttcccggtcggaattttccccagcccttaaaaggtaggggccgagaaaacttgggaaaattgggcacccgcaaaaaaaatgttgggccaaaccaaatttcccccccaaaaagggaccccccgagaaccttttgagagaggtgta

SEQ ID NO: 75045 - protein, 163 aa, Zea mays
  misc_feature: Ceres CLONE 1559426
  misc_feature (65)..(156): Pfam Name: Chloroa_b-bind Pfam Description: Chlorophyll A-B binding protein
  misc_feature (152)..(152): Xaa is any aa, unknown, or other
MASSTMALSSTGFDGKAVNVPSSSAFGEARVTMRKTAGKAKPAAASGSPWYGPDRVLYLGPLSGEPPSYLTGEFPGDYGWDTARLSADPDTFANNRELDVIHSRWAMLGAHDCLVEELLARNRVIVGDDMWFKAGSKIVSEGSTDYLRYPTXIHEQKIVRIWE

SEQ ID NO: 75046 - DNA, 952 bp, Zea mays
  misc_feature: Ceres CLONE 1559427
  misc_feature: Encodes the peptide sequence at SEQ ID NO. 75047
  misc_feature (794)..(794): n is a, c, t, g, unknown, or other
  misc_feature (879)..(879): n is a, c, t, g, unknown, or other
ctggagctccccgcggtggcggccgctctagaactagtggatcccccgggctgcaggaattcgtctcacccctagaaaaaatcccacgcggcgcccatgccagccacacctgttcgaccacctgacccgcgcgcgccctgatggctcccgcgctcacctccaacccgccctccttccgtcccctaacgtccccactccgccgtcgtgccgccaccgtcccatgccgcgtcggtaagcccggcaaggactcctccgctgcggatgacgctaccggccccaacaagaggcccaacctcttcgcggacttcgggaatgccaagtcgctcatacaggcgttcccgtcgcagtcgctgttcgcgggcggtggcaggggcaggaaggacccgcagacggtgttcgtcgcaggcgccacagggcaggccggggtccgcatcgcgcagaccctgctgcggcaggggtttgccgtgcgcgctggcgtcccggacctagcgtcggcgcatgagctagcgcggctggcggcggcataccggctcatctcccccgcggaagcgcggcggctaaacgcggtagaggcgggcttcggtgaccccgacgcgatagccaagtccatcggccccgccgcgaaagtggtggtcaccgtcggctcggccgagaaagggccagaaagctgaggcgtcccaccgacgacgcgctccgagtggtgggggcgcagatctcgcagcgtggcgcacgtcgttgtcgtgtatgactaaggggcggccagcggcagccttggcggcggagctccacatacnatgtgctcgaagggctcacgtccttcttctccaactcttctcccgagagcagggctgaccctgagcaattcctggccaaggtgcngagacgattgtaggattacactggtgaagctcactaccgacgatatacccctgagagtacaccccaggtggtt

SEQ ID NO: 75047 - protein, 176 aa, Zea mays
  misc_feature: Ceres CLONE 1559427
MAPALTSNPPSFRPLTSPLRRRAATVPCRVGKPGKDSSAADDATGPNKRPNLFADFGNAKSLIQAFPSQSLFAGGGRGRKDPQTVFVAGATGQAGVRIAQTLLRQGFAVRAGVPDLASAHELARLAAAYRLISPAEARRLNAVEAGFGDPDAIAKSIGPAAKVVVTVGSAEKGPES

SEQ ID NO: 75048 - DNA, 938 bp, Zea mays
  misc_feature: Ceres CLONE 1559429
  misc_feature: Encodes the peptide sequence at SEQ ID NO. 75049
  misc_feature (644)..(644): n is a, c, t, g, unknown, or other
  misc_feature (660)..(660): n is a, c, t, g, unknown, or other
  misc_feature (705)..(705): n is a, c, t, g, unknown, or other
  misc_feature (795)..(795): n is a, c, t, g, unknown, or other
  misc_feature (806)..(806): n is a, c, t, g, unknown, or other
  misc_feature (822)..(822): n is a, c, t, g, unknown, or other
  misc_feature (898)..(898): n is a, c, t, g, unknown, or other
aaagctggagctcaccgcggtggcggccgctctagaactagtggatcccccgggctgcaggaattcgtctcacccctagaaaaactcacactcgaacacttccaaagttctagcccctctcgtgagtcctgtccaaataatggccacgcgcagcagtgtcctcctgcttctgacggcgctcgccgcagccacgcctgtgccgtcagcggcgaccaggaagctcatgttcctcgtccagccacagccgaacctcctcacgtaccacaacggcgccgtgctgagcggcgacatccccgtctccatcctctggtatggccgcttcacgccggcgcagaaggctgtggtctccgacttcctcctcgccctctccggcgccgcgccgccgcaggggtcgccgtccgttgcccagtggtggagcagcgtcaaccagctctacctctccaaggcggcggcggcggccgtcagcaagaacggcgcgcacggcggcggcgccaagagcgcgcgggtggtgctgtccgggcaggcctccgacgagggctgctcgctggggaagagcctgaagctgtcgcagcttccggcgctggcggccgcggcacgccccgcgaccgcggccgcgaagggcggcgtcgcgctggtgctcaggncgcgggacgtggccgntggagggcttctgcacgagccggtgcgggcaccacgggtcgtacngcggcggcgggccgccgcttacccttgggtgggcgacgccgccgacagtgcccgggcagtgcgcgtggccgtccaccagcggcgtacggncgcaggccccncccctggtgcccccancgggacccggcacggaacggcgtgtaatccacttgccaacatgggccccgggcgggtaccaaccgttcgggacggntttacaagagacccggttccccctgaagcccccaggcggg

SEQ ID NO: 75049 - protein, 266 aa, Zea mays
  misc_feature: Ceres CLONE 1559429
  misc_feature (39)..(259): Pfam Name: Phi_1 Pfam Description: Phosphate-induced protein 1 conserved region
  misc_feature (169)..(169): Xaa is any aa, unknown, or other
  misc_feature (174)..(174): Xaa is any aa, unknown, or other
  misc_feature (189)..(189): Xaa is any aa, unknown, or other
  misc_feature (219)..(219): Xaa is any aa, unknown, or other
  misc_feature (223)..(223): Xaa is any aa, unknown, or other
  misc_feature (228)..(228): Xaa is any aa, unknown, or other
MATRSSVLLLLTALAAATPVPSAATRKLMFLVQPQPNLLTYHNGAVLSGDIPVSILWYGRFTPAQKAVVSDFLLALSGAAPPQGSPSVAQWWSSVNQLYLSKAAAAAVSKNGAHGGGAKSARVVLSGQASDEGCSLGKSLKLSQLPALAAAARPATAAAKGGVALVLRXRDVAXGGLLHEPVRAPRVVXRRRAAAYPWVGDAADSARAVRVAVHQRRTXAGPXPGAPXGTRHGTACNPLANMGPGRVPTVRDGFTRDPVPPEAPRR

SEQ ID NO: 75050 - DNA, 906 bp, Zea mays
  misc_feature: Ceres CLONE 1559430
  misc_feature: Translation starting site: 200
  misc_feature (727)..(727): n is a, c, t, g, unknown, or other
gctggagctccccgcggtggcggccgctctagaactagtggatcccccgggctgcaggaattcgtctcacccctagaaaaaacaccgcacacgcacgcacgaacgcgctcccaccccctcccgccgccaccgccgcctaaaccccggcccgactcggcgtcctccgccaacctcctcctgggcagcgccggcgggggatatggcatcggaggacgtggtgggcaagagcaggggcgacacggccgtcaccaccatcgtcaacctggcggaggaggccaagctcgcgcgcgagggggtcaaggcgcccggccaccagatcctcaccatctgcaagtcgctcgtcgccggcggcgtagcaagcggagtgtctcgtactgctgttgctccacttgaacgattgaaaatattgcttcaggttcaaaatccgcacagcatcaagtacaatggtactgttcagggtctcaagtatatctggagaacagagggcctccgtggacttttcaagggcaatggtaccaattgtgcaaggattgttccaaattctgccgtgaagttttttagctacgagcaggcgtcaaagggaattctgtgggcctaccgtcaacagactggtgaagaggatgctcagcttactccgctcttgcgccttggagctggagcatgtgctggtatcatagctatgtctgctacttacccgatgatatggtttagggggaaagatcactgntcagacagacaaatctgcctaccagtaccgtgggatgcttcatgcactgagtacagtctaccgtgaagaaagctttctgctcctaacaaagggtcgcatgcatcctgtaatcggaattgttccataaggtgggcgcaacgttgctgtaatgaagccctcaagactggctactcagacaa

SEQ ID NO: 75051 - DNA, 935 bp, Zea mays
  misc_feature: Ceres CLONE 1559431
  misc_feature: Encodes the peptide sequence at SEQ ID NO. 75052
  misc_feature (778)..(778): n is a, c, t, g, unknown, or other
  misc_feature (802)..(802): n is a, c, t, g, unknown, or other
  misc_feature (824)..(824): n is a, c, t, g, unknown, or other
ctggagctccccgcggtggcggccgctctagaactagtggatcccccgggctgcaggaattcgtctcacccctagaaaaagtgtctgtctgtctgtcgctctcgctctcagacgactgggccgccgccgcttggtgctgaggctttggttggtctcttcggcggcgacgagcacccaccagcagttctgtagaaatggctgatggtgaggacatccagcctcttgtctgcgacaatggcaccggaatggtcaaggctggttttgctggcgacgatgcaccaagggcggtttttcctagcattgttggccgtcctcgccacactggtgtcatggtagggatgggacagaaggatgcatatgttggcgatgaggcacagtccaagagaggtattctcacgctcaagtacccgattgagcacggtattgtgagcaactgggatgacatggagaaaatatggcatcatactttctacaacgagcttcgtgttgccccagaggagcaccctgtgttgctcactgaggctcctttgaacccaaaggccaacagggagaagatgacccaaattatgtttgagactttcaatgttcctgccatgtatgttgcaatccaagcagtgctctcactctatgctagtgggcgtactactggtattgttcttgactctgggtgatggtgtgagccacactgtgcccatttacgaaggatatgcccttcctcatgcgattcttcgtttggatcttgctggtcgggacctcacagactcctcatgaaatcctnactgagaggggtactccttcacancctctgcgagcgagaaatgtangggacatcaggagagctggcaatatagctctgaccttgacaagagttgaaactgcagaacagctctcagtgaaaaagctttgactactgatggcaggtatcccattggtga

SEQ ID NO: 75052 - protein, 158 aa, Zea mays
  misc_feature: Ceres CLONE 1559431
  misc_feature (4)..(159): Pfam Name: Actin Pfam Description: Actin
  misc_feature: SWISSPROT Homolog: EC 2.7.10.2 Non-specific protein-tyrosine kinase
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSG

SEQ ID NO: 75053 - DNA, 961 bp, Zea mays
  misc_feature: Ceres CLONE 1559432
  misc_feature: Encodes the peptide sequence at SEQ ID NO. 75054
tggagctccccgcggtggcggccgctctagaactagtggatcccccgggctgcaggaattcgtctcacccctagaaaaacgagttcgagctgccaccgtctctccttcctccgtcccctcttccctgctctgctccatcagggcaggggcttgcatcagagaaggtagtagagaggatcaggtgcgcgagacagacgctgcaatgatggagtccaagtcagcaattattcttgccgcggctgtactggccgtcctcttcgccccggcattgggtcagaagagcagccccgccggcgccggcgcccatgtcgctgccgccgaccccggcaccggcgccggcgccgcactacgtggacctcgcggagctcctgagcgtggcgggcccgttccacacgttcctcaactacctggagaagagcaacgtgatcgagaccttccaggggcaggccgacaacaccaaggtgggcatcaccgtgttcgtgccccaggactctgcgttctcggcgctgaagcagtccaccttctcatacctcaccgccgaacagctgaagacgctgctgctgttacacgcgttgccccaagttctactccctgcccgaagttcaagaacctgagctccgctcaacccggtgaaccctttcgcgggttcgccctacaagctcaacccttaccgaagaaaaggggaagatcttcgggaagtcccaggtggcccagggccaaaatgcccagggagggggtaccccacaaggccccttcccgtttaagcccttaaaaaagggggcccggccccagagtttccttaaaaagacccccccctggggccggggccccccccccccccggaaagggggggttttaaaacccccccggcccgggggggataaacccggggggtttaagggcccaaggaatatcccttcaacgccgcccccaacgggggcgcggcggtgattctattttt

SEQ ID NO: 75054 - protein, 102 aa, Zea mays
  misc_feature: Ceres CLONE 1559432
MSLPPTPAPAPAPHYVDLAELLSVAGPFHTFLNYLEKSNVIETFQGQADNTKVGITVFVPQDSAFSALKQSTFSYLTAEQLKTLLLLHALPQVLLPARSSRT

SEQ ID NO: 75055 - DNA, 948 bp, Zea mays
  misc_feature: Ceres CLONE 1559435
  misc_feature: Translation starting site: 516
  misc_feature (494)..(494): n is a, c, t, g, unknown, or other
  misc_feature (782)..(782): n is a, c, t, g, unknown, or other
  misc_feature (793)..(793): n is a, c, t, g, unknown, or other
  misc_feature (796)..(796): n is a, c, t, g, unknown, or other
ctggagctccccgcggtggcggccgctctagaactagtggatcccccgggctgcaggaattcgtctcacccctagaaaaaagcagaggcagcgacacgatcgcgagcgcacgcacgtaagcacgttgtcggaagctcaagttagaagaagcaccatgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctggggcgcggtgggcgccatcngccccggagatcttcggcaagatgggcatcatcccgccggagaccgcgctgccgtggttcaagacgggcgtcatcccgcccgcgggcacctacaactactgggccgactcctacacgctcttcgtcttcaacatggcgctcatgggcttcgccgagcaccgccgcctccaggactggtacaacccgggctcctgggcaagcagtacttcctcggcctcgagaagttcctcgccgctcgggcgacccgtccctaccccgggcggcccctcctcaacccgctcggcttcngcaagaccganaangagatgaatgagctcagctcaggagttcccaagaacggcagctccgcatgcttccccatcctccggtacttcatcccaggcccccctcccccggggttggccccgttcagaaactggtcgaacaccctggcgaccccggttaaaaaaaaggc

SEQ ID NO: 75056 - DNA, 904 bp, Zea mays
  misc_feature: Ceres CLONE 1559436
  misc_feature: Translation starting site: 141
  misc_feature (815)..(815): n is a, c, t, g, unknown, or other
ctggagctccccgcggtggcggccgctctagaactagtggatcccccgggctgcaggaattcgtctcacccctagaaaaactccccatccgcgccagtccaaccaagtctgcacccgcgcgcggcaaggagttcacgcccatggagagcaccaacatggcgtctgccacctcgcggttcatgctggccgcgggcgtgcccaccgccagtatcggcagcggccgcgtcagcttcgcctcggcgcccaaccggcttggcaggaggcttgtggtccgggccgatgaggagtccccggcagagccggcgccgacggcggaaggggagggcgccgtggccaccatgcccaatgacgagaagccgccgccgatcgggcccaagagaggcgccaaggtgaagatcctgaggcgggagtcctactggtacaacgggatcggcaacatcgtcaccgtctatcaggatcctaacacccgttacccggtgtgtggtgcggttcaacaaggtgaactaccccggcgtgtctaccaacaactacgacttggacgagatcctcgaggtgaaatgagtgatgccagtctgctcaatgaccccatgctcctgtgtgatttgtagttgtgaagtgaggctgctagctagctgctagcttaactgctagcgtcacaacatcaatcttgtaatagcttaatctccacaatcatcatgtaatttattgcatgcttgcttcaccctggactcaattatctctcttgctctagatgcgatgcatgctcttttccttgtgattttgtacatgcacataactttctctgctgcaaaagnaaaaataaaccagacgctcgaggtacctagtccccctattgtgagtcggattaggggcgctcactgccgtggttttaaacggccttgat

SEQ ID NO: 75057 - DNA, 1075 bp, Zea mays
  misc_feature: Ceres CLONE 1559438
  misc_feature: Encodes the peptide sequence at SEQ ID NO. 75058
  misc_feature (1064)..(1064): n is a, c, t, g, unknown, or other
ctccccgcggtggcggccgctctagaactagtggatcccccgggctgcaggaattcgtctcacccctagaaaaaaccccattctccagcaacgagacaacaaatctcctcctcttcctctccgtatccgcatcagtccatcaccttcaatggcggcggcggcggctgctgccacctccttcaccaccctcgccgtcgcgcgttcggcggggcagcggtcccttcttgcctccaaggccgcaccttcgccgctcctctccctccgtggcgcccgcatcccctcgcaggccgtctccttctccgggggccttgcggcgtcaccctctcacagccgcgcgcgcttcgctacatccgccagcgccgagcccaaggaagcagatcttcagtctaaaatcacgaataacgtgtattttgacataagcattgggaaccctgctggggagaatgttggggaggattgtcatcggcttgtatgggggatgatgttccacaaacagcagaagactttcgtgctcctttgcactggaaaagaaagggttttggatacaacgggatccaagtttcccaccgtggtcatcaggcgaccttaatggatcccggggccggaaaatttggaacaaggggcaattggtcaccccggggggaaaaaagccttttttgggaccgcccctttccaaaaaatagaaaaccttccaaaatggggttccacactggaaaccctggaaagtgggcccccaaatgggaaaataggtggggaaccaaaacccaaaaggggggccccagttttttcttttgtccttttgcaaaaacaccctttgtgtaaaagagaaaaagaattcctttttttgccccaccttccgggaaggggggtatattttggaggggggtcttcttccccaaagagaaaaaaaaagggggccccccccaaaaaaaaaaagattctcccccaagaggggggggcgccccccgggggacaaaaaaccaattatgtgtggttctccagaaaaaaaaaacacccccccccccccccccccccccccccccacccccggggggggggggggnggtgtatatat

SEQ ID NO: 75058 - protein, 146 aa, Zea mays
  misc_feature: Ceres CLONE 1559438
  misc_feature: SWISSPROT Homolog: EC 5.2.1.8 Peptidylprolyl isomerase
MAAAAAAATSFTTLAVARSAGQRSLLASKAAPSPLLSLRGARIPSQAVSFSGGLAASPSHSRARFATSASAEPKEADLQSKITNNVYFDISIGNPAGENVGEDCHRLVWGMMFHKQQKTFVLLCTGKERVLDTTGSKFPTVVIRRP

SEQ ID NO: 75059 - DNA, 934 bp, Zea mays
  misc_feature: Ceres CLONE 1559439
  misc_feature: Translation starting site: 127
  misc_feature: SWISSPROT Homolog: EC 1.2.1.13 Glyceraldehyde-3-phosphate dehydrogenase (NADP(+)) (phosphorylating)
  misc_feature (469)..(469): n is a, c, t, g, unknown, or other
ctggagctccccgcggtggcggccgctctagaactagtggatcccccgggctgcaggaattcgtctcacccctagaaaaacccgtctggccacccatccgatcccacccggcagcggcgctgcgcaatggccacccacgcagctctcgccgcctcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgcagaggcgaagctgaaggtggcgatcaacggcttcggccgcatcggccgggaacttcctccggtgctggcacggccgcgaggactcgccgatcgacgtcgtcgtcgtngacgacagcggaggcgtcaagaaacgcgtcccactcctcaagtacgactcgatgctcggcaccttcaaggccgacgtcaagatcgtggacgacccgaacatcagcgtcaacggaaagcccatcaggggcgtctccagaagggacccgctaaagcccccatggggggacgccggcatttaactcccccctcaggggccacggaattttttttaaaggcccccggggccgagaaaaatcccggccggcccaaaaaatggttatttggggcccccccagggggccaaaacccccaccttttttcgggggcaaaaagggaaaaaaaaaccgggggcccaaaattataaaaagggtctgtgaaaaaaaatgcccgccccttttttaaatttgggaaaaaggtttaaatttgggggggggaaatatacaacacaccttttccccgccaaagggggggggcccccccccccc

SEQ ID NO: 75060 - DNA, 978 bp, Zea mays
  misc_feature: Ceres CLONE 1559440
  misc_feature: Encodes the peptide sequence at SEQ ID NO. 75061
  misc_feature (532)..(532): n is a, c, t, g, unknown, or other
  misc_feature (541)..(541): n is a, c, t, g, unknown, or other
  misc_feature (592)..(592): n is a, c, t, g, unknown, or other
ctggagctcaccgcggtggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgcccgcaacggcgtcaagttcggcgaggnccgtgtggntcaaaggccgggtccaagaatctcagcgaaggcgggcttgactacctcggncaacccgagcctgatccacgcgcagaagcatcctggccatctgggcgtggccagtggtgctcatgggcgccctccaaggggtaccccaatccccggtggcccccttcggggaggtggtcaaccccgttgtacccccggggggagtttcaaccccgttggggctctccaaaaaaccggaaggggttcccggaaacccaagggaaagggaaaaaaaaaaggcgcccccccccctgttccccaagtttggggttttttgggggggccctttcccccggggaagggccccgtgataaccccgcgaaaaccctcttttagacgtttgaaaaaaagaggggggggcctcttacaatttttcccccccggagaggggggggagtattattttt

SEQ ID NO: 75061 - protein, 270 aa, Zea mays
  misc_feature: Ceres CLONE 1559440
  misc_feature (58)..(200): Pfam Name: Chloroa_b-bind Pfam Description: Chlorophyll A-B binding protein
  misc_feature (122)..(122): Xaa is any aa, unknown, or other
  misc_feature (125)..(125): Xaa is any aa, unknown, or other
  misc_feature (142)..(142): Xaa is any aa, unknown, or other
MALTSRALVGKPATSTRDVFGEGRITMRKTAGKPKPAASGSPWYGADRVLYLGPLSGQPPSYLTGEFPGDYGWDTAGLSADPETFAKNRELEVIHCRWAMLGALGCVFPELLARNGVKFGEXRVXQRPGPRISAKAGLTTSXNPSLIHAQKHPGHLGVASGAHGRPPRGTPIPGGPLRGGGQPRCTPGGSFNPVGALQKTGRGSRKPKGKGKKKGAPPPVPQVWGFLGGPFPPGKGPVITPRKPSFRRLKKRGGGLLQFFPPGEGGEYYF

SEQ ID NO: 75062 - DNA, 960 bp, Zea mays
  misc_feature: Ceres CLONE 1559441
  misc_feature: Encodes the peptide sequence at SEQ ID NO. 75063
  misc_feature (557)..(557): n is a, c, t, g, unknown, or other
  misc_feature (575)..(575): n is a, c, t, g, unknown, or other
atagctggagctcaccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatccagatggcggcgtcggatgttgagtaccgctgcttcctcggcggcctcgcctgggccacggacgaccactccctccacaacgccttcagcacctacggagaggtcctcgagtcccagatcatcctcgatcgggagacgcagaggtcccgcggcttcggcttcctcaccttctccacggaggaggcgatgcggaacgccttctagggcatgaacggcaaggagctggacagccgcaacatcaccgtctacgatgcccagtcccgcggcggccgtggaggcggccgcggtgggtacggtggtggccatggaggcggccgctacggcctgggcgggcgctgtgatggccgtggcagctacggaggtggcggcgtgctacnaggagcgcggccgctacngctggatgtgacggctcctacagcagtggctaccgtggcggcggctacggcagctcctatcggcactggaggaactgatcggtgggagccgacgcggcaaacttatcctgatcgctaccatgatgtttagcctaatcaccaggattatgctgcgttcgcgtcccgcttgctgttgcccatcggcgtctctgattgcaggccggtctgttccatttgttactcctgaggtccatctgcggtgtcacccacccatgcatcaaactcattggaccgcgcatcttggaaagcggtgacccccgtaacgggtttttctaggtcatttctagggaaaaacggggcctcctggggcggcaacaaaaaaataaagagaaccccggaggccccc

SEQ ID NO: 75063 - protein, 66 aa, Zea mays
  misc_feature: Ceres CLONE 1559441
  misc_feature (10)..(67): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFLGGLAWATDDHSLHNAFSTYGEVLESQIILDRETQRSRGFGFLTFSTEEAMRNAF

SEQ ID NO: 75064 - DNA, 915 bp, Zea mays
  misc_feature: Ceres CLONE 1559442
  misc_feature: Encodes the peptide sequence at SEQ ID NO. 75065
  misc_feature (638)..(638): n is a, c, t, g, unknown, or other
  misc_feature (639)..(639): n is a, c, t, g, unknown, or other
  misc_feature (685)..(685): n is a, c, t, g, unknown, or other
ctggagctccccgcggtggcggccgctctagaactagtggatcccccgggctgcaggaattcgtctcacccctagaaaaattcaccccgccgtgcgcgcgcgcccccgcggcgacaaccgggcgaccgccgccgacctacgccaggtgccaagccgttcctcagtcccatcacgaggccttcaacgagcccttcgccggcgacgagaaaatttgattctagttaactattcaagaagtaggagatgatgagctacttccaaaccactacttgcaagcctcaaagcagggtcgttgtgaacaaacctataccaggtcttgggagcacaagtcagcatccgttatattcacatgctctcagattccacaggctgcaacagaaggtgtacccaaggctacttctcgttgctgctagccacaaaaggcttactcctgtatgtgtcttaagtggaaagggaaatgctggcactgctgatgatcctttgatggaatctttgaagaaagctatggctgatgcaaaaaagcccaggtccatacaagacttgctgaaggagcaggtggctaaactcagaagacaagcatccggtggaggctgagggaatgggatcgccgtggaggcagtggtggttctggtggccannatgatgagtcctccaggaagcattggaagaagtatcccagtttacntagccactgtggctttcatacttgggtcctccccctaaccggaaggaaggaactttaccgtcttggcaggaataacccaaaattccgcgccgtgtaaaaaaaaccgcccaaaggaacgtccctggcaaaggggccaccttccccaaacctcttgcaaaaggagcgcccaaaagggccttttgggaaccccggggggggacaccccccaaaatgggtgcctttgggggggt

SEQ ID NO: 75065 - protein, 116 aa, Zea mays
  misc_feature: Ceres CLONE 1559442
MMSYFQTTTCKPQSRVVVNKPIPGLGSTSQHPLYSHALRFHRLQQKVYPRLLLVAASHKRLTPVCVLSGKGNAGTADDPLMESLKKAMADAKKPRSIQDLLKEQVAKLRRQASGGG

SEQ ID NO: 75066 - DNA, 1009 bp, Zea mays
  misc_feature: Ceres CLONE 1559443
  misc_feature: Encodes the peptide sequence at SEQ ID NO. 75067
  misc_feature (946)..(946): n is a, c, t, g, unknown, or other
  misc_feature (1009)..(1009): n is a, c, t, g, unknown, or other
ctccccgcggtggcggccgctctagaactagtggatcccccgggctgcaggaattcgtctcacccctagaaaaaagcgtatgttcttgttccagttcctatttttactccaagtccactagggatcctatccagattcgtggggacaccctcttcgagttccaggtttccaaggtccaaccttctcctctctgaggccgtagcatttgtctggttggattgggttgttccgcttgggtagccgggtgggatcgaaatctgtgtggcacccatatggctgcggtcgaggggacgaagaataaggtaatcatcgacaccgaccccggaattgatgacgcgatgtgccatcttcttggcgctgcaggggggggagctggatgtgctgggcctcaccactaccttcggcaacgttcacaaccgccctcgccacggggaaagggctccaccttgctggaggctgttggcaggacttgacaatccccgtggcaaaagggatcccctggtaccgattcaaaaagccccccaaggctgaaggatctcaaatcttccctccacggtttcaaatagggcttgggaaaaccaaaaaacttccccccccaccatccacacaaagcctggttataatcagcccgccttgcctccccttttttggtattgaaaaaaggcaaatttcttttcccctgggtccaatatagcatctgtgtcgcccccttggcccatattttccaacatttgtcttccttgacttccactccctgtccctgtcccccccccggaacagaataccgccttactttttttccttcgggcgcgccatctttacccataaatgatatgggtcccctcctacacttatcgcaatatcccctcgggttcgtcctcttcaccccatatttcctgtatctctcgccatcttttttttttcgccgacgtaaaacaacaccccncatctatttaaccgcagtggaacgctcattgacgggtgtgttaatctctctatctgtctatcn

SEQ ID NO: 75067 - protein, 63 aa, Zea mays
  misc_feature: Ceres CLONE 1559443
PRGGGRSRTSGSPGLQEFVSPLEKSVCSCSSSYFYSKSTRDPIQIRGDTLFEFQVSKVQPSPL

SEQ ID NO: 75068 - DNA, 1016 bp, Zea mays
  misc_feature: Ceres CLONE 1559444
  misc_feature: Encodes the peptide sequence at SEQ ID NO. 75069
  misc_feature (408)..(408): n is a, c, t, g, unknown, or other
  misc_feature (465)..(465): n is a, c, t, g, unknown, or other
  misc_feature (476)..(476): n is a, c, t, g, unknown, or other
  misc_feature (586)..(586): n is a, c, t, g, unknown, or other
ctccccgcggtggcggccgctctagaactagtggatcccccgggctgcaggaattcgtctcacccctagaaaaattgaagcaaagaaccctgcaactgcaacaagccctgacgcttaatacatcggccggcactcgatcggcagcagatcaaagatggcggcggaggagggggagaaggcgaagagcggcggcggcgggcagcagatgacggtggtgcgggggctggacgtggcgcggtacatggggcggtggtacgagatcgcgtcgttcccgtccttcttccagccgcgggacggccgcgacacgcgcgccacctaccggctgctggaggacggcgccacggtgcacgtgctcaacgagacgtggagcaagggcaagcgcgactacatcgagggcactggctacanggccgacccttgcagcgacgaggccaagctcaggtctagttctacctccccgccttncctcccatcgntccccgtcgtcggcgactactgggtgctctacgtcgacgatgactaccaggtacgcgctccgccggcgagccgggcccccagaacctccgggatcctgggccggaaaacnaacctccaccgaagaccgtgtacaaccccgcttgggggaaccgggccaaggaggaaaggctcccacctggagccaagctgccacgggaccccccaaggaaaacccccccccccggaaaaagacacccccccccccaccaccccaggggggggggggggggggtcaaacccccccctccgcggaaaaaaaaggcccccataaccaaaaaccccggtgttcccggtattttgtttttttattttgcgcaaaaaaaaccgcgcggggggaggaggggggggggtttttttcccttggggaaacgcccccccccattggtttgggaaaaatgggaagcccctcgtctataaacggggggggttttttaaaatttcccccaaaaacaccggggggggggagcccccgggggttttgtttggtggaacaaacacat

SEQ ID NO: 75069 - protein, 210 aa, Zea mays
  misc_feature: Ceres CLONE 1559444
  misc_feature (24)..(151): Pfam Name: Lipocalin_2 Pfam Description: Lipocalin-like domain
  misc_feature (85)..(85): Xaa is any aa, unknown, or other
  misc_feature (104)..(104): Xaa is any aa, unknown, or other
  misc_feature (108)..(108): Xaa is any aa, unknown, or other
MAAEEGEKAKSGGGGQQMTVVRGLDVARYMGRWYEIASFPSFFQPRDGRDTRATYRLLEDGATVHVLNETWSKGKRDYIEGTGYXADPCSDEAKLRSSSTSPPXLPSXPVVGDYWVLYVDDDYQVRAPPASRAPRTSGILGRKTNLHRRPCTTPLGGTGPRRKGSHLEPSCHGTPQGKPPPPEKDTPPPTTPGGGGGGSNPPLRGKKRPP

SEQ ID NO: 75070 - DNA, 971 bp, Zea mays
  misc_feature: Ceres CLONE 1559445
  misc_feature: Encodes the peptide sequence at SEQ ID NO. 75071
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
ctggagctccccgcggtggcggccgctctagaactagtggatcccccgggctgcaggaattcgtctcacccctagaaaaatcgtcgcgcgcgcctgcctctcccacacactccacagcgcccgcgcaggctcgctgcaagcgcaaagcagccacagcaccccctgcacctgcagactgcaaccgcaatgtcggctctcgggacgctctccggcggcgctgccggtgtctccggcctcctccgcctccgccgccgggccgccccagcccccgcgatcgcggcgccgtcgcacctccccgctgggaccgtcaagtgcgcggccgccgtgcccgatgccgccccgatcgtctggggccgtcagctccgcccggcgctcctcctacccgcggcgctgctcccttcgttgcagcccgccaggaggcacacgctgcagccgcccgccgcagccgccgagtccgcaagggaagccaagtctgtggggtttcctgggagaagtacccggccctggtcaccggcttnnntctcttcatgtggtactttcctcaacgtcatattcaacattcctcaacaagaagaatctacaactactttccatatccataacttgtgtcctttgacccaccaggaagggggggccgtaacctgcctcaccaacggggaagggcgggtctcccaaagcaaaggcctatcaatggcaccctcctcaaagcttccttttcattccccctgggggcaggggtttgggcacacccccaacaaaggggccctccccggtgtgtgaagctcttttggccccctaaaaaaatcgtgggaccctttttaggcagggggttattattttttcggggaaaaagggcccctcccccgggggttttctccccccccggggggaatggggttttaagggaccccctaaaggtcttttaaaagggagcgtgcttctgggcgaaataaaaacacccctcttccggg

SEQ ID NO: 75071 - protein, 197 aa, Zea mays
  misc_feature: Ceres CLONE 1559445
  misc_feature (111)..(111): Xaa is any aa, unknown, or other
  misc_feature (112)..(112): Xaa is any aa, unknown, or other
MSALGTLSGGAAGVSGLLRLRRRAAPAPAIAAPSHLPAGTVKCAAAVPDAAPIVWGRQLRPALLLPAALLPSLQPARRHTLQPPAAAAESAREAKSVGFPGRSTRPWSPAXXSSCGTFLNVIFNIPQQEESTTTFHIHNLCPLTHQEGGAVTCLTNGEGRVSQSKGLSMAPSSKLPFHSPWGQGFGHTPNKGALPGV

SEQ ID NO: 75072 - DNA, 967 bp, Zea mays
  misc_feature: Ceres CLONE 1559446
  misc_feature: Encodes the peptide sequence at SEQ ID NO. 75073
  misc_feature (495)..(495): n is a, c, t, g, unknown, or other
  misc_feature (543)..(543): n is a, c, t, g, unknown, or other
  misc_feature (576)..(576): n is a, c, t, g, unknown, or other
  misc_feature (624)..(624): n is a, c, t, g, unknown, or other
tggagctccccgcggtggcggccgctctagaactagtggatcccccgggctgcaggaattcgtctcacccctagaaaaactgatggcgaccgacgtggctgagactcccgcgccgttggtggatgcggcccctgaggcgcccgcggacaccccggcggcgcctgctgttgacgcgaagccggccaaggccaagaaggccacagcgccgaagaagcgcgccagcccgacccatccgccgtacgccgagatggtctcggaggcgatcgcgtcgctcaaggagaggacggggtccagcagctttgctattgccaagttcttggaggacaagcacaaggacaagctcccgcccaacttccgcaagcttctgaacgttcagctcaagaagctcgtcgccggcggcaagctgaccaaggtgaagaactcgtacaagctgtcgtccgccaccaagccaaaggccgccccgaagaagaccaagaccggcgtgaagaagcccanggccgctgccaaaccgaatgccaagtcccccgcgaagccctagtccgncacatagcccatggctgccgcgtaagccgcttncaagccgatagcagcagcaaaacccatggcaccagcaagtccaaaggncaagcctgctgccaaggcgaagcccaaggctgccgggggctaaaccgaatgcagctggccaagaaggccggccgccccggccaggcggggcaaaaattcggcccaaggccaccccagaaaaaaaaggccccggtggccaataccccccgggcccccccaaaaaagggcccggggcccaaaaaggccctcccgggaaaaaaggggggcccccccccccaaaaacccccctcccgaagggaaaaaataaggggggggggggcggaaaaaaaagggggggtggctcccaaaaacccaaaatttgcccccccccttacccaaagagtgggtgggggcccaaaaataa

SEQ ID NO: 75073 - protein, 151 aa, Zea mays
  misc_feature: Ceres CLONE 1559446
  misc_feature (49)..(119): Pfam Name: Linker_histone Pfam Description: linker histone H1 and H5 family
  misc_feature (138)..(138): Xaa is any aa, unknown, or other
MATDVAETPAPLVDAAPEAPADTPAAPAVDAKPAKAKKATAPKKRASPTHPPYAEMVSEAIASLKERTGSSSFAIAKFLEDKHKDKLPPNFRKLLNVQLKKLVAGGKLTKVKNSYKLSSATKPKAAPKKTKTGVKKPXAAAKPNAKSPAKP

SEQ ID NO: 75074 - DNA, 947 bp, Zea mays
  misc_feature: Ceres CLONE 1559448
  misc_feature: Translation starting site: 435
  misc_feature (490)..(490): n is a, c, t, g, unknown, or other
caaagctggagctccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgtgacaccgcgggcctctcggccgacccggagacattcgcgcgcaaccgggatgctggaggtgatccactcccggtgggcgatgctgggcgcgctggggctgcgtgnttcccggagatcctggccaagaacggcgtcaagttcggcgaaggcggtgtggttcaaggccggcgcgcagatcttctcggagggcgggctggactacctggggaaccccaacctggtgcacgcacagagcatcctggccatctgggcgtggcaggtggtgctcatgggcttcgtcgagggctaccgcgtcggcggcggccggctcggggaaggctcgactagtgtaccccggcggcgccctcgacccgctgggcctcgtcgacgaccggtacacgccgccgagctcaaggtgaagagctcaagacggcccgccttgcattgtctcatgtttcgcttctcgtgcaggcatcgtcacggcaagggcccatcgagacttctcgaccaggtgcgacccgttcgcaaaagcttggcatcgccaatactcgtccccgcactacgtatgatcaacccgtaagtt

SEQ ID NO: 75075 - DNA, 942 bp, Zea mays
  misc_feature: Ceres CLONE 1559449
  misc_feature: Encodes the peptide sequence at SEQ ID NO. 75076
  misc_feature (759)..(759): n is a, c, t, g, unknown, or other
  misc_feature (765)..(765): n is a, c, t, g, unknown, or other
  misc_feature (844)..(844): n is a, c, t, g, unknown, or other
ctggagctcaccgcggtggcggccgctctagaactagtggatcccccgggctgcaggaattcgtctcacccctagaaaaaatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggcctgccaggtcgtgctcatgggcgccgtcgagggctaccgcatcgccgtgcgcccgctccggcgaagtcgtcgacccgctctatccccgcggcagcttcgacctgctcggcctcgccgacgtacccgnaggccntcgctgagctcaaggtgaaagagctcaagaaacggccgctcggccatgtctccatggtcggatttctcgtcaggcattnttcacggggagggcccgctcgagacctcgctgaccactttgcgacccgtaaaaaaacgcttgggctacgcaactatttgtccccggaaggtaggaggg

SEQ ID NO: 75076 - protein, 212 aa, Zea mays
  misc_feature: Ceres CLONE 1559449
  misc_feature (65)..(198): Pfam Name: Chloroa_b-bind Pfam Description: Chlorophyll A-B binding protein
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAVRPLRRSRRPALSPRQLRPARPRRRTRRPSLSSR

SEQ ID NO: 75077 - DNA, 812 bp, Zea mays
  misc_feature: Ceres CLONE 1559450
  misc_feature: Translation starting site: 239
  misc_feature (378)..(378): n is a, c, t, g, unknown, or other
ctggagctccccgcggtggcggccgctctagaactagtggatcccccgggctgcaggaattcgtctcacccctagaaaaaagcatctcaagtcttcacactcctcgccatcacataaaaccagtgcaagctagaagcagcgcaatggtcgagcagcaccatggtccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtcctgcgcgcccccgagctacctgactgccgagttccccggccgactacngctggggacaccgcgggggctgtcggccgacccggaaaaactttccccaaaaaccggggaactgggaggggatccccctccccctggggccattttgtgggcccctttggggctcgtttttttccggaaaattccctcccccccacaaagggtttaaaatttggggagagcccttggggttttaaagaggggggggacaaaaattttttaggagggggggggggggggagaatccctcgcaacaccggtgtttttttccccggagaaaataaaccccccccctccttggggcgccccaaattttttgttttttggggcgcccccaaaagaaggggggaccacccccccccccccgcccccccccaaaagaaaaaaaaaaaacaaccccccccccccccgcgcggggggggttccccacccccccccgccaccac

SEQ ID NO: 75078 - DNA, 955 bp, Zea mays
  misc_feature: Ceres CLONE 1559451
  misc_feature: Translation starting site: 153
  misc_feature: Pfam Name: Coatomer_WDAD Pfam Description: Coatomer WD associated region
  misc_feature (570)..(570): n is a, c, t, g, unknown, or other
  misc_feature (815)..(815): n is a, c, t, g, unknown, or other
  misc_feature (934)..(934): n is a, c, t, g, unknown, or other
gctggagctccccgcggtggcggccgctctagaactagtggatcccccgggctgcaggaattcgtctcacccctagaaaaattattgataagcaatttaatgttgtggggtatactttactccttagtttgatcgaatataagacacttgtaatgcgtggggattttgatcgtgcaaatgatgttttatcatctataccaaaggaacaatatgacagtgtggcacgtttcttggaatcacggggaatgttggaggaagccctcgagatagcaactgacactaattacagatttgacctggctgtgcaacttggtcgacttgaaattgcaaaggcgattgctaccgaggtgcaaagtgagtccaagtggaagatattaggggagttagctatgtcaagtggaaagcttgagatggcagaggagtgtcttctacatgctatggacctcagtggtttgttgcttttgtattcttcccttggggatgctgaaggcattaacaaattggcatctgtagccaaagaacaaggaaagaacaatgttgctttcctttgtttcttcatgctaggaaagnctggaagagtgtcttcaattgctaatagaaagcaatcgtattccggaagcagcattgatggcaagatcttatcttccaagcaaagtccctgagattgtagcattgtggaaaaaggatctccagaaggtaaactcaaaagcagcagagtcgctggctgatccctatgagtacccaaacttatttgaagactggcagattgctctcaacgtagaagctgctgttgcctctaaaggagtatctatcanccggccgaagagtacatgattcatgctgaaggtcaaatgaaagtttagtggaagctttaaaaattgcatgtacctggaaggatggtaccgatgataatgaaatactgtcacagtatttnagaggaggggggggaaataaa

SEQ ID NO: 75079 - DNA, 962 bp, Zea mays
  misc_feature: Ceres CLONE 1559452
  misc_feature: Encodes the peptide sequence at SEQ ID NO. 75080
  misc_feature (563)..(563): n is a, c, t, g, unknown, or other
gctggagctcaccgcggtggcggccgctctagaactagtggatcccccgggctgcaggaattcgtctcacccctagaaaaaagtgcatcgaaaatttggtcgaaataaacaagcagagcagaaaacccccacacgcttttagttggccgtccgtccgtccgtctctgaggagcacacagcagtcgattttaaactgcagctacagtctacagaggtcaggtcaggggacacagcctgagcggctggctagcgggggctagcgagcggcgccacagcgcagcacgcagagagccagggcggcggccatggcgagcgcggcgagtggcggcggcgggtcgctgaagcggatgggcccgctccgggtacagtactacatcgtgatgggcgcggtggcagcggctgtggtgctggccacgctgcgctacatgccggggccagccgtcccggcgaccaccgcccgtaccagcggagggcggcgtcgtgcgctcggccccagcagccgcggccgtccccgtgcccgtgcccgccgtggaggaagaaacgggggagatgaccgggcgccnaaggaaggggggggaggaaagggaagaaaaaggggggaaggggggtcgtgctcttcaacttcggcgactccaacagcgacacggggcggcgtggcggcgggtcatggggatccgcatcgcaccgccggagggcagggcctacttcaccaccccacggggcggctctccgacggacgcgtcatcctcgacttcatctgtgagagcctgggcacgccgccactgagtccgttcatgaagccgctgggctccacttctcaaacgcgtcacttcggcattgcagggtcacgccatgccgggagtaacaccttctccctgaacgggcagggggatcattcgcctcctcaagaaagtgcctcacccctcccaaaaaggtaaaatgccccatttgttgaaaagctt

SEQ ID NO: 75080 - protein, 210 aa, Zea mays
  misc_feature: Ceres CLONE 1559452
  misc_feature: SWISSPROT Homolog: EC 3.2.1.51 Alpha-L-fucosidase
MASAASGGGGSLKRMGPLRVQYYIVMGAVAAAVVLATLRYMPGPAVPATTARTSGGRRRALGPSSRGRPRARARRGGRNGGDDRAPKEGGGGKGRKRGEGGSCSSTSATPTATRGGVAAGHGDPHRTAGGQGLLHHPTGRLSDGRVILDFICESLGTPPLSPFMKPLGSTSQTRHFGIAGSRHAGSNTFSLNGQGDHSPPQESASPLPKR

SEQ ID NO: 75081 - DNA, 944 bp, Zea mays
  misc_feature: Ceres CLONE 1559455
  misc_feature: Translation starting site: 541
  misc_feature (389)..(389): n is a, c, t, g, unknown, or other
  misc_feature (642)..(642): n is a, c, t, g, unknown, or other
  misc_feature (825)..(825): n is a, c, t, g, unknown, or other
  misc_feature (836)..(836): n is a, c, t, g, unknown, or other
  misc_feature (871)..(871): n is a, c, t, g, unknown, or other
ctggagctccccgcggtggcggccgctctagaactagtggatcccccgggctgcaggaattcgtctcacccctagaaaaatctacctcaggctgcttgaagtagtatgcatcagcggccctggtcctctctcccgctcccgctcaagggcagcagagaaagcagctgagcgctgactgtggatctcatccgtatcgcgtatatacgtcgtcctgtttggatccaccgcgttttgctaattcccttcgaaccggccggtggccttcgttctcccaccaggcctgtctgtctgctgtatccgccagagcttccatggattccaccctcttcatcatcggcgtcataggcaacatcatctcagttctcgtcttcatatcgcctatcaagacngttctggaggatcgtgcggggcgggacgacggaggagttcgagccggcgccgtacgtgttgacgctgctcaacgcgctgctgtggctctactacggcctcaccaagcccgacggcttcctcgtcgccaccgtcaatggctttggggctgtcatggaggccatctacgtcgtcctcttcatcgtctacgccgccaaccatgccacaagggttaagaccgcaaagctggcagcagcgttggacatcggtggcttncggagtcgtgtttgcggccaccacattcgccatcagtgaatttgaattgagaatttggtgatagggattgatatgtgcctgcctcaatgtgctcatgtacgggtcaccccccttgctctatgaaacggtgatcccgacaaagagcgtggagtcatgcccattctcctgtcccctctctcctcntcaacggagcntctggggcacgtacgcgtgcttggacgcgacatcntcctcggaatcccatggggaatagcttcgtgctggcaccctttcagctgatcgtctacccgactacatggaca

SEQ ID NO: 75082 - DNA, 809 bp, Zea mays
  misc_feature: Ceres CLONE 1559456
  misc_feature: Encodes the peptide sequence at SEQ ID NO. 75083
  misc_feature (715)..(715): n is a, c, t, g, unknown, or other
  misc_feature (788)..(788): n is a, c, t, g, unknown, or other
tggtctccccgcggtggcggccgctctagaatagtggatcccccgggctgcaggaattcgtctcacccctagaaaaagtcatgctcggcgccgcgccggcgctgctcacctactactggcggatgaagatgcccgagacggcgcggtacacggcgctggtggccaagaacgccaagcaggccgccgccgacatgtccaaggtgctgcacacggagatcgtggacgagcaggagaagctggacgccgccgagggcgcaacagcttcggcctcttctcagggagtcgcgcgccgcacgggctcactcgtggggcacgcacacttggttctggtgaaatggcttctaaaagcaaacggttccaaagggattcttccccgtttaaggggttccccagggcacacctggggccggtggagaggggccccaattccccgggaaaaaccttttgggttttggaaacccccgggggttttgttcaccccccccctttaaaaaggggggggccgccccaaaaaaaaggggggtgtttttataaaaaaaaatttgtggggggcccccccccccccccccgccgggggggggggggggggggaaaaaaggggggggggggaagaaacctttcttttttttttataattgtggggggcaacaccaccccccccctcctaaaaaaaaatattgggggggccgccccccccccccttcttttttgtgtnaaggggaggaggaggggggggtgttttttttttttttttttctttaaaaaaaaaaaaaaaaaaaaaaaaaaanaccccccctcccccccccccc

SEQ ID NO: 75083 - protein, 136 aa, Zea mays
  misc_feature: Ceres CLONE 1559456
MLGAAPALLTYYWRMKMPETARYTALVAKNAKQAAADMSKVLHTEIVDEQEKLDAAEGATASASSQGVARRTGSLVGHAHLVLVKWLLKANGSKGILPRLRGSPGHTWGRWRGAPIPREKPFGFWKPPGVLFTPPL

SEQ ID NO: 75084 - DNA, 952 bp, Zea mays
  misc_feature: Ceres CLONE 1559457
  misc_feature: Translation starting site: 87
  misc_feature (661)..(661): n is a, c, t, g, unknown, or other
  misc_feature (863)..(863): n is a, c, t, g, unknown, or other
  misc_feature (868)..(868): n is a, c, t, g, unknown, or other
ctggagctccccgcggtggcggccgctctagaactagtggatcccccgggctgcaggaattcgtctcacccctagaaaaaagagaaatggcgggagcgaacttcctctccaccgcggcgctcgtcgcccgcggcgtcgctgcctgctcttctatttcaactccgacacggaggcacccgcaaatccgggtgtgctgccgggctgacgttgaggctatggaggcctatgcccatgaagagcgccttcgattccgtcggagagatttcatcggcacctgcgtcggcaccgctattggtttggaaatgatcgacggctctacgagtttctctggagtggctactgcagctgatctcattgagcgtagacaaaggtcggagttccaatcaaaaatcaaagacaccctttacgtagccataaaggctaagccagagctcgttccatcgttgttgaccatggcactgaatgatgccatgacatacgacaagaccaaaaactggaggcgcaaatggatctatcaggctagaaacaagcagacctgagaacagtgggctctcttccgcgttggatttgctgactgaagccaaaaaggagatcgattccttttccaagggaggtcccatttcgtttgcagatctgatccagtttgcagcacaatcagcanctgaagagatcgtttcttgacgctgccattgcccaaatgtggtggaaatgaagagaagggaagaacactgtactctgcatatggttcaatggggcagtggggtctgtttcgatagaacgttcgggagagcagacgcacaggagcaatcccagagggaagatgcctgacggggagcagggctctgtgcagagatgaaagatangtccntcccctttttgggtgggtcccccccagctgcctgttatgcaggcgtcccttggaccgtgacaggctgcctacggaggaacaacg

SEQ ID NO: 75085 - DNA, 968 bp, Zea mays
  misc_feature: Ceres CLONE 1559458
  misc_feature: Encodes the peptide sequence at SEQ ID NO. 75086
  misc_feature (793)..(793): n is a, c, t, g, unknown, or other
ggagctccccgcggtggcggccgctctagaactagtggatcccccgggctgcaggaattcgtctcacccctagaaaaagccttcgcccctccaaggttctctgattccagacgcaaccctgcggctgcggggtcaaggagccagagggggtgcacagcgatcgttctgccggagatcgaaaccctcagctagggtctgaggcgccgggctgcggccgccgagatgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccttgggacggaggcacgttcaagcttaccttgcagtttacagaagattacccaaacaagccaccaactgttcggttcgtctctaggatgtttcatccaaacatatatgctgatggaagcatctgcttggatatcctacagaaccagtggagtcctatatatgatgttgctgcaatcttgacttctattcagtccctgctgtgtgatccaaaccccaactcccctgcaaactcaaaagcccccagactgttccgcgagaacaagcgggagtacacccccaaaatccccgagattgttgaagcagaactggacaccccactattgcaggaagatgctcctcctggcccgaaaaggcccaataaggaacccctgaaaaaacacctctggggttgtgggttcgccccacctggcccaaacattgaaaaacccccgntccacccctgccctgtgcagggttttggtcggatccaaaaccaccggtggcccttgggggggggcgtcctaattttacggggtggttttggaaaaatcctccctaaaagaaaccccccggtgggcaaaacaaaaaatgggaaaagggggtctcattggaccatgcaaaccacttt

SEQ ID NO: 75086 - protein, 248 aa, Zea mays
  misc_feature: Ceres CLONE 1559458
  misc_feature (8)..(145): Pfam Name: UQ_con Pfam Description: Ubiquitin-conjugating enzyme
  misc_feature: SWISSPROT Homolog: EC 6.3.2.19 Ubiquitin--protein ligase
  misc_feature (191)..(191): Xaa is any aa, unknown, or other
MSTPARKRLMRDFRRLQQDPPAGISGAPHDNNIMLWNAVIFGPDDTPWDGGTFKLTLQFTEDYPNKPPTVRFVSRMFHPNIYADGSICLDILQNQWSPIYDVAAILTSIQSLLCDPNPNSPANSKAPRLFRENKREYTPKIPEIVEAELDTPLLQEDAPPGPKRPNKEPLKKHLWGCGFAPPGPNIEKPPXHPCPVQGFGRIQNHRWPLGGGVLILRGGFGKILPKRNPPVGKTKNGKRGSHWTMQTT

SEQ ID NO: 75087 - DNA, 947 bp, Zea mays
  misc_feature: Ceres CLONE 1559459
  misc_feature: Encodes the peptide sequence at SEQ ID NO. 75088
ctccccgcggtggcggccgctctagaactagtggatcccccgggctgcaggaattcgtctcacccctagaaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtggcggagaacttcgagcggttcaaggagtcagaggtgtaccactgccgctgggccatgcttgccgtccccgggatcctggtgccggaagctctgggcctgggcaactgggtgaaggcgcaagagtgggcggccctccccggcggggagggcacgtacctgggcgcccccgtgccgtggggcacgctgccaaccatcctggggatcgagatcgtgggcatcgccttcgcccaggaccagcgccccttggggaaggaccccccaaaaaaaaaaatacccccggcggggccttcgacccccctggcttttcctaaggaccccgccaggttctgagaagtccagctccagggggattaagaaaggcccgcccccccctgcgggggcgttggggggggttctgggtctcaacaaaaagcgtgacccccccccccggcgcccctggaaaaaattaggcttccccctccgcccaaaccgtgggcgaacgaaccttgtgggggaatatattcctccaccaaagaattccccgcctgtggggcccctcaaattggtgggttggggggtcttttgataaaaactaaacccgcc

SEQ ID NO: 75088 - protein, 186 aa, Zea mays
  misc_feature: Ceres CLONE 1559459
  misc_feature (54)..(187): Pfam Name: Chloroa_b-bind Pfam Description: Chlorophyll A-B binding protein
MVMASSSGLRSCSAVGVPSLLAPSSRSGRLAPFCANATTSGRVTMSAEWMPGQPRPAHLDGSSPGDFGFDPLGLATVAENFERFKESEVYHCRWAMLAVPGILVPEALGLGNWVKAQEWAALPGGEGTYLGAPVPWGTLPTILGIEIVGIAFAQDQRPLGKDPPKKKIPPAGPSTPLAFPKDPARF

SEQ ID NO: 75089 - DNA, 951 bp, Zea mays
  misc_feature: Ceres CLONE 1559460
  misc_feature: Encodes the peptide sequence at SEQ ID NO. 75090
  misc_feature (791)..(791): n is a, c, t, g, unknown, or other
  misc_feature (796)..(796): n is a, c, t, g, unknown, or other
ctggagctccccgcggtggcggccgctctagaactagtggatcccccgggctgcaggaattcgtctcacccctagaaaaagctacgtactttgcacggaggcatccgtcaaaatacacgaagggcaacgaggcgaggcctagtatagaggaaaacgagtgagaggggggaaatgctgcgccacgccgcccgccgtctcgtctcccgcaccgccgcggcgcccaccgcccgccgggcgctcgtcacggcagaggtgcctgcggaggccgccgaggactccacgtttgtggaggcgtggaagaaggtcgcccccaacatcgagcccccaacgacgcccctcttcctcatgcagccgcgcccgcccacgccggctaccatccccactaagctcaccgtcaacttcgtcctcccctacaagtccgagatcgccaacaaggaggtggacatggtaattgtaccagctacaactggtcagatgggcgttttgccaggccatgttgccacgattgcagagctcaagcctggtgttctctcagtacatgaggggaacgatgtgaccaagtactttgtgagcagtggatttgctttcgtccatgcaaactccattgctgatattgtggctgttgaggctgtccctgtggatcagatcgacccagcttttgttcagaagggtctcgctgaattcactggccagcttggttcggcctctactgacctggagaggctgaggctcagatcggtgtcgatgtcacagtgcgctcatgctgcattgaccggttaattgtgtcatcntaaantgtctgtctttagaatgagtttaacttgcaatccctaataattatagtcatctaaacatggacatatggttcttggtactgaatcctgcagggatttattttgtactcgggatattttactcctgagctcaaaccggagttggcttcttttccct

SEQ ID NO: 75090 - protein, 202 aa, Zea mays
  misc_feature: Ceres CLONE 1559460
  misc_feature (72)..(155): Pfam Name: ATP-synt_DE_N Pfam Description: ATP synthase, Delta/Epsilon chain, beta-sandwich domain
  misc_feature: SWISSPROT Homolog: EC 3.6.3.14 H(+)-transporting two-sector ATPase
MLRHAARRLVSRTAAAPTARRALVTAEVPAEAAEDSTFVEAWKKVAPNIEPPTTPLFLMQPRPPTPATIPTKLTVNFVLPYKSEIANKEVDMVIVPATTGQMGVLPGHVATIAELKPGVLSVHEGNDVTKYFVSSGFAFVHANSIADIVAVEAVPVDQIDPAFVQKGLAEFTGQLGSASTDLERLRLRSVSMSQCAHAALTG

SEQ ID NO: 75091 - DNA, 935 bp, Zea mays
  misc_feature: Ceres CLONE 1559461
  misc_feature (921)..(921): n is a, c, t, g, unknown, or other
ctggagctccccgcggtggcggccgctctagaactagtggatcccccgggctgcaggaattcgtctcacccctagaaaaaatccccatccactctactttacaccgcaggcagtgagccagccactgagccaccaagttaactctgagcgacgtcaagcaccaacgcacgacgaccaccaccaccacctcgagctacaagctatggcgaagcgtctcctccgctcttcgtcccttcctctggccctggtgccgccgccgctgctgcttctcctggtagcgggatcgctcgcaggggcaaccgcgcttggcagcttccctggggaacgtcgtggtcgaagcctgcagcagctgccaaacccgatgcctcagcctgtcccgcagccgcagccagacccaaacgtacggccgcaaccggggtcgccgaacccactgccaccacagcccctgccgcaaccaaatccaaaccctcagccgcagccccttccgcaaccacagccaggcccgcagcctgacccaaacccacaacctcaacctcagcctcagcctctcccgcagccacagcctggcccaatcccgccgcagcctgacccgaaccggaacccacagccacaacctctacccttgccacagcctctcccgcatacacagcctggcccgatcccacagcctaacccaaacccaaacccacagcccgtgccgatgccagacccaaatgtgcagcagccacaaccacaacctgctcccaacaaaatcacagccgcagtctgatcagctctccggggggtcacagccacttccaacagcgaaacaatgatgttgaacccgcattacgcatgcttttaagctttgctgctttgctactatatagctctatacatacagtagtttttttcgttggtttcctttacgctgtattaatnaataaatatatgcg

SEQ ID NO: 75092 - DNA, 808 bp, Zea mays
  misc_feature: Ceres CLONE 1559462
  misc_feature: Encodes the peptide sequence at SEQ ID NO. 75093
  misc_feature (311)..(311): n is a, c, t, g, unknown, or other
  misc_feature (312)..(312): n is a, c, t, g, unknown, or other
  misc_feature (331)..(331): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
tggagctccccgcggtggcggccgctctagaactagtggatcccccgggctgcaggaattcgtctcacccctagaaaaagctctcgcaccgaccgtcccagaaatatctcgtcggcggtcagttgagctgcgagcaaccatcaaccaatcaaggacgacgacgcacggatcgatggccacgctctcctcctgcagccgcctgagtagcggcaccggcgccgcggctatccgccggcagccgaagccgacccgtgcaggagtcctgttcaccagccggcggggctcctcccgcgagcgtcgcacggccgccnngcgctgcactgcggcgccngggcgcgtagagcagcagaacaccgggtaagtggcggtacaaaaacaggtggctggtgcatgccatcccccgctgcccttgtaacttggtggggaaaaaaaaatccccgggtggaattaaaacccgggtttttttaaccccccaaaacccaaagggggggttggtggttcccccccaaagggggggagtttaattccgcggggggcgccgtggttttaaaaaaaaaaaaaaaggggggctcccccccccgcggggaagggggggagctttctttttttttacccgggggggaaaaataacccccccccccccggtttgttgggggggggttttnnnnncccccccccccccccctttttggggggggggaaaaaaaaaaaaataaaattttggggggagagaaaaaaagccccccccccccctatgtgggggggcgggcggggggccccctttatttttttttttttttggcggggg

SEQ ID NO: 75093 - protein, 62 aa, Zea mays
  misc_feature: Ceres CLONE 1559462
  misc_feature (47)..(47): Xaa is any aa, unknown, or other
MATLSSCSRLSSGTGAAAIRRQPKPTRAGVLFTSRRGSSRERRTAAXRCTAAPGRVEQQNTG

SEQ ID NO: 75094 - DNA, 964 bp, Zea mays
  misc_feature: Ceres CLONE 1559463
  misc_feature: Encodes the peptide sequence at SEQ ID NO. 75095
  misc_feature (778)..(778): n is a, c, t, g, unknown, or other
ctggagctccccgcggtggcggccgctctagaactagtggatcccccgggctgcaggaattcgtctcacccctagaaaaaatcctcccaggtcggattcaacctctctcccggggtaaaggatggagttctggaggaagccctcgagccgtgtggagctctgctggcggtatgctctccacaacctcccctacatggcctgcacctaccgcgtccagatggatctcgctcaagcgccatcctgccgaacctgcacgatggcagcgagatcgcccagcctagaggacgcctccgagatggatcttaactggcccaatgatccgctgtgcgatggcgattctagcaccgagaattcccgtaacgaccttacgagcgaagtcatcgcaaagttcaaggagcttgggcaaaaaacgccgtacacatggagggacgctcttcgcggccaagaaagcatgaaacgtaatgaacttgaggatgacatgcttgacaaattcacaaatgaagtctcacgcgaacagagctgacaaacaaagctcgcaaatcaaactctgtacataggtgcctccaagctccaaaatgagtttctttggaggaagtggacctcgcagtgtatccagttccagctacgagagccctatactgaagaacgctaggataccaggtaacagtcaagcaaggttgcaatctgctatgcaagaaatacttctgcgagggtcatctcgccaataacgactacctctgttagtgcacagaccctgagagcactacatttcataganccgattcaactgtaaccatgagcaaagcgatgggaaaaagccgcaaattcagaacgccaggcccaatctagggaacgggttgctgcgatatcgcaatgtgcactccgaaccatatgtgcctctgaagaaacgctcctttgtcaaaaggaggacgaccccctactctttttttttggaaaagagaga

SEQ ID NO: 75095 - protein, 50 aa, Zea mays
  misc_feature: Ceres CLONE 1559463
MSFFGGSGPRSVSSSSYESPILKNARIPGNSQARLQSAMQEILLRGSSRQ

SEQ ID NO: 75096 - DNA, 931 bp, Zea mays
  misc_feature: Ceres CLONE 1559465
  misc_feature: SWISSPROT Homolog: EC 1.1.1.1 Alcohol dehydrogenase
  misc_feature: SWISSPROT Homolog: EC 1.1.1.103 L-threonine 3-dehydrogenase
  misc_feature (672)..(672): n is a, c, t, g, unknown, or other
  misc_feature (867)..(867): n is a, c, t, g, unknown, or other
gctggagctcaccgcggtggcggccgctctagaactagtggatcccccgggctgcaggaattcgtctcacccctagaaaaacctcttcacaccaactgccgcccctgctccgagaaccagaatggccgccgccgatgcatcttcgttgcctccgtccgccatcacctgccgagcggcggtggcgtggggaccgggccagccactggtgatggaggaaggtggaggtcgccccgccggggcccatggagatccgtgtcaaggtcgtctccacctccgtctgccgcagcgacgtcactgcctggcaatccaaggcgcaacttgatctgttccccagagtcttcggccacgaggcatccggtagagagtgtcggtgaaggtgtgaccgagttccaagtcggtgaccacgttctcactgtcttcattggggaatgcaagagctgcaagcactgcgtctcagggaagagcaacatgtgccagaagctcggtctggagaggaagggtgtcatgcacagcgatcagaagacacgcttctctgtcaaggggaaacctgtgtaccattactgtgcagtgtcaagcttcagcgagtacacggttgtccattccggatgtgcggtgaaggttggcttgaccgtgccatggacagggtgtgcctgctgagctgcggtgtgtctngcagactcggtgcagtctggaatgtagctaatgtatcaaagggctcaagtgtagctatatttggtctttgggaccgtaggactttctgtcgctcaaggtgctagctttcgagggcgtccaagattataggagttgataactatcctgagaaagcagaaagggaaaatcctttggtgtccacgacttattaacccnattgatttggtgaacttgtcacaagtaatcaagataccggtgtgggagggtgatcctctttttt

SEQ ID NO: 75097 - DNA, 955 bp, Zea mays
  misc_feature: Ceres CLONE 1559466
  misc_feature: Translation starting site: 158
  misc_feature: SWISSPROT Homolog: EC 1.2.1.12 Glyceraldehyde-3-phosphate dehydrogenase (phosphorylating)
  misc_feature (692)..(692): n is a, c, t, g, unknown, or other
  misc_feature (699)..(699): n is a, c, t, g, unknown, or other
  misc_feature (773)..(773): n is a, c, t, g, unknown, or other
ctggagctccccgcggtggcggccgctctagaactagtggatcccccgggctgcaggaattcgtctcacccctagaaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgttttgttgttggtgtcaatgaggacaagtacacctcggatgttaacattgtttccaatgctagctgcaccacatactgccttgctccccttgctaaggtcattcatgacaacttcggcatttgttggaggtttgatgancactgtncatgccatcactgccacccagaaaactgttgacggaccctcagccaagtactggagaagtggcagggctgccanctttacatcattcctagcagcacggtgctgcccagctgttgggtaagtcctcctgatctgaatgcaagctcactggtttgtccttcctgtcccaacgggggatgccccggtggttacctcacgtcagattcggggaaggggccccttgaagattccagaaacctttaggctgcctccagggc

SEQ ID NO: 75098 - DNA, 930 bp, Zea mays
  misc_feature: Ceres CLONE 1559467
  misc_feature: Encodes the peptide sequence at SEQ ID NO. 75099
  misc_feature (704)..(704): n is a, c, t, g, unknown, or other
  misc_feature (730)..(730): n is a, c, t, g, unknown, or other
  misc_feature (733)..(733): n is a, c, t, g, unknown, or other
  misc_feature (743)..(743): n is a, c, t, g, unknown, or other
  misc_feature (781)..(781): n is a, c, t, g, unknown, or other
  misc_feature (829)..(829): n is a, c, t, g, unknown, or other
ctggagctccccgcggtggcggccgctctagaactagtggatcccccgggctgcaggaattcgtctcacccctagaaaaaagttgccaattgccatcgccaactacctcctctcctcgctcctccaaccaaacaagccaccccccacgaaacccgcaatcccagccgaagccggacgatgaagagggacggatggcagcacggcgccgtccggggcagccgcagcaaggtgctgaggacggccgccggcgacgacaactccgacgccgacgcggtcgtggaaacggcggcggcggcggcgaggaagccgacgaacgcgtcccggagcacgggcaagtgccggcgggcccggtgcgcgggctgccacgcgcacccggtctccaaggcgcgcgacaaggccaagggcgcgcgcaagctgcgcgcctgcgacgtcgcgctcaaccaccgcctcgtgtcctggcgcgtcgtctaccagagccccgggtacagcggcgcgtccgcctcctccctgctggcgtacctggccggtggaagcagctggcacgaggaggaggaggactactacgagggcggagcggcgcccgacggccggctctctgacctctacgacctcttcgtcggccgcgggcagaggaggacggcgtggatgctgtacgagagattcaggcagttgaagagcaggggctgctggatgcaaagatcgcnagtacgacgagtggatgactacggcnacnacatggggtnctgcatggttggcaccaccatcgcgctggattctcctnacgcaaagaggactggatcgtgggcgaagagatctgattcccatctcntcatctcggttggcaaattggggaaggctcatttgcgaatagactccggccatccctgccggggctgggggggaggttatccaaccccgctagtctggggt

SEQ ID NO: 75099 - protein, 251 aa, Zea mays
  misc_feature: Ceres CLONE 1559467
  misc_feature (176)..(176): Xaa is any aa, unknown, or other
  misc_feature (185)..(185): Xaa is any aa, unknown, or other
  misc_feature (186)..(186): Xaa is any aa, unknown, or other
  misc_feature (189)..(189): Xaa is any aa, unknown, or other
  misc_feature (202)..(202): Xaa is any aa, unknown, or other
  misc_feature (218)..(218): Xaa is any aa, unknown, or other
MKRDGWQHGAVRGSRSKVLRTAAGDDNSDADAVVETAAAAARKPTNASRSTGKCRRARCAGCHAHPVSKARDKAKGARKLRACDVALNHRLVSWRVVYQSPGYSGASASSLLAYLAGGSSWHEEEEDYYEGGAAPDGRLSDLYDLFVGRGQRRTAWMLYERFRQLKSRGCWMQRSXVRRVDDYGXXMGXCMVGTTIALDSPXAKRTGSWAKRSDSHLXISVGKLGKAHLRIDSGHPCRGWGGGYPTPLVWG

SEQ ID NO: 75100 - DNA, 938 bp, Zea mays
  misc_feature: Ceres CLONE 1559468
  misc_feature: Encodes the peptide sequence at SEQ ID NO. 75101
  misc_feature (262)..(262): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (593)..(593): n is a, c, t, g, unknown, or other
  misc_feature (654)..(654): n is a, c, t, g, unknown, or other
  misc_feature (656)..(656): n is a, c, t, g, unknown, or other
  misc_feature (657)..(657): n is a, c, t, g, unknown, or other
  misc_feature (775)..(775): n is a, c, t, g, unknown, or other
ctccccgcggtggcggccgctctagaatagtggatcccccgggctgcaggaattcgtctcacccctagaaaaaatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcgggtaaggcctagcnggctgcggcgtcctgtagccnnngtgtacgccccgaccgcgtgctgtacctggcccactgtccggaaccccccaattacctgaaggggagttcccggggaaaaacggggggaaacccggggggtgttgcgaaaccccgaaattttccccaaaaaaggggggggggggggggtcccccccccccggggacatgtgggggcgcccccccttttttttcttcccggaggggtccccccccccccccagggtttttttttttttaaaaagctttgtgttttttcacaccccccccccccctattttttgggggggggggggggaggtattttttnaaaaaaaacaccccccccctcccccccaaaaaaaaaacaccccctcctctttttttggggngnnttttttttttgttggggggggagagaaaaaaataaaaaacccccccccgcccgcccgccgcggggggggggggagagaacacccttcccctcctcctggggggggtggggggcgctcncccccccccccccaccccccaaaaacatatctccccttttgttggggggagggggagaggagagacgacaaacaccccccccccttctttttttttttttttttgtttttttttttttttgtctcgcgggcggggggcggggggggagagggagcgcttatat

SEQ ID NO: 75101 - protein, 40 aa, Zea mays
  misc_feature: Ceres CLONE 1559468
MASSTMALSSTAFAGKAVNVPSSSAFGEARVTMRKTAGKA

SEQ ID NO: 75102 - DNA, 929 bp, Zea mays
  misc_feature: Ceres CLONE 1559469
  misc_feature: Encodes the peptide sequence at SEQ ID NO. 75103
  misc_feature (779)..(779): n is a, c, t, g, unknown, or other
ggagctccccgcggtggcggccgctctagactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcagcgccttcgtgggcggcaacatcaccctgttccgggggctcctgtactgggtggcgcagctgctggggtccaccgtggcgtgcttcctgctccgcttctcgacgggcgggcaggccacgggcaccttcgggctgacgggcctgtcggtgtgggacgcgctggtgctggacatcgtgatgaccttcgggctggtgtacactgtgtacgccacggcggtggcaccgaagagggcagcctgggcaccatcgcccccattgcatcgggctcatcgtagggccacctccctggtgggcggcgccttcgacgcgcgtcatgaaacccggcgagtcttcngccccgccctcgtcagctgggaggggggctaccaatgggttgacggggtcaggcccctcatggaaggcggcctcgcggggtattttaaaactgttctaattgtccaaaccacgagaaggttccctcccgactactaaagcggagccggag

SEQ ID NO: 75103 - protein, 246 aa, Zea mays
  misc_feature: Ceres CLONE 1559469
  misc_feature (13)..(229): Pfam Name: MIP Pfam Description: Major intrinsic protein
  misc_feature (202)..(202): Xaa is any aa, unknown, or other
MPINRIALGSHQEVYHPGALKAAFAEFISTLIFVFAGQGSGMAFSKLTGGGPTTPAGLIAAAVAHAFALFVAVSVGANISGGHVNPAVTFSAFVGGNITLFRGLLYWVAQLLGSTVACFLLRFSTGGQATGTFGLTGLSVWDALVLDIVMTFGLVYTVYATAVAPKRAAWAPSPPLHRAHRRATSLVGGAFDARHETRRVFXPALVSWEGGYQWVDGVRPLMEGGLAGYFKTVLIVQTTRRFPPDY

SEQ ID NO: 75104 - DNA, 958 bp, Zea mays
  misc_feature: Ceres CLONE 1559470
  misc_feature: Translation starting site: 534
  misc_feature (942)..(942): n is a, c, t, g, unknown, or other
ctggagctccccgcggtggcggccgctctagaactagtggatcccccgggctgcaggaattcgtctcacccctagaaaaagtgctgctggcgaaagaagcaaccgaaaataactgcatcgcgtcgcctgttcatggtccttctcctcgtcccacacacgggtttgccgaacatgttcttcctctggacagtagataagcgaatgcccgtgtctggttcgctctatggctgatgaggagtactacccccagtaccagcaagtggacgagagggtagtgttatggtggagcagcatctgcctatgagggccccgatagctgaagtacctggacttctgccacgtggtggctgcacatgtcgcagtgtacctcgctgggctctactgtctcagctaagaccacaacggtgcgatcctccgctgctttgacgccgtcaagtctgccgtctagggcgtcgttaggcacttctaccatcggctggcgcggcctgacggtcgaacttctacccttcgtcgaccggtaggtggaccactcgatgctctacgtggacaagcacctcccaggcgcgctgaacgtggcatcggctcatgtctaccccgcgattcggggcatgcaatatgtagcacgcaagctggctgcctatgccaacgatcgggattgaggggcgcaccccgtggtgcgcttgcgatgacagatccggtggctccagattggacaagaagggtagatcccatggtcaatgagctctacatggtatactagcacctggggcagcacctggtcgtgtccaaatggagctcgatgaatgggctgacagtgctatcactatctccgacatatcacgtagccacgactcgcaatgtactactagtgcacgggctgtcagcgcgacacggatcagtgttcgcgggagcaagtactcctcgcatgcacacgaatcatcncaaggtggatcgcagg

SEQ ID NO: 75105 - DNA, 977 bp, Zea mays
  misc_feature: Ceres CLONE 1559472
  misc_feature: Encodes the peptide sequence at SEQ ID NO. 75106
  misc_feature (771)..(771): n is a, c, t, g, unknown, or other
  misc_feature (772)..(772): n is a, c, t, g, unknown, or other
  misc_feature (792)..(792): n is a, c, t, g, unknown, or other
ctggagctccccgcggtggcggccgctctagaactagtggatcccccgggctgcaggaattcgtctcacccctagaaaaagtgctttctctctctctcgatctcgagcgacgactcggttacagccgccgtcctacgccaggtcccaggtcttcgtcgggcccttctccggcaacgagcaccaacaagatttttgtgtgtaaagatttgcgagcaccattcactttttcatcagtgtgaaattaaaacacttcaaggcttcaagcatgagctctcaccgtgtgaagtggaatgaggacaatttgtatgaaattgagtcaaacaaaccggtgaggcagaagataacagagccaaagacaccatatcacccaatgatagatgatgatggatcattgtcgccaacacgtcctttcgacaaatgtcttgatgagactgtccaggctgaagctatcttaacagccttaaatggtgtggcttcttcaagcattagcatttcaaaggatgatgcgttggggatcgtcagatgatgatacagatgccatagaacaagatgctgaccctgaagctgacacgacaaggttgagtttcaaggagcatcgccgtgcccactacgatgagtaccgcaaggttaaggagctgatgaggactggatcccttactgctgaggaggccgatgaggataccagagctgccaccagctcgaagaacaagggtgtgggggaatggagggccgtatgattacatgtagccctcgactcaaacatgaggagtnncatatgaagtgctgatgccnctgttattattgtatcatgtatgcaatacagtgtaactcttgtttttgtttgagatgctggtgtgcaaatggattgatgacgaattaattgatttggtgttgctacctggtcgaatgtcgtcgctccattttggtggggacctacattgcaattggagaaattggttcaaccgagcaactgctga

SEQ ID NO: 75106 - protein, 86 aa, Zea mays
  misc_feature: Ceres CLONE 1559472
MSSHRVKWNEDNLYEIESNKPVRQKITEPKTPYHPMIDDDGSLSPTRPFDKCLDETVQAEAILTALNGVASSSISISKDDALGIVR

SEQ ID NO: 75107 - DNA, 938 bp, Zea mays
  misc_feature: Ceres CLONE 1559475
  misc_feature: Encodes the peptide sequence at SEQ ID NO. 75108
ctggagctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgcaacggcgtcaagttcggcgaggccgtgtggttcaaggccggctcccagatcttcagcgagggcgggctggactacctcgggaacccgagcctcatccacgcgcagagcatccttgctatctgggcctgccaggtcgtgctcatgggcgccgtcgagggctaccgcatcgccggcggcccggctcggcgaggtcgtcgaaccgctctaccccggcggcagcttcgacccgctcggcctcgccgacgacccgaagccttcgccgagctcaaggtcaggagctcaagacggccgcctcgcccatgtctccatgttcggattctcgtccagcatcgtcaccgggaagggccgctcgagacctcgctgaccacatggcgacccgtcacaacacgcttgggctaaggcacactttgtcccgggaaggaaggagg

SEQ ID NO: 75108 - protein, 253 aa, Zea mays
  misc_feature: Ceres CLONE 1559475
  misc_feature (65)..(214): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPARRGRRTALPRRQLRPARPRRRPEAFAELKVRSSRRPPRPCLHVRILVQHRHREGPLETSLTTWRPVTTRLG

SEQ ID NO: 75109 - DNA, 942 bp, Zea mays
  misc_feature: Ceres CLONE 1559477
  misc_feature: Translation starting site: 252
  misc_feature (901)..(901): n is a, c, t, g, unknown, or other
caaagctggagctccccgcggtggcggccgctctagaactagtggatcccccgggctgcaggaattcgtctcacccctagaaaaaacctcggagcccaggatttctaatctaatctaatccaaaacccttcttgtctttgctgcggctgcccgaatgccctgctccatttgcagctagcttagctttggtttcctctgcttctcattctcccgtgcacttccagttcctgcccagctgcagggctgctccaatggccaccttgtccgccatctctgccaacgtcggctactgcaaggcaccaaccctgagctggaagggaagcggagtaccaggccggattgtggtctccatgtccaccacccgaagaggcctcgtctccctaagacgacgatcccctcggtttcgcgtctacgcggcgaaggcggagacggtgagcaaagtgatggacatcgtgaagcagcagctggcgctggcggcggacgtggggctgacggcggagaccaagttcacggacctcggcgccgactcgctggacacggtggagatcgtcatgacgctgggaggaggagttcaagatcaccgtcgaggaggacaatgcccagagcatcgccaccatccaggacgcccccgacctcatcgacaagctcgtcgaccagaagccacgagacagcgactgattgtcgacgcgacgacacccaaatcctatccatcgatcgccgctcgtgcatgtgaatgctccgttattgtactgtaaattgagtatgtttttttttatctctagctagagatatttatggacacagatgggaagagaagagttgatgatacctaccattcgtcatcgatccgttgcaagggttttccatctgttctgggttccatcttcccagccagctaacntaagggtcgccgcgtcctttcgacaacgatggacgaaatct

SEQ ID NO: 75110 - DNA, 896 bp, Zea mays
  misc_feature: Ceres CLONE 1559481
  misc_feature: Encodes the peptide sequence at SEQ ID NO. 75111
  misc_feature (711)..(711): n is a, c, t, g, unknown, or other
ctggagctccccgcggtggcggccgctctagaactagtggatcccccgggctgcaggaattcgtctcacccctagaaaaaaacttctggcctttagacattttctcctccgtagattgcagaagttttttttttcgcttatcagtatttcggtcgagaaattcgcgaagggattaggggaattcgaggcagggatttgcaagaatcagggcagtttgatgttgcttcctgtgcgcgtcgctaatttctctgttttattcgcgtgatttttagggttttattttgagtttttcgttttctccaccgtatttcgttggcttcgttccgtgctactgtaaattcagaatcttgtcagagaaaagagaaggaaaaggaaaaacaaacaaaatagtaaggggaatttggtacctgggtgtttgctgttccttgagttggtgaatctttggagtgcctggctccgacgagatcgaaaggagggacctttccttggttcctctgctggagctgtgattgcagaggtgaaccatgtcagcgatggcggcggcgggtgaagcggaatatggtgaatgcgtgcagaaggggtccctgcagcagcaccaggcgcctcaacccagccccggcgctctattctacacccatgaatgccgtcgccgtctacaggatcccggtcattgccggcgtctaccaacagccgcgggcagcattgtcgtcntgtccgcggctcaaggccagctcattccctggcagctctgacccttcaaggcaagccgggcgccccccagtacccccccaaaacgggccgtgcccttgttttttgccccctggaacccccaagggtggggccagtaccttgaggctcccccgggtcccccggcttcctccagccccaagaggggc

SEQ ID NO: 75111 - protein, 75 aa, Zea mays
  misc_feature: Ceres CLONE 1559481
  misc_feature (63)..(63): Xaa is any aa, unknown, or other
MSAMAAAGEAEYGECVQKGSLQQHQAPQPSPGALFYTHECRRRLQDPGHCRRLPTAAGSIVVXSAAQGQLIPWQL

SEQ ID NO: 75112 - DNA, 986 bp, Zea mays
  misc_feature: Ceres CLONE 1559482
  misc_feature: Encodes the peptide sequence at SEQ ID NO. 75113
  misc_feature (836)..(836): n is a, c, t, g, unknown, or other
  misc_feature (935)..(935): n is a, c, t, g, unknown, or other
  misc_feature (954)..(954): n is a, c, t, g, unknown, or other
  misc_feature (986)..(986): n is a, c, t, g, unknown, or other
ctccccgcggtggcggccgctctagaactagtggatcccccgggctgcaggaattcgtctcacccctagaaaaacttgtcgcagcaagtgatttggctcttgccatggaggtgccgctctccccaccgcgtgcccacgccggcctcctctgctgcagctccactcccgtcgtcctcggcctccgctcccagtccgccaccgctccgagccgccgcgcgcggccactccttgcccgcaggaaccgggacagccggagcgacgaggagaccgcggcggagcccaagatcatcacggtcgggcggccggggaagagcgggcggcggcgcaacaggaagcagcagcagcagcagcagcagacggcggcgaaggaagaagaagaagaagaagaggaggaagatgaggacgaggaggaggagcgtgacgcgacgatcccggaggtggtgacgaaccggatgatgcggcgggtgggcgcgtccgtggggcttccgctggcgctgggcgggggggtgttcccaggggtctactacctgaagggggggggaaaggggaacctgcccacatgggatccccttcggcgtggcggttgttcttcttccgcggcgcgctggccgggggtgaactacggcatctttgtccccccagctgggaccccccccccgggaaggcttccctccccggcctgaaaaaaagaccccccccaactggggccctccttcttgggaatccctcccggggaaccctccccccccccgccggggggagagaaattttgtcccggaaaaaatgggcctctgcattgtggggctgccctgtaaataccccccccaactatatgntgccttttgtttgggggtggggaaagggaggggttcaaaaaaaacaatcctcccctcctctggttccccgcgaggggaatgaaggggcactttcctcgnctccatccactttcactantgtttggatagaagcaagtagctgggacaccn

SEQ ID NO: 75113 - protein, 192 aa, Zea mays
  misc_feature: Ceres CLONE 1559482
MEVPLSPPRAHAGLLCCSSTPVVLGLRSQSATAPSRRARPLLARRNRDSRSDEETAAEPKIITVGRPGKSGRRRNRKQQQQQQQTAAKEEEEEEEEEDEDEEEERDATIPEVVTNRMMRRVGASVGLPLALGGGVFPGVYYLKGGGKGNLPTWDPLRRGGCSSSAARWPGVNYGIFVPPAGTPPPGRLPSPA

SEQ ID NO: 75114 - DNA, 961 bp, Zea mays
  misc_feature: Ceres CLONE 1559484
  misc_feature: Encodes the peptide sequence at SEQ ID NO. 75115
  misc_feature (611)..(611): n is a, c, t, g, unknown, or other
ttggagctccccgcggtggcggccgctctagaactagtggatcccccgggctgcaggaattcgtctcacccctagaaaaaagcagcagccagcagcgggggctggagcactcaccagtcaccactcagcagcgatcgcagcaccgcggcgagataatgagcagcctgtcctccggcatctctgcctcgccatctgcagcgcccagcaccgctcggcgccgccatgacgcagcgccgcagcagctgaggggtgaaggcggcggcgcggccacagctgctgcacgccggccgccggcgttcgagtgtcgggaggaggccgggcggagggtggtgggttgttgagggccgggcctgggccgctgtcggagatcgagccggacctggaggaggacgccatcgacgtgtaccgcaccaacggcatcagcccggaggacttcgagtacgggaagtatgacggacaccacacctatctcgaaggtcaagacaagaagggcttctgggaggatgtctccgagtggtaccaagaagctgagcctcctcagggctttcaagcactcatctcctgggcatttcctcctgcgatcatcctcggcatggctttcaatgtggccnggggagtacctgtacatcggggcggccgtcttcatcgtggtgttctgcgtcatcgagatgggcaagcccgacaagccgcacaactcgagccggagatctacctgaatggagatgtcggcccgcgacaagctcatcgccgactacactccatggacatctgggacttccacgaggaggtacgcgagctctgggacttcacgtcaacacatggacgacatcgtcaagccgacctgatgcgttggatacacggctcgctgcccctcagattgtgcctccaggcaaaaacccggtgaaaggaacggtactgccaggaaatcccttgataaaggaaagcaccctccggtagacgt

SEQ ID NO: 75115 - protein, 88 aa, Zea mays
  misc_feature: Ceres CLONE 1559484
MTDTTPISKVKTRRASGRMSPSGTKKLSLLRAFKHSSPGHFLLRSSSAWLSMWPGEYLYIGAAVFIVVFCVIEMGKPDKPHNSSRRST

SEQ ID NO: 75116 - DNA, 986 bp, Zea mays
  misc_feature: Ceres CLONE 1559485
  misc_feature: Encodes the peptide sequence at SEQ ID NO. 75117
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (776)..(776): n is a, c, t, g, unknown, or other
ctggagctccccgcggtggcggccgctctagaactagtggatcccccgggctgcaggaattcgtctcacccctagaaaaaactccagccattacccgcagctagcaaacaaatggccaccgtcctgagcagcccccgcgcgccggccttctccttctccctccgcgccgcgccagcgcccactaccgtggccatgacccgtggcggtggcgccagcagcaggctgcgcgcgcaggccacctacaacgtgaagctcatcacgccggagggggaggtggagctgcaggtgcccgacgacgtctacatcctggactacgccgaggaggaaggcatcgacctgccctactcctgccgcgcggggtcctgctcctcctgcgccggcaaggtcgtctccggctccgtggaccagtccgaccagagctacctcgacgactgccagatcgccgccggctgggtgctcacctgcgtggcgtaccccacctccgacgtcgtcatcgagacgcacaaggaggatgacccttatctcctaagcaaatttaataaagcaccgccaatttatcacgtcgacttgcaagccccggagaagtagaagatgtcctcaatacctgcctgggccatgaaatttttttgtccccgtttcaaacggtattggtaaacctattacccccgggttttcaaaaattttttaaaaaaatttaacccccgggctagtccttcccttttnnnaaaaaaaatgggagagaagggccaaacaaaagagtaaaaaaaaaaaatatnccccgcccttttcccccttccccccgcgggggggggagaaaatttccccggggggtcccccccaaaaaaagagtttgcccccgcccacaacatttttccttggtggctcccccggggggggggcccaccaaaaaaaatagtgggccggggggaaagaggggagaaacccccccccccccccggggcggggggggaggtctcgctttattt

SEQ ID NO: 75117 - protein, 131 aa, Zea mays
  misc_feature: Ceres CLONE 1559485
  misc_feature (22)..(97): Pfam Name: Fer2 Pfam Description: 2Fe-2S iron-sulfur cluster binding domain
MTRGGGASSRLRAQATYNVKLITPEGEVELQVPDDVYILDYAEEEGIDLPYSCRAGSCSSCAGKVVSGSVDQSDQSYLDDCQIAAGWVLTCVAYPTSDVVIETHKEDDPYLLSKFNKAPPIYHVDLQAPEK

SEQ ID NO: 75118 - DNA, 858 bp, Zea mays
  misc_feature: Ceres CLONE 1559487
  misc_feature (797)..(797): n is a, c, t, g, unknown, or other
ggagctccccgcggtggcggccgctctagaactagtggatcccccgggctgcaggaattcgtctcacccctagaaaaaatccacacacacacaacacagcagagagattactacgatccaacagttctagagcaagagagaggaagacacaccgcagagttagcaggctaataacttgcaggagcagcaggaatggcggcgacgcgtcgcctctcttgccttctcctcgccgtgcttctggcaggagtggccgctgccaccgccttcgacgaagcggctgctgccggcttcgggcttggccacggcgcgcgtttcgcgcgcaagcatggacgagctgccgctgagatgccccagccggagccacaacctaaaactaagccgggagccccatatgcagccactgccccaggcgggaacctaaaccgaaacctatgccccatccagagccaaagcccggaacctcaaccaaagggccaacccttgaaccttaaccaatggccgaggccctttcccaaaaatccaaccccgaacccctttgctttggccgaaaggcgggaccctaagccccaaacctttagccccaaacccggagcccccacccctaaaaatgaggccccagggccaaaaccccgggaatcccaaacccctaacccaaaggccgaaaataaaaaaaattttgtaacccaaaacccaaagggcctaaaccaaataacggggggccctatacccggagaaaaaaacaccccaggccccagagcgcggtgtgcccccaccccccaaaacaggggaggcctgtncgggggggaaccttttctccgcggagaaagaaaacccccggggccccccaactttttgtgt

SEQ ID NO: 75119 - DNA, 954 bp, Zea mays
  misc_feature: Ceres CLONE 1559488
  misc_feature: Encodes the peptide sequence at SEQ ID NO. 75120
  misc_feature (731)..(731): n is a, c, t, g, unknown, or other
  misc_feature (750)..(750): n is a, c, t, g, unknown, or other
ctggagctccccgcggtggcggccgctctagaactagtggatcccccgggctgcaggaattcgtctcacccctagaaaaagagtcctccctcgcctctcaaccactcatcatcgccttcgcaggcatcgccctctcgccgggccgtccgattccgccatggcttccgatgagagcaaaaattcaaaaccagagaagccatcttcagcagctggtgcaggcctccccaatccgtttgatttttcttctatgagcaacttgctcaatgacccatcgataagagagatggctgagcaaattgcaagtgaccctgtgttcaaccagatggctgaacagcttcagaaaagtgctcagggtgctggagaacagggtattcctgcattggatcctcaacagtatatggaaacaatgcaacaagtcatgcaaaaccctcagtttgtgtcaatggcagagcgtcttgggaatgcccttatgcaggatcctgctatgtccagtatgcttgagaacttgaccagtccagctcataaggagcagcttgaggagaggatggcccgtatcaaggaagatccatccttgaagccaattcttgatgagatagagaatgggggtccatctgcaatggtgaagtattggaatgaccctgagggtcttcaaaagattggccaggcaaggggtgttaacttcccggaagatctagtgtgtccactgtgctctctgggcccgagagactgangagaaagggagggatgacnatgagtcattgtcatcacctgccagtgttggtgatgaagaaggtttgaagaagcttttgaacgtgagccaaaagggatgaaaaatgcccagggagacgggcttacctttgcatggggctttggggagtgaatgggcaaaattcccctgagggcggggcccagtgatgcctaaaaaaacaagaaccccgtgccaaatgcgtgggg

SEQ ID NO: 75120 - protein, 190 aa, Zea mays
  misc_feature: Ceres CLONE 1559488
  misc_feature: The sequence is a functional homolog of SEQ ID NO 1839 in the 10/374,780 US patent application
MASDESKNSKPEKPSSAAGAGLPNPFDFSSMSNLLNDPSIREMAEQIASDPVFNQMAEQLQKSAQGAGEQGIPALDPQQYMETMQQVMQNPQFVSMAERLGNALMQDPAMSSMLENLTSPAHKEQLEERMARIKEDPSLKPILDEIENGGPSAMVKYWNDPEGLQKIGQARGVNFPEDLVCPLCSLGPRD

SEQ ID NO: 75121 - DNA, 923 bp, Zea mays
  misc_feature: Ceres CLONE 1559489
  misc_feature: Encodes the peptide sequence at SEQ ID NO. 75122
  misc_feature (701)..(701): n is a, c, t, g, unknown, or other
  misc_feature (746)..(746): n is a, c, t, g, unknown, or other
  misc_feature (751)..(751): n is a, c, t, g, unknown, or other
  misc_feature (753)..(753): n is a, c, t, g, unknown, or other
ctggagctccccgcggtggcggccgctctagaactagtggatcccccgggctgcaggaattcgtctcacccctagaaaaatctcactctcaccgcttgttgcactgctgctggtcgctctcctctcccggctcatcctcgtcctcgccacaaggacgacaaagggtggttctccgtccagtggggacgacgatggccggcgccgactgcctccgtcgccgccagggcttcccctcctcggccacctgcccctcctcctcggctccctgccgcaccgtcgcctccaggcgatggcggcctcgcacggcccggtcgtgctcctgcgcatggggcgcgtgcccacggtggtggcctcctcggcggccgcggcccaggaggtcatgaaggcccgcgacctggcctacgcgagccgccccaggctgcgcatggcggagcgcctcctgtacggccgcgacatggccttcgccccctacggcgagcgctggcgccagacgcgccgcgtctccgtgctccacctcctcagccaccgccgcgtcctctccttccgccgcgcgcgggagcatgaggccgccacgatggtcgcccgcgtcagccgcgcccgcgccgccgtcaacctcaacgccgccctcatagtctacagcagcggcatcatctcgcgcgccgccctcggcgtcaccgacgtccggacctacaggctgcacntgagcggcgtgcgccccagcaaaaagctcacgaagctgtgctacnacttncnagcgcttgcttgggacggtgaactgtgggggaactactgcccttggctggcatgggtcaacacgctgacggcccttcacgccagggggcgcgcacatccggggatatgactctttcctcgaagcggtcattgcagaccacgccaatagccccgtggcgaagaaccccggt

SEQ ID NO: 75122 - protein, 190 aa, Zea mays
  misc_feature: Ceres CLONE 1559489
  misc_feature: SWISSPROT Homolog: EC 1.14.13.68 4-hydroxyphenylacetaldehyde oxime monooxygenase
  misc_feature (138)..(138): Xaa is any aa, unknown, or other
  misc_feature (153)..(153): Xaa is any aa, unknown, or other
  misc_feature (154)..(154): Xaa is any aa, unknown, or other
  misc_feature (155)..(155): Xaa is any aa, unknown, or other
MAASHGPVVLLRMGRVPTVVASSAAAAQEVMKARDLAYASRPRLRMAERLLYGRDMAFAPYGERWRQTRRVSVLHLLSHRRVLSFRRAREHEAATMVARVSRARAAVNLNAALIVYSSGIISRAALGVTDVRTYRLHXSGVRPSKKLTKLCYXXXALAWDGELWGNYCPWLAWVNTLTALHARGRAHPGI

SEQ ID NO: 75123 - DNA, 1010 bp, Zea mays
  misc_feature: Ceres CLONE 1559490
  misc_feature: Encodes the peptide sequence at SEQ ID NO. 75124
  misc_feature (655)..(655): n is a, c, t, g, unknown, or other
  misc_feature (784)..(784): n is a, c, t, g, unknown, or other
  misc_feature (808)..(808): n is a, c, t, g, unknown, or other
  misc_feature (907)..(907): n is a, c, t, g, unknown, or other
ctccccgcggtggcggccgctctagaactagtggatcccccgggctgcaggaattcgtctctccccttgaaaaaaagggcctctcgatcgctcatcagtcgccagaggagttgttgatccaagcgagtgagggtgaaaaaaaagcggcgaacaaaaggcaccatcgtcatggacggcggatactaccgcggcgggtactaccggcggcggtggcgccatcgcgacgccggggtacgctcccgcggtcccgtacgggatgtcgcaagtgaacatccagggcaacggggtgcgggcgggcgctgccccccccaccgaccgtgaaagtgtactgccccgccaaccccaactacgccatgagcgtccgcgacggggaaaggtggtgctggccgcccgcgaacccccaggacgaataccagccctggatcaaggaccatgcggtgggacaccagcatcaaggaacgaggataggttacccgtgcgcttcgccgctggtgaacaaggtcgatccggggtaagccatcaaagcactccgtctggggcagtccccaccccgtgtgccgccctggttgcccttacaaccccgggactttttttgggacgaaattccgttgcttgtgggtacggtataaatgcccgcgtacttccgggccgaacngttttttccgcctgcggtcccgcatggttcaaacataccattctacctttcaacctttcgaacgcccctccaaccgggcgaccagtggggcaacgggcggccgtcccgtgacgggccaccaaacgtcgntggccttccggaaaaagtgttgcnaagggcctacaccctggcgctgggtagatccccagcccctacctcctgaccccatcggatgattttgacatgggggggccctgggattggtgcacttgncttgcatacgtcctagcagaaataactggggcttttcccccccgaggctcctttttgcattgcatgcaccattttccttataaacagggccgaaaaaaagggt

SEQ ID NO: 75124 - protein, 53 aa, Zea mays
  misc_feature: Ceres CLONE 1559490
MSVRDGERWCWPPANPQDEYQPWIKDHAVGHQHQGTRIGYPCASPLVNKVDPG

SEQ ID NO: 75125 - DNA, 944 bp, Zea mays
  misc_feature: Ceres CLONE 1559493
  misc_feature: Encodes the peptide sequence at SEQ ID NO. 75126
  misc_feature (364)..(364): n is a, c, t, g, unknown, or other
  misc_feature (534)..(534): n is a, c, t, g, unknown, or other
ggagctccccgcggtggcggccgctctagaactagtggatcccccgggctgcaggaattcgtctcacccctagaaaaagtcgtacagccccgttcccatagaggacagtctgctgtctgccgcaagcctagcttcgtccaccactgaatcaagaaacaaaacaactaggcatggacgaccgcacctacaagggcggcatcaaggcgtactggaagcgccggggctactaccgcatggacggcgacgccgcgcggcgccgccagccgctccccaccgtggagctcggaagtggcgtcgcccaggcccaggcccaggcccagccgccggcgggggatggctcgggccggcgccgccggtgccgcgngtggcgcgtgcgccgcggccagctggggcggcggctgctccgcgcgctgtcccctcgccggtggctcatgcggctccgcgacgcgtacgtgtccgccatgctgcggctggcctcctcccccgccgtcgggtacggcgccggcgcgcccttctgcgccacggcgacccacngcgcggcggcggcggcggccttcgcgcggccggcgcagctcaaggagtacgacgagaaggcgctgggtggagatctacaggtccatactcgcgcgcggcggggcctctcggcggggcgcctgcccgccgcacgctgcggctaccgacggctgtttgagcttgagcggcagaagagacgtgtgggtcctcttgctatttattcctatgtgtcgcgacttgtactgagttgtaactggcggcgccccacaagctagcgtttcttctccgttccattcgatcatcagtcttatgtaggggcttatgggttgggaatcaaaagtcggttggccgctaaaccagggccagggccccttaaggaaaaagttcaaaagatgaaaaaaacaaatttgctgaaaaaaaaaaaaacggga

SEQ ID NO: 75126 - protein, 205 aa, Zea mays
  misc_feature: Ceres CLONE 1559493
  misc_feature (65)..(65): Xaa is any aa, unknown, or other
  misc_feature (122)..(122): Xaa is any aa, unknown, or other
MDDRTYKGGIKAYWKRRGYYRMDGDAARRRQPLPTVELGSGVAQAQAQAQPPAGDGSGRRRRCRXWRVRRGQLGRRLLRALSPRRWLMRLRDAYVSAMLRLASSPAVGYGAGAPFCATATHXAAAAAAFARPAQLKEYDEKALGGDLQVHTRARRGLSAGRLPAARCGYRRLFELERQKRRVGPLAIYSYVSRLVLSCNWRRPTS

SEQ ID NO: 75127 - DNA, 978 bp, Zea mays
  misc_feature: Ceres CLONE 1559494
  misc_feature: Encodes the peptide sequence at SEQ ID NO. 75128
  misc_feature (740)..(740): n is a, c, t, g, unknown, or other
  misc_feature (743)..(743): n is a, c, t, g, unknown, or other
gctggagctccccgcggtggcggccgctctagaactagtggatcccccgggctgcaggaattcgtctcacccctagaaaaatggaacgtaaaaaaaaaatggcagctccctcgtcgtccctcaccccgccgccgccggcagcggctgtggcctccacaacgctgtccgggaacctcacggcctcctcgctcctgtctattacgccgccgcgaccgcgcctcgccgcctcgcaccgccgggcggtcgtggccgcggccgcgtcgccccgtcccccgccgacaccggagggcgacggcgacgagcaggaggtggagagggcgatggggatggacggtggcatccccgggacctcgggggagtttctgcgccgcgtctcctcccgcgcttacggcatgcggcgccacctcatggagtcgctcgactccctcgcctacgacgtactggagacaaacccatggagagaagattccaagccagtctatgtgctagccacaagcgataaccacctatggacaatgaaaactcgcaggagccgcaatgaagtcgaaagggaacttggaaagcttttctcaaacggagggggttctggagttggaactaaatcgaagtactctggcaccaagtttaacatggttgtcgaagatatcagagagggagtactggtatttgaggatgaagatgatgctgtaaaatactgcaaccttctgcagggcggtggccaaagttgcgagggaattgcnganatagaaacatcatcagttttcagcatgtgcggtaaaatgaaagcccttgctggtcttttccgcccgcgaaaggactcctccattgcctcaaagcctcgagcgcgacttgagggcaagaagagggcactggaaggactagttctgtctgtttaccccgccaaaaaagtgtgaatgtattcctctagctggttggagccatgggccctaggccttgaatcctccaaaggaggcaccc

SEQ ID NO: 75128 - protein, 197 aa, Zea mays
  misc_feature: Ceres CLONE 1559494
  misc_feature (141)..(141): Xaa is any aa, unknown, or other
MGMDGGIPGTSGEFLRRVSSRAYGMRRHLMESLDSLAYDVLETNPWREDSKPVYVLATSDNHLWTMKTRRSRNEVERELGKLFSNGGGSGVGTKSKYSGTKFNMVVEDIREGVLVFEDEDDAVKYCNLLQGGGQSCEGIAXIETSSVFSMCGKMKALAGLFRPRKDSSIASKPRARLEGKKRALEGLVLSVYPAKKV

SEQ ID NO: 75129 - DNA, 901 bp, Zea mays
  misc_feature: Ceres CLONE 1559495
  misc_feature: Encodes the peptide sequence at SEQ ID NO. 75130
  misc_feature (638)..(638): n is a, c, t, g, unknown, or other
ctggagctccccgcggtggcggccgctctagaactagtggatcccccgggctgcaggaattcgtctcacccctagaaaaacttgcaagtatagtctcggcggctctagaatacgatgggcaaggacgacgtgatcgagagcggcgctggcggcggcgagttcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggggtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccgggctactccgcggcacggncctcggcgccgagatcatcggcaccttcgtgctcgtctacaccgtcttttctcgcaccgaccccaagcgcaacgccgcgactcccacgtcccggttctggctcccctcccatcgggctcgccgtggtcatgggtgcactggccacatccccgtcacgggcacgggatcacccggcaggagcctgggcgcgcgtcatctacacaggacagcctgggacacccgggatctctggtgggcctttcggggcctgcatcccgcctcta

SEQ ID NO: 75130 - protein, 262 aa, Zea mays
  misc_feature: Ceres CLONE 1559495
  misc_feature (34)..(255): Pfam Name: MIP Pfam Description: Major intrinsic protein
  misc_feature (175)..(175): Xaa is any aa, unknown, or other
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGLLRGTXLGAEIIGTFVLVYTVFSRTDPKRNAATPTSRFWLPSHRARRGHGCTGHIPVTGTGSPGRSLGARHLHRTAWDTRDLWWAFRGLHPAS

SEQ ID NO: 75131 - DNA, 796 bp, Zea mays
  misc_feature: Ceres CLONE 1559511
  misc_feature (209)..(209): n is a, c, t, g, unknown, or other
  misc_feature (221)..(221): n is a, c, t, g, unknown, or other
  misc_feature (527)..(527): n is a, c, t, g, unknown, or other
ggagctccccgcggtggcggccgctctagaactagtggatcccccgggctgcaggaattcgtctcacccctagaaaaaccccgaggggcccaagctgccgtgcgttggggacaaggaacctctctcctctttagcagctgagtttcagtctggcagccccattttacaagagaaaattaagttgcttgggcgagcaatatggtactttnaagacgtacacngtggagatggaaactgcttttatcgaagctttatgttttcctacctggaacacatcctagagacacaagacaaagctgaggctgatcgcatcatggtaaaaattgaggaatgcaagaaaacactcctctctcttggatatattgagttcacttttgaggacttcttttcgatattcattgaactgctggaaagtgttctgcagggacatgaaactcctatagggcctgaagagctttctagaagaaccagagatcccacaagttttctgattatggttgtcatgtttctttaggggttgtcacttncttgtggaaattcaaaggaggtctgactttctttggaccgttcaaatcttggttgacaaattcaaccgtggtttcagttctgccaggcttctggtgaaacctatggggtgaggaaaagggaccaggggcccactaatggccctaacgaaggcccttggggctaccaatcccgggttaggtacctaaaaccagaactctcgggggacctggggaaacctgaggcgggaattcccccaatttttttccctcgggccaaggaatttggaagg

SEQ ID NO: 75132 - DNA, 875 bp, Zea mays
  misc_feature: Ceres CLONE 1559512
  misc_feature: Encodes the peptide sequence at SEQ ID NO. 75133
  misc_feature (296)..(296): n is a, c, t, g, unknown, or other
  misc_feature (740)..(740): n is a, c, t, g, unknown, or other
  misc_feature (770)..(770): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (865)..(865): n is a, c, t, g, unknown, or other
tggagctccccgcggtggcggccgctctagaactagtggatcccccgggctgcaggaattcgtctcacccctagaaaaagtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcanaagggaggccggcggcggcaaggcggcgctggcgcccgaggaggtggtggcgcggatgcccgcggcgcccagcgaccccgccgccgccgcggccatggtggaccgcatgctccgcctgctcgcctcctacgacgtcgtccggtgccagatggaggaccgggacggccggtacgagcgccgctactccgccgcgcccgtctgcaagtggctcacccccaacgaggacggcgtgtccatggccgccctcgcgctcatgaaccaggacaaggtcctcatggagagctggtactatctcaaggacgcggtgctggacggcggcatcccgttcaacaaggcgtacgggatgacggcgttcgagtaccacgggacggacccgcgcttcaaccgcgtgttcaacgagggcatgaagaaccactcggtgatcatcaccaagaagctgctggnacttctacacgggcttcgagggctgtcacnctgttgacctagnnnnnnnnnnnnnnnnnntttgcccccccacctttccaccccattcaggtcccgccaacccgcaaaaatctccgggggtcaancttcgaaacc

SEQ ID NO: 75133 - protein, 141 aa, Zea mays
  misc_feature: Ceres CLONE 1559512
  misc_feature (32)..(142): Pfam Name: Methyltransf_2 Pfam Description: O-methyltransferase
  misc_feature: SWISSPROT Homolog: EC 2.1.1.68 Caffeate O-methyltransferase
  misc_feature (130)..(130): Xaa is any aa, unknown, or other
  misc_feature (140)..(140): Xaa is any aa, unknown, or other
MPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDPRFNRVFNEGMKNHSVIITKKLLXLLHGLRGLSXC

SEQ ID NO: 75134 - DNA, 857 bp, Zea mays
  misc_feature: Ceres CLONE 1559514
  misc_feature: Encodes the peptide sequence at SEQ ID NO. 75135
  misc_feature (678)..(678): n is a, c, t, g, unknown, or other
  misc_feature (800)..(800): n is a, c, t, g, unknown, or other
  misc_feature (803)..(803): n is a, c, t, g, unknown, or other
  misc_feature (806)..(806): n is a, c, t, g, unknown, or other
  misc_feature (807)..(807): n is a, c, t, g, unknown, or other
  misc_feature (815)..(815): n is a, c, t, g, unknown, or other
  misc_feature (836)..(836): n is a, c, t, g, unknown, or other
ctccccgcggtggcggccgctctagaactagtggatcccccgggctgcaggaattcgtctcacccctagaaaaaatccagaccaccattaccagagtgctctgctctcgctggaggccgtggttcattcacgctcatggaggccgccgccattcccaccagtgccccggaaaccaggattgccgttgtcaccggcggcaacaaaggcatcgggctagaggtgtgccggcagctggccggcgccggcgccggcgccaccgtcgtcgtcttaacagccagggacgagacgaggggtgcagccgctgcagaagagctcagagaatctgggctctccaatgtcatcttccatcagctggacatcaccgacgctgcgagcgtcagtcggctggctgagttcctcaaggctcgttttggaaagctagatatcctggtaaataatgccgcagttggtgctgttgagtacgtccaagatcctgctgacggtgcaacgagcgaggaagagctgagtggcatggacatggaccaaaggcttcagtgcatgtttaagagagtccgggagacctacgacgctgcgacagaaggcatcaagacaaactactatggcataaagcatgtgatcgaagccttgctgcctctgcttcaagcttcctccggatgggaggatcgttaacgtctcctnctgagttcggcctgctaaggctgatcaacaacgaggagctaaggcaggagctaaacgacgtggagaagctcaccgaggagaggctgggacgaggtgcttggccgcgtacctgagagacttcnacnccnngcaaggtngggggcgccccggttggcccngtggacttcttcggcctacaa

SEQ ID NO: 75135 - protein, 177 aa, Zea mays
  misc_feature: Ceres CLONE 1559514
  misc_feature (14)..(140): Pfam Name: adh_short Pfam Description: short chain dehydrogenase
  misc_feature: SWISSPROT Homolog: EC 1.1.1.184 Carbonyl reductase (NADPH)
MEAAAIPTSAPETRIAVVTGGNKGIGLEVCRQLAGAGAGATVVVLTARDETRGAAAAEELRESGLSNVIFHQLDITDAASVSRLAEFLKARFGKLDILVNNAAVGAVEYVQDPADGATSEEELSGMDMDQRLQCMFKRVRETYDAATEGIKTNYYGIKHVIEALLPLLQASSGWEDR

SEQ ID NO: 75136 - DNA, 1811 bp, Zea mays
  misc_feature: Ceres CLONE 1559517
  misc_feature: Encodes the peptide sequence at SEQ ID NO. 75137
aagccagaaaagtctcctcttccttgctccgttcatccgcccctcaccgtcgcccaatctcacatggctcggcgtctccacggccaactccagctccagctcttcctcccggttcctcctcgccgccccctccgacgacgcctccctctgtcggatccaccgctgaccgcgcgccgctacgcctgcgcctgatcaccggctggttcttggcctcttcgcttcctggaccgcccagacgtctccatgggcaagagtaagaggaacaagggcggtcgaggtggtggtggtgccgatgacaagcttgacggtggtggcgatgccgatagcgtgacctccatgtccagtgggctgtctgaccttcagttcgcgcaggccacagagcatattagctcgcaggaattcgttcttgacaagtacgtcgacgctctctatgagaagaggggatccacaagagaggaagcattgggctctcttaccgatgcttttgaaagttttgtgcttcttggtttagtggaaaacaaatatgtcacactattgagccagttcatcaattcaattaaaaggggatctgtaaaagaggtgtgtctggcttgtcgctgcattggcttactggcaattacactaggtgctggaagtagttcgcacgaaataatggatgagtcacatccacatcttttgagagttctccaaacttggcctgacgcacaaaagatgatctctgcacttgattgcttagcagttgtcacatttgttggtgcaactgatcttgctgaaactcagctgtctctgaaagccatctgggatgtgatccatccaaaatcaggatcaaatgtcggcgtagtcagaaaaccgaagcctcctttgttagcagctgccgtatctgcatgggcatttcttttaacaactattggttcatctagaagaaatactgattcttggaaagagccaattacatttctctgtagccttctagaagcagaggaccgtgctgtgcggattgctgctggtgaagcattagctctgtgttttgagctaagaatgtttgatgtttcctctagtgacgaagctgatgttgacagttacactggagaggctggtggttctaagcatcaacttttcttgaatatgcaagcattgaaggccaaactatctggtctagtctatagtctatctatggaggcggggggcaggggtgctgacaagaaaaatcttaatgatcagagagacctgttccaacgaatctcagattttattaagagtggtgagtgccctgaagaatcacttaggatttcaggcaagaatggcattttaagagttacatcatggcgtgaatcaatacagttgaactatatgaggcggtttcttgggcggggattcctgaagcattcacaggacaacgatttgctgcatgaggtctttgacatcaaaattgatcgtactgaaaacatgtcagccaccgaaaagaaaatgttcagatctggagaagagaaaggaagagctctgaagttgaataaagagcgtcgtctagctcaggagaggaagcagcagaatatcttgaacgagcaatatggatagaacctacccggaagactggagttttgtacagtggaactgttaccagatggtgagtgctgtgtgtgtatgtgacgctattgatgcatttgaggtgtattgctccggtggcggtactacagcgacatgtttgaaattgctccgaaatactattgagttttgtggcaaaaaaaaaaaaaaaaaaaaaaaaaaacaaaaaacaaaaaaacaaaaaaaaaaaagaaaaaaaaaaaaaaaaa

SEQ ID NO: 75137 - protein, 443 aa, Zea mays
  misc_feature: Ceres CLONE 1559517
  misc_feature (24)..(338): Pfam Name: IFRD Pfam Description: Interferon-related developmental regulator (IFRD)
MGKSKRNKGGRGGGGADDKLDGGGDADSVTSMSSGLSDLQFAQATEHISSQEFVLDKYVDALYEKRGSTREEALGSLTDAFESFVLLGLVENKYVTLLSQFINSIKRGSVKEVCLACRCIGLLAITLGAGSSSHEIMDESHPHLLRVLQTWPDAQKMISALDCLAVVTFVGATDLAETQLSLKAIWDVIHPKSGSNVGVVRKPKPPLLAAAVSAWAFLLTTIGSSRRNTDSWKEPITFLCSLLEAEDRAVRIAAGEALALCFELRMFDVSSSDEADVDSYTGEAGGSKHQLFLNMQALKAKLSGLVYSLSMEAGGRGADKKNLNDQRDLFQRISDFIKSGECPEESLRISGKNGILRVTSWRESIQLNYMRRFLGRGFLKHSQDNDLLHEVFDIKIDRTENMSATEKKMFRSGEEKGRALKLNKERRLAQERKQQNILNEQYG

SEQ ID NO: 75138 - DNA, 834 bp, Zea mays
  misc_feature: Ceres CLONE 1559521
  misc_feature: Translation starting site: 204
  misc_feature (645)..(645): n is a, c, t, g, unknown, or other
ctggagctccccgcggtggcggccgctctagaactagtggatcccccgggctgcaggaattcgtctcacccctagaaaaaagcccatccatccaatacgcccaccagccaccacacatcctctctccctcccagtcccaggagcgtggcctcactctcctcgtcgcatcccctctcctcatcttcaaagcgcgggcggcggcaatggcgatggcctccacctacgcgccgggcggaggcgcgggggcgctcgcgcagggaagatgcagggtccgcggtcccgcggggctgggcttcctcggcccctccaaggccgccggcctcccccgccccctcgccctcgccaggcggacgagcagccccgtcgcggtgggcgccaggctgcgatgcgcggcgtcgtcgtcccccgcggcggcgcggcccgccacggcgccgcgcttcatccagcacaagaaggaggccttctggttctaccgcttcctctccatcgtgtacgaacacgtcatcaacccgggccactggactgaggacatgcgcgacgacgcgctggaacctcgcgaactcttcagcccgcacctcacggtcgtcgacgtcggcggcggcacgggggttcaccacgctcgggatcgttcagcacgtcaacccngaaaacgttacgctgcttgaccaagtcccggaaccatttgaacaaggccgggaaaaaggaggccctcaagggggggcaccttcatggaagggggaaccccaaggacctcccgttcccccccgaattcttttgaaccaaaaattttcggccgggaaatatgaattattgccccaaacccaaggccggggg

SEQ ID NO: 75139 - DNA, 857 bp, Zea mays
  misc_feature: Ceres CLONE 1559522
  misc_feature: Encodes the peptide sequence at SEQ ID NO. 75140
ctggagctccccgcggtggcggccgctctagaactagtggatcccccgggctgcaggaattcgtctcacccctagaaaaaacccggccaccccgcccgccccagtctggcagcctgcctccatagtccatctcctctccccctaccgacaccgatcccattccccaggcccaagcgcccatggatcccaagcccgacgccagcgcgcccgccgcggtgccagcggagcacgcggcgtacccgaggctgtcaccggaggacatcgccccgccgccgccgcctgtcgtgccgccgtccggcgccgacccctacgtgctctccgccccgtcgcctaacccgcccgccaagagcgctagggagaatctgagggagatgttcggcatggtggggaagaagttcaacgaggccgcgcgcaagaccgagggcatcgccggcgacgtctggcagcatctgaaaactggacccagcatcactgatactgccatggggaggattgctcagatatccaaggttatatctgagggtggctacgacaagatatttcagcagacttttgagtgctcgcctgatgagaagctcaacaaggcatatgtgtgctacctatcaacgtcgcgtggaccaatcatgggcgtccagtatctctcgactgtcaagattgcattcgggagcgacagccctgtgatatatgtgactgagaacaactaaactgagtcgtccttatgataggctgtctgactccttcatcacctgagatcggttactcccgcagcgagtcagcataaccctgcagagatgtacattcaggatcgtttcagtctacaactacgagtgctgggttcatgggtttcgtgaactact

SEQ ID NO: 75140 - protein, 174 aa, Zea mays
  misc_feature: Ceres CLONE 1559522
MDPKPDASAPAAVPAEHAAYPRLSPEDIAPPPPPVVPPSGADPYVLSAPSPNPPAKSARENLREMFGMVGKKFNEAARKTEGIAGDVWQHLKTGPSITDTAMGRIAQISKVISEGGYDKIFQQTFECSPDEKLNKAYVCYLSTSRGPIMGVQYLSTVKIAFGSDSPVIYVTENN

SEQ ID NO: 75141 - DNA, 1030 bp, Zea mays
  misc_feature: Ceres CLONE 1559523
  misc_feature (1030)..(1030): n is a, c, t, g, unknown, or other
ctggagctcaccgcggtggcggccgctctagactagtggatcccccgggctgcaggaattcgtctcacccctagaaaaaacggggccaccccgcccgccccagtcgggcagcctgcctgccatagcccatctccgctccccctaccgacaccgatcccattccccaggcccaagcgcccatggatcccaatcccgacaccagcccgcccgccgcggtgccagcagagcacgcggcgtacccgacgctgtcactggaggacatcaaggacgtcagcaccggctgttgggccgccgtcctacggcggacccccacatgctaacaaccccgttgccgcagcaccatagctattggacgggggaaaagagcgccctgaacctcatgcagaatcagtaaaaggacccccccccccggcagatggggcccaccacgcgtcggccggcagactgtgcgaagactcaggggacgtgggggggcggtcagggcacctcttctggaccggcagggaggatgcgtcctcgagaggctaaaggagcgggggtggtatcctcttacgcgacgtagcggggcatgtagctaacgaccctgcggtaagagaaacaatatgggcagagggacaaggggtaccatggcaaaacagggggcggcacggcggggttgggttgtattcgcacagagtgaataaacgaagcgctgagcatgtgcgcgggtctgttctggggcgggcctgtttagaggggtagacactaaacgtggcggccccccacgggaaggacaccgggtgggagttatggtaggcggggtgctctaattccggtcgggttggtattgttgggtcggcggggccgccacccgtcggcgaatagacacatatacgcgggcaagggtgagctatggattttgtacccaaacagcggtactgatggttacgcagaatacgtcgcaagacggctagtaataatgagcggccgcccgcgttttagccacctcgagatgagcgcccgtatctttcgtgttcgcccccagagattn

SEQ ID NO: 75142 - DNA, 799 bp, Zea mays
  misc_feature: Ceres CLONE 1559527
  misc_feature: Encodes the peptide sequence at SEQ ID NO. 75143
  misc_feature (553)..(553): n is a, c, t, g, unknown, or other
gctggagctcaccgcggtggcggccgctctagaactagtggatcccccgggctgcaggaattcgtctcacccctagaaaaattcctccccaacacgccgccgtcttctgcggttctgccgtttactcctccactttggcctcctcacttgcaagtttaatcttcgcctccagccatgggtaaggagaagtctcacatcaacattgtggttattggccacgtcgactctggcaagtcgacaaccaccggccacctgatctacaagcttggaggcattgacaagcgtgtgatcgagaggtttgagaaggaggccgctgaaatgaacaagcggtcctttaagtatgcttgggtgcttgacaagctcaaggctgagcgtgagaggggtatcaccattgatattgctctgtggaagtttgagaccaccaagtactattgcaccgttattgatgcccctggacaccgtgactttatcaagacatgatcactggtacctccaggctgactgtgctgtccttatcatgactccacactggtggttttgaggctgtatctcnaagatggcagacacgtgagcatgctctctttgcgtcacactggaatgagcagatgatttgctgctgcaacaagaatgatgcaacacctccaatacctcaaggcccttattgataaaaattttaaaggaatttcttcttaccttaaaaaagttggggtacaaccctgaaaaaaaaaccatttggttccccatcccgggttttaaggggtgaaaacctgtattgaaagggccccccacctttgaaggg

SEQ ID NO: 75143 - protein, 101 aa, Zea mays
  misc_feature: Ceres CLONE 1559527
  misc_feature (5)..(102): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKT

SEQ ID NO: 75144 - DNA, 758 bp, Zea mays
  misc_feature: Ceres CLONE 1559530
  misc_feature (250)..(250): n is a, c, t, g, unknown, or other
  misc_feature (301)..(301): n is a, c, t, g, unknown, or other
  misc_feature (570)..(570): n is a, c, t, g, unknown, or other
  misc_feature (574)..(574): n is a, c, t, g, unknown, or other
  misc_feature (575)..(575): n is a, c, t, g, unknown, or other
  misc_feature (578)..(578): n is a, c, t, g, unknown, or other
  misc_feature (665)..(665): n is a, c, t, g, unknown, or other
  misc_feature (680)..(680): n is a, c, t, g, unknown, or other
  misc_feature (712)..(712): n is a, c, t, g, unknown, or other
  misc_feature (729)..(729): n is a, c, t, g, unknown, or other
agctccccgcggtggcggccgctctagaactagtggatcccccgggctgcaggaattcgtctcacccctagaaaaaatccgcatccgcataaatcccagtcaaattgaacgagagcgccactcccctctgctaatcccagtcaaatcgaagcaagcatggccatggcggccgtgggcgtgggcggcgcagtggcgttcctcctcccgcagcgccgccaggggcgcccgtcccctgaagtcgcgggcggcngcgggcccccttgccgtgcccccgtctacaagcccgggtggggcttatgcnaaccaaggtggggaaaatgaccacttttcatcccgaaaaaggaaaacccgggcccgggaaaacgggtttggttttccgggggggggggaaaatgtggtcccaccccggggaaaaaaaagccccccccccgggggggggaaaaaacccccccccccgggggtgtggaaacccacggggggggggggaaaaaaagaaaaaacacccccccccccccggaggggggggccccccccttggagagggggggggggggccccccccccccccgntttnnttnttaaaaagagagaaagagttttttttttctcccccccccaaacaaaatattatttttttggggggggggccgccccccccccccctntttttttttttcttntttttggggggggggggggggggggggggggnttttttttctctttttnggtttgtgggtcctcccccacccgggggg

SEQ ID NO: 75145 - DNA, 860 bp, Zea mays
  misc_feature: Ceres CLONE 1559531
  misc_feature: Translation starting site: 360
  misc_feature (399)..(399): n is a, c, t, g, unknown, or other
  misc_feature (789)..(789): n is a, c, t, g, unknown, or other
gctggagctcaccgcggtggcggccgctctagaactagtggatcccccgggctgcaggaattcgtctcacccctagaaaaacagagtcccagctccctcactctactctggacgcgactcgaacttaaaccctagagccgcagccccggtcgctccaccgaccccaaatctcaaatcagcgggagggaactcgcacgcgaaggctgaactcatggctcgcgtctacgttgggaacctggatccgcgtgtcacggcgcgggagatcgaggacgagttccggatgtttggggttctgaggagtgtatgggttgctaggaaaccaccagggtttgccttcattgactttgatgaccgcagggatgcacaagatgccattcgtgaattggatggtaagaatgngttggagggttgagctgtcaactaaagttggtggtggccgtggccgagaccgtaacggttctgatatgaagtgctatgagtgtggtgaagctggccactttgcacgtgaatgccgcttacggattggttcaggaggcttgggtagtggaaggcgtcgcagccgaagtcctagatatcgcagccgcagccgcagccgcagccgcagcccaagatatcgaaggagcccaagctatagcagaagcccgcgagatcgttctcctaggaggcgaagttacagcaggtcgccactgggatctcctgcacggagtctcagcaggtcaccgccgctgcccgccgctcctcccagaaatacagcaggtcaccacctggagcccgagaaatgagcaggtngccgccgccacctcctccagaaataaagcaggtcaccaccggcagccccagacgtgagcagggtcacaccc

SEQ ID NO: 75146 - DNA, 859 bp, Zea mays
  misc_feature: Ceres CLONE 1559543
  misc_feature: Encodes the peptide sequence at SEQ ID NO. 75147
  misc_feature (400)..(400): n is a, c, t, g, unknown, or other
ctccccgcggtggcggccgctctagaactagtggatcccccgggctgcaggaattcgtctcacccctagaaaaaaaccccgcgcgcgggggagcgataaaccctagtcttcgccgtcgtcgcaggaggacccgcgatgtcgcacttcgggaggtcaggcccgccggacatccgcgacaccttctcgctcctcgtcctcaacatcagcttccgcaccacggccgacgacctcttcccgctcttcgagcgctacggcaaggtcgtcgacgtcttcatcccgagggacaggaggaccggggactcgaggggtttcgcgttcgtgcggtacaagtacgccgacgaggcgcagaaggctatagatcggctcgatggccgtgatgtggatgggagaaacatcaccntgcagtttgcaaagtacggccccaatgctgagccaatccgcaaaggaagggttaaagagggggttgagaaatcacaagacagatcaagaagccgcagtccaaggccaaggcacagagacagagatcatagaagccaaagtcgcagcaggagcagagaaaggcatgtccgtgatagagacaggggctatcgtcgtcggagcagaagtagaagccgaagtcttagttcaagccctgacaacagaagtcatcatagagcaagagatgatgataagcgcaagagtatgagtaagagcaggagcagggagcacagtagaagccgctcatactatagtgcttcacctgcccggcacagtgctagccctcgcaagagcccacggcacagaggagccccacttctgcaaacatgccaatgggaaagtaccacctctgtcacgctgggtttctccattaccgaagcgg

SEQ ID NO: 75147 - protein, 241 aa, Zea mays
  misc_feature: Ceres CLONE 1559543
  misc_feature (18)..(89): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (89)..(89): Xaa is any aa, unknown, or other
MSHFGRSGPPDIRDTFSLLVLNISFRTTADDLFPLFERYGKVVDVFIPRDRRTGDSRGFAFVRYKYADEAQKAIDRLDGRDVDGRNITXQFAKYGPNAEPIRKGRVKEGVEKSQDRSRSRSPRPRHRDRDHRSQSRSRSRERHVRDRDRGYRRRSRSRSRSLSSSPDNRSHHRARDDDKRKSMSKSRSREHSRSRSYYSASPARHSASPRKSPRHRGAPLLQTCQWESTTSVTLGFSITEA

SEQ ID NO: 75148 - DNA, 767 bp, Zea mays
  misc_feature: Ceres CLONE 1559544
  misc_feature: Translation starting site: 413
  misc_feature: SWISSPROT Homolog: EC 4.1.2.13 Fructose-bisphosphate aldolase
  misc_feature (595)..(595): n is a, c, t, g, unknown, or other
ctgggctccccgcggtggcggccgctctagaactagtggatcccccgggctgcaggaattcgtctcacccctagaaaaaaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatgggtcgtcgcgccctcgccctacgcgatgagctcgtgaagaccgcgaaaacgatcgcgtcgccggggcgggggcatcctggcgatggacgagtcgaacgcgacgtgcgggaaagcgctggcgtccatcgggctggagaaaacggaagccaaccggcaggcgtaccgcacgctgctggttcacgggcccgggcctggggcaatataatttccgggggcattcttcttcaaaggaaaccttgtaacagtcccccgttcgacgggcgcnaaaaattgggaaattctgggcggaaacagggaattctgcccggggaaacaaggggggaaaaggggccttttttcccctttcccggggtcacaaaaaaaaaatttgtgggtgcccagggctttgaaaaggccttggggttccccccggggaggcgcccctttataatcgaggg

SEQ ID NO: 75149 - DNA, 726 bp, Zea mays
  misc_feature: Ceres CLONE 1559545
  misc_feature: Translation starting site: 185
ctggagctcaccgcggtggcggccgctctagaactagtggatcccccgggctgcaggaattcgtctcacccctagaaaaatacacagcaaagcctcaaaacctgatcatcagagaaacgaaaaggaagaggtgagcgtgggagaaaaaacaaaagaaaggaaaagagatatagccctgagaagaatgtcccttacaactgatgaactcaaggccaaggccgaggtatactacggtgacgagatctgccagctgtgtacccagctcctggcttcagggaagcaggcctccccaatggcctgcttccattgaaggacctaatcgagtgcggctatgtccaggaaactggattcgtgtggctgaagcaaagcaacagggttgaccacatcttccatagtctaggaaggctggtctcttacggcacggagatcaccggctatgccgagaagggcaggatcaggaaggtcaaagggataaagacctaggagctcatgctgtgggtcccggtgggagaagaatgctcttgatgatgatccagcgactggggaagcttgtctgcaagaagcattgcctgggatttaccaaaaaccttcccctggcatccggcttttcccatattcccccgaagaaaggaacaaacaaatgttaaaaggccaaaacttgttgccttcaacttgaaaaccccgggttgggtcccctccattgggaggaaaaagccttccccccca

SEQ ID NO: 75150 - DNA, 778 bp, Zea mays
  misc_feature: Ceres CLONE 1559549
  misc_feature: Encodes the peptide sequence at SEQ ID NO. 75151
gctggagctccccgcggtggcggccgctctagaactagtggatcccccgggctgcaggaattcgtctcacccctagaaaaagtaacctctttgataggctaacaagggttgtcaggtcctacgcaaatgcagttctaagttcgtttgaagaccctgagaagattctagaccaggcagttctggagatgaatgatgacttgacaaagatgcggcaggccactgcacaggtcttggcatctcaaaagcggcttgagaatagatctaaagctgcagaacaagcttctgctgattggtatcggagggctcaacttgctcttcaaaagggtgacgaggatcttgctcgtgaagcccttaagcggcgtaaatcatatgctgacaatgcaagctccttaagatcccagcttgatcagcagaagggtgtagttgaaaatctgatttcaaatacccggcttcttgagagcagatatcagaggcccagcagaaaaaggatacccctaaagctcgtgcttcatcagcaaagactgctaccaaagtgagtgaaatgttggggcaacgttgaatcccaaatagcggcccttttctgccttttggagaaatggggggaaaaaaatttttgggggatgggaatccccaagggcaaagggccccccgcgcccccttttggccccccggggtgatttttttaaaaagaagaaaaaattttttcccccccccctttttaaaaaaaaacaacaaccacccttgtggtggggggggggggagagagaaaaaaaaaaat

SEQ ID NO: 75151 - protein, 116 aa, Zea mays
  misc_feature: Ceres CLONE 1559549
MNDDLTKMRQATAQVLASQKRLENRSKAAEQASADWYRRAQLALQKGDEDLAREALKRRKSYADNASSLRSQLDQQKGVVENLISNTRLLESRYQRPSRKRIPLKLVLHQQRLLPK

SEQ ID NO: 75152 - DNA, 610 bp, Zea mays
  misc_feature: Ceres CLONE 1559551
  misc_feature: Encodes the peptide sequence at SEQ ID NO. 75153
  misc_feature (294)..(294): n is a, c, t, g, unknown, or other
ctggagctccccgcggtggcggccgctctagaactagtggatcccccgggctgcaggaattcgtctcacccctagaaaaatgccatttcgcttccattggtgtccgtttgggcgcttaacccaacttccatctttatttgaggaaggagaatcatcacctccagttacatttcatgacttcatgggacaacatgtgtttacggagcaagtagctgtatctgctgcagcagggacaactaatccttgcccctatgtggcatacttgcatccgtcttacaccatttgacgtcatcngtcaagctccccatgtcccctgaacagaaactatgggattcgtccttgcatacccatggatcatttgggaacccccaatgggcttgggcccaatcaaaaaggttaaggggtccaatggcaaaaccaaatggcaaccccgggggtgaaattttttccatccaaaaaaccccctttggggggcacccatgggggccccccccattttttttaagggggggccaaaacccccaaaaaaggggaaataaaaaagggggggcccgccccccccggggaaaaaacccccccctttttttgggggaaaaccaaaaaggggggc

SEQ ID NO: 75153 - protein, 68 aa, Zea mays
  misc_feature: Ceres CLONE 1559551
MPFRFHWCPFGRLTQLPSLFEEGESSPPVTFHDFMGQHVFTEQVAVSAAAGTTNPCPYVAYLHPSYTI

SEQ ID NO: 75154 - DNA, 765 bp, Zea mays
  misc_feature: Ceres CLONE 1559555
  misc_feature: Encodes the peptide sequence at SEQ ID NO. 75155
ctggagctccccgcggtggcggccgctctagaactagtggatcccccgggctgcaggaattcgtctcacccctagaactggcgcttttcccacgagcgccccctgcccttctcgctctcctccataggcagacgccgcgctcccccaacgccgctccgccgaccccagtcatatctcccgcccccagctgaggcaatggggtcctcgtcctcgccgtcgccgccgccgccgcccatgatcgggcgggccgggaacctcaccgtcttcatcacgccgccgtctcctgctagcacgccgcggggcgctttgcgcacgccgccgcccgagtctccgcgctcggatttctctacacccacccgacagaggatagccccgtcgccctccccttctccctcgccgcagaaacacgagagcccgttcgcggcgcctgcggtggtgttcaccccgcccccgccgtcggctcctgtgaaggtcgcgccgccgccggtgcaggtgccgccgccgcagtacgagaaggcgtccgcggggagcaagcacgacggatcggcgtttgggcttcttcgggggaagccctccccgccgttcccgaaaagggaacgcccacctttgaagaaaaacagggggtcccccggtgtgggggggggagaaaaccccaaaaacccccggggggggcttccaccccctcttttagggggcccccctaaaaaaaaattttttttttttttaagggggggtaaaactttaaggggtccctcctcttagggg

SEQ ID NO: 75155 - protein, 175 aa, Zea mays
  misc_feature: Ceres CLONE 1559555
MIGRAGNLTVFITPPSPASTPRGALRTPPPESPRSDFSTPTRQRIAPSPSPSPSPQKHESPFAAPAVVFTPPPPSAPVKVAPPPVQVPPPQYEKASAGSKHDGSAFGLLRGKPSPPFPKRERPPLKKNRGSPGVGGGENPKNPRGGLPPPLLGGPPKKKFFFFLRGGKTLRGPSS

SEQ ID NO: 75156 - DNA, 860 bp, Zea mays
  misc_feature: Ceres CLONE 1559556
  misc_feature: Encodes the peptide sequence at SEQ ID NO. 75157
  misc_feature (305)..(305): n is a, c, t, g, unknown, or other
  misc_feature (321)..(321): n is a, c, t, g, unknown, or other
  misc_feature (322)..(322): n is a, c, t, g, unknown, or other
  misc_feature (328)..(328): n is a, c, t, g, unknown, or other
ctggagctccccgcggtggcggccgctctagaactagtggatcccccgggctgcaggaattcgtctcacccctagaaaaactctttccccaatccgttcaacgacggcttcaggaaccctttttccggcggccgccacaacgagcctcgggcaccgcaaagcaaatcctatcctatcagtcggatcgtgcgtctcgtcgagcctcgatcctatccccgccacgccgatccctcgtcggtcgtccgaatctggtggactatctccatcgccgggcgttcatttttggcccggtgagccgggggtgnggggggtggggtattnntggtgncgtgagttgctgctcccgcccgtcgatgcttggttagcagaagagacggcggcggtaccatgttgcagtgcctggatggagtgaagcagctccttggcgtgctcctcaagtgctgccacatcgacctcaagcagcccaacggcctagaggatccggaggtgctcgctagggagaccgtgtttagcgtgagcgaggtcgaggcattgtatgagctgttcaagaagatcagcagtgctgtgattgatgatgggctgatcacaaggaggagtttcagttggcgctgttcaagactaataagaaggaaagtttgtttgctgatcgggtatttgactttatttgatcaaaacacaatgggaatccttggatttggaggatttgctcggggggctctcagaatttcatccccaacgctccctttggatgagaaaattgagtttttcattccaacttttatgacctccagcaacaaaggctttccttgaaagaaaggagggaaaacaaaagggttggtggcctccctttggggaagtcc

SEQ ID NO: 75157 - protein, 140 aa, Zea mays
  misc_feature: Ceres CLONE 1559556
MLQCLDGVKQLLGVLLKCCHIDLKQPNGLEDPEVLARETVFSVSEVEALYELFKKISSAVIDDGLITRRSFSWRCSRLIRRKVCLLIGYLTLFDQNTMGILGFGGFARGALRISSPTLPLDEKIEFFIPTFMTSSNKGFP

SEQ ID NO: 75158 - DNA, 803 bp, Zea mays
  misc_feature: Ceres CLONE 1559561
  misc_feature: Translation starting site: 120
ctggagctcaccgcggtggcggccgctctagaactagtggatcccccgggctgcaggaattcgtctcacccctagaaaaagccggttgctttcgcttcgccggagaagagctgagcgcgatggcagcggcgcaggaggaagcggcggcggcgccgccgagcacggagagcgatgctaccgagacggaggaggcaccaccaggcggcgcggagagcgatgctacggcgatggaagcggcggcggagtactcgtggctccagctccgcttcgaccgcccccctcgccggctctaccacttcgcccgccagttccgctccgccacttcctctggcagcaatagtagcggcgagaacttcctcaagggcgtaaagtggtcgcccgacgggtcctccttcctcaccagctccgacgataactccctccgcttgttttacttaccggaaggaagcgtacattgcggcggagcccgttgccgaggccgctgtcgaaagtgaagattcttatggagctttcattcaggcgaacgagggtgagccagtgtacgatttctgctggtacccgtgtatgtccttgtctgacccagccacttgtgtatttgcaagcaccagtcgtgatcatccgatacacctttgggatgccaccgtgggggaactccggtgcacatacggagcatatgatgccatgaatgaaatacctgctgcacctttcgatttctttcattttctcagggatctaagctatttgctgggatacacaaagcttttaaaatggtttggaggttcaaccggcctggccgaaaaatt

SEQ ID NO: 75159 - DNA, 766 bp, Zea mays
  misc_feature: Ceres CLONE 1559562
  misc_feature: Encodes the peptide sequence at SEQ ID NO. 75160
  misc_feature (577)..(577): n is a, c, t, g, unknown, or other
tggagctccccgcggtggcggccgctctagaactagtggatcccccgggctgcaggaattcgtctcacccctagaaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacntcggcaacccgagcctgatccacgcgcagagcatcctcgccatctgggcctggcagggtcgtgctcatgggcgccatcgagggggaaccgggtcgccgggcggcccgctgggaagaagtggtcgaacccgttttaacccgggggggaaggtttcaacccggtttgggccttcgccaaagaaaccctgaa

SEQ ID NO: 75160 - protein, 207 aa, Zea mays
  misc_feature: Ceres CLONE 1559562
  misc_feature (64)..(200): Pfam Name: Chloroa_b-bind Pfam Description: Chlorophyll A-B binding protein
  misc_feature (146)..(146): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYXGNPSLIHAQSILAIWAWQGRAHGRHRGGTGSPGGPLGRSGRTRFNPGGKVSTRFGPSPKKP

SEQ ID NO: 75161 - DNA, 840 bp, Zea mays
  misc_feature: Ceres CLONE 1559573
ctggagctcaccgcggtggcggccgctctagaactagtggatcccccgggctgcaggaattcgtctcacccctagaaaaactgctctaggggctaaggtctggcttgctgagctggagctgatggatctagggtttgggttgcggtgatggtcctgcatcgccggaggagctcatggcggaagctccggccagccctggccgctgcggccggagccactagagtgggagccccatgggaggcggaggcggtggcagcttcatggaggaggacacgttcctgcccatcggtcatacatcgctcgcatcctgaagaaggtcatcccgagctaacgggaagatcgccaaggacgctaaggcagaccatgtctgcagagcatctccgagtgtatctccgtcactcactagcgaagcgagtgacgagtgccacagggagaagcggaagaccatcaatggctcacgatctgctgtggagcatggccacgctggggtttcaagactacgttgaacccctcaaggtcgtcctacagatgtcacacagagatggagggtgatatctagttaactgctacatctagcgatgtgctcgattaacaaggatggtcttggtcctgtgcgagcaagtagctcggctgcagaacggcgagcataccaccaaggcatgggttatatgcaacctcagtaccattacggtgatatctcaaactaggtgacgtatggaacttttctgtgagggctgctcataactgatggggattatttttgtctttgtcattgacaaggaccccttttgcgtgggcctttaggagtaggcaaatcggccttaaaaaggccggtttttt

SEQ ID NO: 75162 - DNA, 701 bp, Zea mays
  misc_feature: Ceres CLONE 1559581
  misc_feature: Encodes the peptide sequence at SEQ ID NO. 75163
gctggagctccccgcggtggcggccgctctagaactagtggatcccccgggctgcaggaattcgtctcacccctagaaaaaatcccctcagtcctcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggccctgtctgcgcgtacgagctgtccaaggaccccaccgtgagcgtggccatcgtgaaccatccgtgtccccgggcggcggctccttggcttggcgggcacctgttctccgcccagggggggtgccaaggccggcccacctgtttcctggaaaaaccggggcctgggcctaacaaacaaaggccaaagaaaccaacggggggggggcaaaaaaaacccggggggcctt

SEQ ID NO: 75163 - protein, 174 aa, Zea mays
  misc_feature: Ceres CLONE 1559581
MATTAASSLLKSSFAGSRLPSATRTTTPSSVAVATPRAGGGPIRASISSSPTPPYDLTSFRFSPIKESIVSREMTRRYMTDMITHADTDVVIVGAGSAGPVCAYELSKDPTVSVAIVNHPCPRAAAPWLGGHLFSAQGGCQGRPTCFLEKPGPGPNKQRPKKPTGGGQKKPGGP

SEQ ID NO: 75164 - DNA, 763 bp, Zea mays
  misc_feature: Ceres CLONE 1559585
  misc_feature: Encodes the peptide sequence at SEQ ID NO. 75165
ctggagctcaccgcggtggcggccgctctagaactagtggatcccccgggctgcaggaattcgtctcacccctagaaaaaaatcccccaaacatttcgtcgaatccgccgtgagatccgcccgactctcgctccgttccggcgctctcggtcgggcgaaggctccaccttcctccgacaagatggcggggaagggagccaaggccacggccgccaagtcggcggacaaggacaaggggaagaagaccggcggccccgtctcgcgctcctcccgcgccgcaccccaggagaagtcagctccgaagaaagatgtttatcaattgttcgctgagaaggtcagggataacaaacaactggaatcaagatgggcgatcatgcaagaaacccgcgtggagtatttccgtggaaaagatttcaataccttcgtcaagaatcatccagaagtcagggaaattttggggccagataaggagttagaggtggaagacattgttaacactttgctgaccaagaaccttgtgataaggtgtgatcgagttatgaaaactgtgaggccctgcaagaaaaagctatcctcatggccttgctcatttggagatccataaaggaacaagtgtttaccggaaaaagaaggggttttttgcctggagaggtttccgaaaaaaagggacctttggggcaaaaaaatttcttttcattttggtttgggcctcttttttttcacctggggcagttctcgcctttatttccccccgtttttcccc

SEQ ID NO: 75165 - protein, 140 aa, Zea mays
  misc_feature: Ceres CLONE 1559585
MAGKGAKATAAKSADKDKGKKTGGPVSRSSRAAPQEKSAPKKDVYQLFAEKVRDNKQLESRWAIMQETRVEYFRGKDFNTFVKNHPEVREILGPDKELEVEDIVNTLLTKNLVIRCDRVMKTVRPCKKKLSSWPCSFGDP

SEQ ID NO: 75166 - DNA, 806 bp, Zea mays
  misc_feature: Ceres CLONE 1559586
  misc_feature: Translation starting site: 167
  misc_feature (270)..(270): n is a, c, t, g, unknown, or other
  misc_feature (274)..(274): n is a, c, t, g, unknown, or other
ctggagctcaccgcggtggcggccgctctagaactagtggatcccccgggctgcaggaattcgtctcaccccctagaaaaaacagcatccgcagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgntggnaagagctcactgttgaggagcgtaaccttctgtctgttgcatacaagaatgtgattggggctcgccgcgcttcatggcgcattgtttcttccattgaacaaaaggaggagtcccgtaagaaacgaagagcatgtgaaccttatcaagggaatatcgtgggcaagaatcgaggctgaaactggagcaaataaccctgttggaatgggagaaattttaaacctgcgttggacccccccccaaggcccctttcccacgggcgcggaaacaaaaggcttcttccccccaaaggaaaggggggaatttcccagggtgttttccgggaaaaatttaaaaaaacgggccccaaaaaaaaaaaaaaattttcctgaaacaaaaaaagggggggccaaaaagaggcttccaaaaaaaaatttttcccctgggggggggggggcccccccccccccccccaaaaaaaggggggggggggggcctccccccatttttttttttccccgccgcgccttcttttggaggaagggcgccccccccc

SEQ ID NO: 75167 - DNA, 854 bp, Zea mays
  misc_feature: Ceres CLONE 1559593
  misc_feature: Encodes the peptide sequence at SEQ ID NO. 75168
  misc_feature (812)..(812): n is a, c, t, g, unknown, or other
  misc_feature (813)..(813): n is a, c, t, g, unknown, or other
  misc_feature (820)..(820): n is a, c, t, g, unknown, or other
  misc_feature (832)..(832): n is a, c, t, g, unknown, or other
  misc_feature (854)..(854): n is a, c, t, g, unknown, or other
ctggagctccccgcggtggcggccgctctagaactagtggatcccccgggctgcaggaattcgtctcacccctagaaaaaactcacctcagcctcacctgccttcccaatcaatcgcattctccgtccgcgacccaatccaggtgccgacagaccagataccagagcaaacaagaagccgtctcactccacgtcgcaagggaaatggccaccgcctcgctcgcactgctcgatcagacgctgctgccgtcccctctggcgtacaacggcggctccgaccgcctcagccaggagatcttctccatcctcgagtccaacttcctattcggcgcgtcgccgctggagggcggcgcgtgctccgcgggccgcgtccgcgtgctgtccatcgacgggggtgccgacggcggcgcgctggccgccgcagcgctggtacggctcgagcgccgcctgcaggagctctccggcaaccccgccgcgcgcgtcgcggacttcttcgacctggcggccggctccggcgcgggcgggttcctcgcggcggcgttgttcgcgtgccggatgcccgccgaggcggcgcgcgacgtcgtggccaagaaccggaaggtcctgtccgggcgtggcgggggcctgatgtcgttccggcgccccgaggccgcgttccggaaggtgttcggtgacctgacggtgcgcgacgccgccaagccgctgctgatcccgtgctacgacatggccaccgcggcgccgttcgtgttctcccgcgccgatgccgtggaggccgacgcgttcgacttcccgctgtggcaggtgtgcgcggcnngcttgcngcgtgggcccgncggaggtggcgtccctggacgn

SEQ ID NO: 75168 - protein, 217 aa, Zea mays
  misc_feature: Ceres CLONE 1559593
  misc_feature (59)..(207): Pfam Name: Patatin Pfam Description: Patatin-like phospholipase
  misc_feature (204)..(204): Xaa is any aa, unknown, or other
  misc_feature (206)..(206): Xaa is any aa, unknown, or other
  misc_feature (210)..(210): Xaa is any aa, unknown, or other
MATASLALLDQTLLPSPLAYNGGSDRLSQEIFSILESNFLFGASPLEGGACSAGRVRVLSIDGGADGGALAAAALVRLERRLQELSGNPAARVADFFDLAAGSGAGGFLAAALFACRMPAEAARDVVAKNRKVLSGRGGGLMSFRRPEAAFRKVFGDLTVRDAAKPLLIPCYDMATAAPFVFSRADAVEADAFDFPLWQVCAAXLXRGPXGGGVPGR

SEQ ID NO: 75169 - DNA, 740 bp, Zea mays
  misc_feature: Ceres CLONE 1559594
  misc_feature (97)..(97): n is a, c, t, g, unknown, or other
  misc_feature (104)..(104): n is a, c, t, g, unknown, or other
  misc_feature (193)..(193): n is a, c, t, g, unknown, or other
  misc_feature (471)..(471): n is a, c, t, g, unknown, or other
  misc_feature (476)..(476): n is a, c, t, g, unknown, or other
ctggagctcaccgcggtggcggccgctctagaactagtggatcccccgggctgcaggaattcgtctcacccctagaaaaagctagtaccagtagtcngtcgcgntttgcagctaggcagatctgagttagccggcggatccgatccgtgcgcgtgcgcagtgtgtgtgtgtgtgtgtgtgtgtgtgtgtgtcnggtggagagatggccacagcttacgctcccatggcgagccaggtgatgaagagcagcctcgtcgtgcactcgaggccgaggggcctgtcaggcgctgctgcgctcacgaggcggcccggccggttcacctgtcaaggccatccagcccgagaaggcaacgtatcaaggtggtgcagcccatcaacggcgacctcttcatcggcagccttggagacgccgggtcacttcgagcccgctcgtgggcgtgggtaacttctccaaaccttcggccttaccgnaccgncctggagcccccttttttgcggggcgtccaaggtcggccttccccacggggttactcccccggggggggcttttccccctcaaggggcccccttcccaaaaacccccttttaacaggccaaaggcgggggccccttttggggcccccccgggccccttttccccctttttcaagggggggttgccccaaaacacagataagggaggggggtgccccccccctctttttataaaagagggggggggacccccccccccccccccc

SEQ ID NO: 75170 - DNA, 840 bp, Zea mays
  misc_feature: Ceres CLONE 1559595
  misc_feature: Encodes the peptide sequence at SEQ ID NO. 75171
ctggagctccccgcggtggcggccgctctagaactagtggatcccccgggctgcaggaattcgtctcacccctagaaaaaagcacagtgccttcactgcacttcgcttggctgcctcgagaaaagctccactccaaaaaaacctcgcgtccctttctgaatccagactccagaggggcgggcgtgtcctgtcggatgacgagccggcgcgacaggttggagccttcgccggctgcggccgcggtggcgctgctgctgctgctggtggccgccgcgccggcgtctgggcaggtggcgacgtcgtgcacggcgtcgctgatatcgacgttcacgccgtgcctcaacttcgtgacggggagcaccaacggcggcggctcgccgacgaagcagtgctgcggggtgctggcggagatggtgcgcacgggcgccgactgcgcctgtctcatcctcacgggcaacgttcccttcagcctccccatcaaccgcacgctcgccgtctccctccccaagctctgcagctccacctccgtcccgctccagtgcagagacacggcgacgcaaatcccagctccaggtaacatgcatcaacatcgccttgtttgtcagtaccaaaacaacaacaacaacaacaacaaataatctgaagtctttaggagaagatgaacaactgaactctgtgtcttttttttctgtaccaggacctatcgccttcgctccggctctgccctcactgccacccatcccaccggaatcgtccgacccctcggcggatcccacggcgatccctccggcggtggactcgccgccgttctccagaggccagtggtggtgcccagctcga

SEQ ID NO: 75171 - protein, 147 aa, Zea mays
  misc_feature: Ceres CLONE 1559595
  misc_feature (37)..(116): Pfam Name: Tryp_alpha_amyl Pfam Description: Protease inhibitor/seed storage/LTP family
MTSRRDRLEPSPAAAAVALLLLLVAAAPASGQVATSCTASLISTFTPCLNFVTGSTNGGGSPTKQCCGVLAEMVRTGADCACLILTGNVPFSLPINRTLAVSLPKLCSSTSVPLQCRDTATQIPAPGNMHQHRLVCQYQNNNNNNNK

SEQ ID NO: 75172 - DNA, 755 bp, Zea mays
  misc_feature: Ceres CLONE 1559597
  misc_feature: Encodes the peptide sequence at SEQ ID NO. 75173
ctggagctcaccgcggtggcggccgctctagaactagtggatcccccgggctgcaggaattcgtctcacccctagaaaaaatcagccaaagtataagcgcagatcgagtcatcaagctagctagcccggagcacgcctagacacgccagcagcaatggcggctcagctggccgttgcgtttctcgccttgttgtcctcctctgccttcttggccgtgtctggccagaagttcaacgccatcttcagcttcggcgactccatgtccgacaccggcaacctgtgcgtgaacggtccccccgccggcctgacgctcacccagccgccctacggcgagaccttctttggccgcgccacctgccgctgctccgacggccgcctcgtcgtcgacttcctggccgagaagttcgggctgccgctgctgaagccgtcgaagcagggcggctcagacttcaagcagggcgccaacatggcgatcattggcgcgaccaccatggactcggggcttcttccagtcgctggggcatcccccaacagaatctggaaacaaccgggcccctcaaaaaccccagaaatccccgtgggttcccagcaacttaaatccccttccaattgggggtttaaaccaagggctttcaaatttttaccctttcccaaaccccctttttcggcctggggccaaattttcggggggaaaaaaaaatcacaagccgaaaaaattttttggggggggtttaaccccccgcggagaaaagggg

SEQ ID NO: 75173 - protein, 200 aa, Zea mays
  misc_feature: Ceres CLONE 1559597
  misc_feature: SWISSPROT Homolog: EC 3.2.1.51 Alpha-L-fucosidase
MAAQLAVAFLALLSSSAFLAVSGQKFNAIFSFGDSMSDTGNLCVNGPPAGLTLTQPPYGETFFGRATCRCSDGRLVVDFLAEKFGLPLLKPSKQGGSDFKQGANMAIIGATTMDSGLLPVAGASPNRIWKQPGPSKTPEIPVGSQQLKSPSNWGFKPRAFKFLPFPKPPFSAWGQIFGGKKKSQAEKIFWGGFNPPRRKG

SEQ ID NO: 75174 - DNA, 849 bp, Zea mays
  misc_feature: Ceres CLONE 1559598
  misc_feature: Translation starting site: 314
  misc_feature (791)..(791): n is a, c, t, g, unknown, or other
ggagctccccgcggtggcggccgctctagaactagtggatcccccgggctgcaggaattcgtctcacccctagaaaaaaatcggagcgggcagccacatccagttgcgcgcttgtgcagtcgctctgctgcagcaggaaggaaagaagctagcgcttatagcttgtcagccatggccaccgccgccgcgtctagcctcctcaagtcctccttcgcggggtcccggatcccgggaggcacacggaccacaccggacgtccctcgaggtggacaccggcccgagcagccccggcgcggggcccatctgtccgtccatgaacatgtcctcctgcaagccgccctacgacctgacctacttgcagatcacccccatgagagagtccaacgtgtgccacgagatgacccgtcactacatgacggacgtgatcacctaccccgacaactacgtcttcatcgcgggcgccggctccactggggtgtcctgcgcgtacgagctctccaaggacacctccgtgaggatcgccatcgtgaagcaatcggggtcaccgggcagcggcgcgtggatggccaggcatctgttatcgaggcatggtggtgcgcaagccggcgcacatgttcctggaccagctgggtgtggagtatgaccaggcccaggactacgtggtcatcaagcacgccgcgcttgttcacgtctactggtgatgacgcctgctcgtggcgagccccagggtatagctgatagactcgcttggccacgagatgcacctcatcgtcagggggagggaccatacngcggctttccacacaattggggcgccatcgtgtcatgtaccaccgacacgctgtccct

SEQ ID NO: 75175 - DNA, 860 bp, Zea mays
  misc_feature: Ceres CLONE 1559599
  misc_feature (252)..(252): n is a, c, t, g, unknown, or other
  misc_feature (257)..(257): n is a, c, t, g, unknown, or other
  misc_feature (276)..(276): n is a, c, t, g, unknown, or other
  misc_feature (356)..(356): n is a, c, t, g, unknown, or other
  misc_feature (379)..(379): n is a, c, t, g, unknown, or other
  misc_feature (571)..(571): n is a, c, t, g, unknown, or other
tggagctccccgcggtggcggccgctctgaactagtggatcccccgggctgcaggaattcgtctcacccctagaaaaaatccgttgatcccatcggcttccccttcctcttccccgatccccttcctcccccgatcccatccaattccacttccacaccgcgggcctcgccgccgacgccgacgccgccggccatgtccaagtacggcaccattcccacctcctcctccgcgggcggagggcccgtgccccntcggncggcgcctccccgctcganttcatctcccgcgccaaggctcggggcgcctcggcgctggcgagcgccgggccttggcccgagctcgtgggacgttccancccccttcgggcctggccccccnaagcccttgggaaaccgttacctttccggttgggcggccaaaccttggcccattttggccagggaaaaaaaggcccaacgggggcccccgggggggggggttttcccctcccccccccccccggggggaccccccgtttcccccaaaaaaggaaatcccccccccctcaacaaaattttttccccggggggncccccccccctcaaaatttccccccgcggaaaaaagagaccccccctggtctctttttttggggggggggggtgttttccccaaaaagggagaaaaattctccttctccgggggggggtccccccctttttaaaaaaaacaagggggggggggctctccccctccctccaaaggaggcccacccccccaaaaaaatttcctcctcccccccgggggggaaaaaaaggaggggggcgttgggggtttttttttttttttttttaacaccaaccgggggcgcgggaaagga

SEQ ID NO: 75176 - DNA, 807 bp, Zea mays
  misc_feature: Ceres CLONE 1559600
  misc_feature: Encodes the peptide sequence at SEQ ID NO. 75177
  misc_feature (173)..(173): n is a, c, t, g, unknown, or other
  misc_feature (186)..(186): n is a, c, t, g, unknown, or other
  misc_feature (342)..(342): n is a, c, t, g, unknown, or other
  misc_feature (377)..(377): n is a, c, t, g, unknown, or other
  misc_feature (385)..(385): n is a, c, t, g, unknown, or other
  misc_feature (409)..(409): n is a, c, t, g, unknown, or other
  misc_feature (410)..(410): n is a, c, t, g, unknown, or other
  misc_feature (430)..(430): n is a, c, t, g, unknown, or other
  misc_feature (455)..(455): n is a, c, t, g, unknown, or other
ctggagctccccgcggtggcggccgctctagactagtggatcccccgggctgcaggaattcgtctcacccctagaaaaactcttttcccctcccttttccgcacggggagcgacctgcgccgccgccacgatgccgaagcactaccgccctgcgggtaagaagaaggaaggtngaatgcggcaaangtacatcacgaggaccaaggcggtcaactacctgcaagttagcctcgcaatctttaggaagctatgcattctaaagggtgtctttccacgtcagccaaagaagaaggtggaagggaaccacaagacctactaccacacaaaggatattgcattccntcgctcatgacccctttgatcgagaaagtcagggnagattaanggtcatcgaaaggagggtaaaaannggctgtgctagaaaacaggnatcttgcagacaggctgttgaatcngccacccacttaacagcctgataagcttgtccttgaaaggatccaacattcgttgaaggctcctccggacttgggatgactggcttacaaagggggcatccgttttgcgccatacctggcttttaacggggaacctttttggggtaaaacgaaatccttaattgcccccgggttaaccccgtgaaggggaaaagttttatttttcccgaaacccttttttttgagggaaaaaaatttattttcccgggggaggggggttattttttccggggggggaaaatttccgggggaaaaaaaaaaccccccgggggaaaaaaccccccggggtgtttttttaaaaaagaaattaaaa

SEQ ID NO: 75177 - protein, 73 aa, Zea mays
  misc_feature: Ceres CLONE 1559600
  misc_feature (15)..(15): Xaa is any aa, unknown, or other
  misc_feature (19)..(19): Xaa is any aa, unknown, or other
  misc_feature (71)..(71): Xaa is any aa, unknown, or other
MPKHYRPAGKKKEGXMRQXYITRTKAVNYLQVSLAIFRKLCILKGVFPRQPKKKVEGNHKTYYHTKDIAFXRS

SEQ ID NO: 75178 - DNA, 827 bp, Zea mays
  misc_feature: Ceres CLONE 1559601
  misc_feature: Encodes the peptide sequence at SEQ ID NO. 75179
ggagctccccgcggtggcggccgctctagaactagtggatcccccgggctgcaggaattcgtctcacccctagaaaaagccccctcaatccctcatagtcagtcatagagcgagaggaagaggcgcgcgtgggtgcagtgcagacgtgcggggcagagcacaacagcaggggatccggggagggagggaagccatgggcgaggaggcggccaagaaggaggaggtggagaagcccaaggaggccgccgcggcagaggagaagaagaaggacgacaagcccaaggaagtaggcggcggcggcgagaagcccaaggacggggaggaggacgagaagaagaaggaggacgcgccgccgcctccgccgcccccgccgccggaggaggtcgagatgcgggtctacatgcactgcgaagggtgcgcccgcaaggtcaagaagatcctcaggcgcttcgacggagtggaggatgtgatcgccgactccaaggcgcacaaggtgctggtgaaggggaagaaggcggccgccgaccccatgaacgtggtggagcgcgtgcagaagaagactggccgcaaggtcgagctgctgtcgccgatgccgccccccgcccgatgtgggacgaaagtaaagcatatgagtgcggagaataaaagggacgatgaccaataagggggaagccgaagctctccttaaacccgaagggaaaaaaaaggaacccccccgggggaatctccgggggggggaaaaaagagggcccaatttacaccccccagagggggttctccccaaaggggggtttaaaccaaaggaggggagcctcccctataaaaaa

SEQ ID NO: 75179 - protein, 156 aa, Zea mays
  misc_feature: Ceres CLONE 1559601
  misc_feature (65)..(129): Pfam Name: HMA Pfam Description: Heavy-metal-associated domain
MGEEAAKKEEVEKPKEAAAAEEKKKDDKPKEVGGGGEKPKDGEEDEKKKEDAPPPPPPPPPEEVEMRVYMHCEGCARKVKKILRRFDGVEDVIADSKAHKVLVKGKKAAADPMNVVERVQKKTGRKVELLSPMPPPARCGTKVKHMSAENKRDDDQ

SEQ ID NO: 75180 - DNA, 845 bp, Zea mays
  misc_feature: Ceres CLONE 1559602
  misc_feature: Encodes the peptide sequence at SEQ ID NO. 75181
  misc_feature (616)..(616): n is a, c, t, g, unknown, or other
ctggagctccccgcggtggcggccgctctagaactagtggatcccccgggctgcaggaattcgtctcacccctagaaaaaaaaccctagcgcccccggccccggtctccgcccccccgccttcgccgtcgcggtcgcgccccatggcggggaagtcgcgaccgcccaagcggatcctcgagtcctataccatcaagggttcggacagagtcatcaagcctggcgattgcgtgctaatgagggcatctgatgcttcaaagccaccttatgtggcaagagttgaggcaattgaagcagcaggatctcgaggcaccaatgtgagagtacgagtgcggtggtattatcgaccagaggagtccataggtggtcggcggccatttcatggttccaaggaggttttcctctctgaccactatgatgtacaaagtgctgacaccattgaggggaaatgcaatgtccacagcttccgtagctatacaaagcttgattctgtcaatgctgaggatttcttctgccgcttcgagtataaatcagctactggcagctttgtaccagatcgtatagcagtgttttgcaagtgcgagatgcccatacatccagatgaccttatgatccantgcgaggaatgttctgactggtttcaccctgcttgcattgggatgacaatcaaagaagcaaagaaactcgagcattttttctgccagacctgtacagctgaaaaatgtaagatgggttgaggatttcacatgaagcttccgccgcatccgaaagaaaaagcgggtggagtcaaaaagccgcccaaaggtgatggcccgtgctgaattaatttttggaaaacctttgccc

SEQ ID NO: 75181 - protein, 197 aa, Zea mays
  misc_feature: Ceres CLONE 1559602
  misc_feature (22)..(139): Pfam Name: BAH Pfam Description: BAH domain
  misc_feature (143)..(192): Pfam Name: PHD Pfam Description: PHD-finger
  misc_feature (158)..(158): Xaa is any aa, unknown, or other
MAGKSRPPKRILESYTIKGSDRVIKPGDCVLMRASDASKPPYVARVEAIEAAGSRGTNVRVRVRWYYRPEESIGGRRPFHGSKEVFLSDHYDVQSADTIEGKCNVHSFRSYTKLDSVNAEDFFCRFEYKSATGSFVPDRIAVFCKCEMPIHPDDLMIXCEECSDWFHPACIGMTIKEAKKLEHFFCQTCTAEKCKMG

SEQ ID NO: 75182 - DNA, 849 bp, Zea mays
  misc_feature: Ceres CLONE 1559605
  misc_feature: Encodes the peptide sequence at SEQ ID NO. 75183
  misc_feature (759)..(759): n is a, c, t, g, unknown, or other
ctggagctccccgcggtggcggccgctctagaactagtggatcccccgggctgcaggaattcgtctcacccctagaaaaaaagctgcgtctccagctcccagcgcgcccgaccgcccacacctctgcccctccactcatcttcctggccgcagctcctcatcttcctgcgtgcactccttctctgtctcccatggccgagtgtcctccctgctcctctctccatctccctctccatcttggcgcttccccagctcgttttcccatctcccttctccttcccatggtgcgcagggcatcctcccctcgactccctccctagctccccaccgctcgctattctctccttcctggtcgcccgtctccagcttgatctgcactcgtcgtccctgcccctcgctgttttcgtgccagtcgagctcgcccagcccctcgcctctccacctcatcaacgccctcagccatggatgtcgaaccccctctctttagtgcctttctttgcagcccctgcgtcaccgtgcgtgtaaggtgtttgtctaaatgctcaagaggagtgtcgtgtcgtagacagcccttttggcgtcgtcaggtgtttgatgttttgcgcatcccgtctacgacaccgtcgaccctcagtacgctaagtgatcacgtgatgtggaggaccagagctgagtcggccacaagatggtattaagcgcgggtttctttgcaaggtgatgctaatggacgaacttaaggatggacagactgaaccagtngcaacacaaaaggctggtcaccaagtgatcatcgtctaacaacactaacttagtgttatcccaggtactagatttgtgcttgctgtggag

SEQ ID NO: 75183 - protein, 77 aa, Zea mays
  misc_feature: Ceres CLONE 1559605
MDVEPPLFSAFLCSPCVTVRVRCLSKCSRGVSCRRQPFWRRQVFDVLRIPSTTPSTLSTLSDHVMWRTRAESATRWY

SEQ ID NO: 75184 - DNA, 886 bp, Zea mays
  misc_feature: Ceres CLONE 1559608
  misc_feature: Encodes the peptide sequence at SEQ ID NO. 75185
  misc_feature (48)..(48): n is a, c, t, g, unknown, or other
  misc_feature (711)..(711): n is a, c, t, g, unknown, or other
  misc_feature (747)..(747): n is a, c, t, g, unknown, or other
  misc_feature (776)..(776): n is a, c, t, g, unknown, or other
ctggagctccccgcggtggcggccgctctagaactagtggatcccccngggctgcaggaattcgtctcacccctagaaaaaaaaaaaaaaaaaaaaaaaacctccccaatctcgccgtttgccttctgcgcctccatttcggcctctgtcccttgcaagttcaatctcacctccaaccatgggtaaagagaagtcccacatcaacattgtggttattggccacgttgactctggcaagtcgaccaccacaggacacctgatctacaagcttggaggcattgacaagcgtgtgatcgagaggtttgagaaggaggctgctgaaatgaacaagcggtccttcaagtacgcatgggtgctcgacaagctcaaggctgagcgtgagagaggtatcaccattgatatcgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactccgaaatactccaaggcacgttatgatgagatttgtgaggaagtctcatcctaccntcagaaagttgggtacaaaccctgatagaatgcccntcgtccccattctgggtttgagggcgacnacatgattgagaggtccatcacctttgattggtacaaaggccaaccctgctttgagctcttgaccagatcaccgaggccaagagcttttcggacaagccccttcgtctgc

SEQ ID NO: 75185 - protein, 185 aa, Zea mays
  misc_feature: Ceres CLONE 1559608
  misc_feature (5)..(186): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (178)..(178): Xaa is any aa, unknown, or other
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEICEEVSSYXQKVGYKP

SEQ ID NO: 75186 - DNA, 891 bp, Zea mays
  misc_feature: Ceres CLONE 1559614
  misc_feature: Encodes the peptide sequence at SEQ ID NO. 75187
  misc_feature (536)..(536): n is a, c, t, g, unknown, or other
agctccccgcggtggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgcccggcacggcgtcaagttcggcgaggccgtgtggntcaaggccggggtccagatcttcagcgagggcgggctggactacctcgggcaaccgagcctgatccagcgcaaagcatcctgcccattggggctgcccaggtggtgctcaggggccccttcaggggtaccccaaccccgggggcccgcttcggggagggggttaacccttttaccccggggggagttttaaaccccttgggttccccaacaaccggaagggtttccgggaactaaggcaaggagatacaaaagcgcccccccccccggtttcccaagtggggtttctcgggggggcatcttccccggaagagggcccctgaaaaaccccccgaacacccttgtaactttgtaaaa

SEQ ID NO: 75187 - protein, 187 aa, Zea mays
  misc_feature: Ceres CLONE 1559614
  misc_feature (58)..(178): Pfam Name: Chloroa_b-bind Pfam Description: Chlorophyll A-B binding protein
  misc_feature (125)..(125): Xaa is any aa, unknown, or other
MALTSRALVGKPATSTRDVFGEGRITMRKTAGKPKPAASGSPWYGADRVLYLGPLSGQPPSYLTGEFPGDYGWDTAGLSADPETFAKNRELEVIHCRWAMLGALGCVFPELLARHGVKFGEAVWXKAGVQIFSEGGLDYLGQPSLIQRKASCPLGLPRWCSGAPSGVPQPRGPASGRGLTLLPRGEF

SEQ ID NO: 75188 - DNA, 840 bp, Zea mays
  misc_feature: Ceres CLONE 1559620
  misc_feature: Translation starting site: 211
  misc_feature (438)..(438): n is a, c, t, g, unknown, or other
  misc_feature (440)..(440): n is a, c, t, g, unknown, or other
  misc_feature (448)..(448): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
ctggagctccccgcggtggcggccgctctagaactagtggatcccccgggctgcaggaattcgtctcacccctagaaaaaccaccacaccacaccacaccggccggctcacacgcgccgcaaagcagagcacggggggctgagaccagagcagagcggagcgccaccagccaatcctttgcctgcccaagcagcagcagcagctggcccgatggctctgtctctctccggtacctccgcccgcttcgccctcgcgtcgctggtcccccgggccagggcctacgcggcgtcggcggcgtccggggccatgaggcgcgcggcggagggcgcggccgcgggcgaggccaagggaggcgggcgcgcgccgcagccgccgcgaggggtcgtgggtgcccgaaccacgtcacgggccactacccgccccgccaactggggccgncngccggtcnaaacccccgccggaaccttccggggcccggggaaccttttccccggaaccctaaaccccgggggggtttaaagaggggccccggggctccccttttaaccccggggttccccccccctgttttttggtaaggaaaaaaaagggcccccccccttaacccccggggtgaaaacaaaggggggggggggcgggggggttttcttcgtggggaaaaaaaaggcgctttttataacacacccccccggcggggggggggggggcggcccttttttttgagacccccccggaaaaaaaatttttttttttggggggggggagaagaaagcccccccccaaaaagagannnnnnaaaatttgggtttcctctttttctttttgggggggggggggggg

SEQ ID NO: 75189 - DNA, 856 bp, Zea mays
  misc_feature: Ceres CLONE 1559623
  misc_feature: Encodes the peptide sequence at SEQ ID NO. 75190
ctggagctccccgcggtggcggccgctctagaactagtggatcccccgggctgcaggaattcgtctcacccctagaaaaactccgcctctactgtagccacggcccttggttcccctccattattcgacctcaccttgccaccagccatggctgccgtgaccgccgcggccatctctctgtcctcctcctccacctcctcccctgcggctgctgccaaggacaaggcggcgtccccgtcgtcgtcgccatgcaggcacctccagttcctgtcggcggtgagcccgcggcggcggtggcgggccggcgcccgcgcggtgcgggcgcaggtgtccaccaccgagaccgcggcggcggggccggcgaagacgtccaagaagcatgacgaggggctggtcaccaacaagtacaagcccaaagagccgtacgtcgggaggtgcctgtccaacaccaggatcaccggcgacaacgcgccgggggagacgtggcacatggtcttcagcaccgaaggcgagatcccgtatagagaggggcagtccatcggcatcatcgctgatggcgaacacaagaacggcaagccgcacaaactcaggctatactccatcgccagcagcgccctcggagatatcggcgaccccaagacggtgtcgctttgcgtgaagaggctagtctacaccaacgatcacggggagattgtcaaaggagtctgctcaaacttcctgtgtgacttgaaaccaggcgccgatgtgaagatcacaagaccagtgtgcaaggagatgctcatgctcaaagaccgcgatgcaacagtcatcatgctctcaacgggtaccggtattgctccgtgccgctccttgctgt

SEQ ID NO: 75190 - protein, 236 aa, Zea mays
  misc_feature: Ceres CLONE 1559623
  misc_feature: SWISSPROT Homolog: EC 1.18.1.2 Ferredoxin--NADP(+) reductase
MAAVTAAAISLSSSSTSSPAAAAKDKAASPSSSPCRHLQFLSAVSPRRRWRAGARAVRAQVSTTETAAAGPAKTSKKHDEGLVTNKYKPKEPYVGRCLSNTRITGDNAPGETWHMVFSTEGEIPYREGQSIGIIADGEHKNGKPHKLRLYSIASSALGDIGDPKTVSLCVKRLVYTNDHGEIVKGVCSNFLCDLKPGADVKITRPVCKEMLMLKDRDATVIMLSTGTGIAPCRSLL

SEQ ID NO: 75191 - DNA, 841 bp, Zea mays
  misc_feature: Ceres CLONE 1559624
  misc_feature: Encodes the peptide sequence at SEQ ID NO. 75192
  misc_feature (717)..(717): n is a, c, t, g, unknown, or other
  misc_feature (730)..(730): n is a, c, t, g, unknown, or other
  misc_feature (793)..(793): n is a, c, t, g, unknown, or other
ctggagctccccgcggtggcggccgctctagaactagtggatcccccgggctgcaggaattcgtctcacccctagaaaaagctggctcccaccgaattcattccacccccgtctcctccgatcggacggaccaccgggccagcagcggggcggatcgcgtcagcagccatggtgaaggcctaccccacggtgaacgaggactacctcaaggcggtcgacaaggccaagcgtaagctccgcggcctcatcgccgagaagaattgcgccccgctcatgctccgcctcgcatggcactccgcgggcaccttcgatgtggccaccaaaaccgggggccccttcggcaccatgaagaaccccgccgagcaggcgcacggagccaacgccggactggaaattgccatcaggctgctagagcccatcaaggagcagttccccatcctatcctacgctgacttctaccagcttgctggagtcgtggcagtcgaggtaaccggcggacctgatgtcccctttcaccctgggaggcaggacaagcctgagcctccaccggaaggccgccttcctgatgcctaccaggttctgatcacctcaggcaggttttctcccacacagatgggtttgagcgactaggacattgttgcgctttctggtggtcacaccctggggagatgccacaaagacaggtctggatttgaaggagcctggacgtccaccccntttgatcttgacnactcttactttcaggagcttctgagcgaaaaaagggaaggccttctgcagctaccaagtgacnaagcccttcttctctggatcaatctttcggcccacctgttgaccaata

SEQ ID NO: 75192 - protein, 153 aa, Zea mays
  misc_feature: Ceres CLONE 1559624
  misc_feature (19)..(154): Pfam Name: peroxidase Pfam Description: Peroxidase
  misc_feature: SWISSPROT Homolog: EC 1.11.1.11 L-ascorbate peroxidase
MVKAYPTVNEDYLKAVDKAKRKLRGLIAEKNCAPLMLRLAWHSAGTFDVATKTGGPFGTMKNPAEQAHGANAGLEIAIRLLEPIKEQFPILSYADFYQLAGVVAVEVTGGPDVPFHPGRQDKPEPPPEGRLPDAYQVLITSGRFSPTQMGLSD

SEQ ID NO: 75193 - DNA, 856 bp, Zea mays
  misc_feature: Ceres CLONE 1559627
  misc_feature: Encodes the peptide sequence at SEQ ID NO. 75194
  misc_feature (682)..(682): n is a, c, t, g, unknown, or other
  misc_feature (792)..(792): n is a, c, t, g, unknown, or other
aagctggagctccccgcggtggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgcccgcaacggcgtcaagttcggcgaggccgtgtggttcaaggccgggtcccagatcttcagcgagggcgggcttgactacctcggcaacccgagcctgatccacgcgcagagcatcctggccatctgggcgtgccaggtggtgctcatgggcgccgtcgaggggtaccgcatcgncggtggccgctccggggaagtggtcgacccgctgtaccccggcgcagcttcgacccgcttcggctccgcgacgaacccggagcgttcgcggagctcagggtcaggagatncagaacggccgccttcccatggtctccatgttcggctttctcgtgcaggccatcgtcaccgggc

SEQ ID NO: 75194 - protein, 228 aa, Zea mays
  misc_feature: Ceres CLONE 1559627
  misc_feature (58)..(203): Pfam Name: Chloroa_b-bind Pfam Description: Chlorophyll A-B binding protein
  misc_feature (171)..(171): Xaa is any aa, unknown, or other
  misc_feature (208)..(208): Xaa is any aa, unknown, or other
MALTSRALVGKPATSTRDVFGEGRITMRKTAGKPKPAASGSPWYGADRVLYLGPLSGQPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVVLMGAVEGYRIXGGRSGEVVDPLYPGAASTRFGSATNPERSRSSGSGDXERPPSHGLHVRLSRAGHRHR

SEQ ID NO: 75195 - DNA, 851 bp, Zea mays
  misc_feature: Ceres CLONE 1559629
  misc_feature: Encodes the peptide sequence at SEQ ID NO. 75196
ctggagctccccgcggtggcggccgctctagaactagtggatcccccgggctgcaggaattcgtctcacccctagaaaaaacagcaagaccaacaaacccacttctgactgaccactgtgccgcgccgtggtcaccgagacggacacacagaactactatggccgcttcggcgctgcaccagaccaccaacttcctcgggcaggccctggtctcccgcgccgcccgcgtcgatgccggcggccgcatcaccatgcgccgcaccgtcaagagcgttccccagagcatatggtacggccctgatcgccccaagtatcttggcccgttctccgagcagacgccgtcctacctgaccggtgagttccccggcgactaccggtgggacaccgcgggcctctcggccgacccggagacattctcgcgcaaccgggagctggaggtgatccactcccggtgggcaatgctgggcgcgctgggctgcgtgttcccggagatcctggccaagaacggcgtcaagttcagcgaggctgtgtggttcaaggccggcacgcagatcttctcggagggcgggctggactacctggggaaccccaacctggtgcacacacagagcatcctggccatctgggcgtgccaggtggtgctcatgggcttcgtctatggctaccgattcggcggcagcctgctcggggaaggctcgacaaggtgtaccccggcggcgccttcgacccactgggctctcgcgactactcggagacgcctctaagctcaaggtgtaggagctcaagatcggccgccttgccatgatcatcatgttcggcttcttcgtgcagagcatcatcacctgtcaggc

SEQ ID NO: 75196 - protein, 201 aa, Zea mays
  misc_feature: Ceres CLONE 1559629
  misc_feature (59)..(194): Pfam Name: Chloroa_b-bind Pfam Description: Chlorophyll A-B binding protein
MAASALHQTTNFLGQALVSRAARVDAGGRITMRRTVKSVPQSIWYGPDRPKYLGPFSEQTPSYLTGEFPGDYRWDTAGLSADPETFSRNRELEVIHSRWAMLGALGCVFPEILAKNGVKFSEAVWFKAGTQIFSEGGLDYLGNPNLVHTQSILAIWACQVVLMGFVYGYRFGGSLLGEGSTRCTPAAPSTHWALATTRRRL

SEQ ID NO: 75197 - DNA, 827 bp, Zea mays
  misc_feature: Ceres CLONE 1559630
  misc_feature: Encodes the peptide sequence at SEQ ID NO. 75198
  misc_feature (643)..(643): n is a, c, t, g, unknown, or other
ctggagctccccgcggtggcggccgctctagaactagtggatcccccgggctgcaggaattcgtctcacccctagaaaaagtcgcacctgcacgccgcggcagcagccaagcctctctcgtctcgtgcggcaagcgccacacagacacccgatggcgctcctgctgctgcgcggctgcgccgcgccgccagccgtccacgcggccccggcggggtcccggctgctccctccggcgctgccgcggcggcggctcgtggccgtcgcctcttcggcctcctccgctccgtccggcgaggtggcgtcgtcgtcccaggacggccgcggctacgggaccgtgggcgggcccaacggccacgccatcgctcccgccacagacaccaagtccaccgccgtcgagaccaccgtcgagagggtgatcttcgacttccggttcctggcactcctcgccgtcgccgggtcactcgccggctccgtcctgtgcttcctcaatggctgtgtcttcatcaaagaggcgtaccaggtttactggtcgagctgtgtcaaaggggttcatacggggcagatggtcctcaaggtcgtcgaggccatcgatgtgtatcttgctggaacagtcatgctgatatttgggaatggtctctacggnctcttcatcagcaacgcttccggcggttgtcctcctgaaatccaacgtgccctcaacgggtcgtcgttgttccgggatgtcccctttgaagaacgcccgaagtgaataaacttcacctcctttgacgagctcaaaaaaaagtgggggccgtcttccggaaaaatctacttttgaagaagttcca

SEQ ID NO: 75198 - protein, 198 aa, Zea mays
  misc_feature: Ceres CLONE 1559630
  misc_feature (88)..(192): Pfam Name: UPF0114 Pfam Description: Uncharacterized protein family, UPF0114
MALLLLRGCAAPPAVHAAPAGSRLLPPALPRRRLVAVASSASSAPSGEVASSSQDGRGYGTVGGPNGHAIAPATDTKSTAVETTVERVIFDFRFLALLAVAGSLAGSVLCFLNGCVFIKEAYQVYWSSCVKGVHTGQMVLKVVEAIDVYLAGTVMLIFGNGLYGLFISNASGGCPPEIQRALNGSSLFRDVPFEERPK

SEQ ID NO: 75199 - DNA, 870 bp, Zea mays
  misc_feature: Ceres CLONE 1559633
  misc_feature: Encodes the peptide sequence at SEQ ID NO. 75200
  misc_feature (641)..(641): n is a, c, t, g, unknown, or other
  misc_feature (642)..(642): n is a, c, t, g, unknown, or other
  misc_feature (821)..(821): n is a, c, t, g, unknown, or other
ctggagctccccgcggtggcggccgctctagaactagtggatcccccgggctgcaggaattcgtctcacccctagaaaaagctttgctcccgttcccatgctgatttttttaggcggctgctggcctgcctgtctccactggaagctccggattacgtagaaaaggggcgggcggcatgaggatccagtgcgacgcgtgcgaggccgcggcggccgcggtggtgtgctgcgccgacgaggcggcgctgtgcgcgcgctgcgacgtggagatccacgccgccaacaagctcgccagcaagcaccagcggctcccgctcggcgacgccgcggcgctccccgccagcctcccgcgctgcgacgtgtgccaggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgccggcgccgcccaagggcagctccaagcccgcggccgtcgtcagcgcgccagctgccgggacgaccaccaaaacaaggacggtcaaggacgcgctgccgcanngaaggtgccgtcctcgccgttcctgccaccgtccgggttgggcccgtcgaggaacctcctcgagctgtcggactacgaatccagcgacaagaaagactcgtctcttgggctcaaagaaagctggagtggttcgagggacatccgacctgttcccacgcccattcgccagctaaaactgnccatgggcggagttcttcgccttcgccgcagcaagtgaagtaacgccgg

SEQ ID NO: 75200 - protein, 212 aa, Zea mays
  misc_feature: Ceres CLONE 1559633
  misc_feature (55)..(102): Pfam Name: zf-B_box Pfam Description: B-box zinc finger
  misc_feature (1)..(47): Pfam Name: zf-B_box Pfam Description: B-box zinc finger
  misc_feature (155)..(155): Xaa is any aa, unknown, or other
  misc_feature (156)..(156): Xaa is any aa, unknown, or other
MRIQCDACEAAAAAVVCCADEAALCARCDVEIHAANKLASKHQRLPLGDAAALPASLPRCDVCQERPAFIFCVEDRALLCRDCDEPIHVPGTLSGNHQRYLATGIRVGFSSVCGASAEGLPPAPPKGSSKPAAVVSAPAAGTTTKTRTVKDALPXXRCRPRRSCHRPGWARRGTSSSCRTTNPATRKTRLLGSKKAGVVRGTSDLFPRPFAS

SEQ ID NO: 75201 - DNA, 858 bp, Zea mays
  misc_feature: Ceres CLONE 1559634
  misc_feature: Encodes the peptide sequence at SEQ ID NO. 75202
  misc_feature (582)..(582): n is a, c, t, g, unknown, or other
  misc_feature (625)..(625): n is a, c, t, g, unknown, or other
  misc_feature (626)..(626): n is a, c, t, g, unknown, or other
  misc_feature (643)..(643): n is a, c, t, g, unknown, or other
  misc_feature (657)..(657): n is a, c, t, g, unknown, or other
  misc_feature (658)..(658): n is a, c, t, g, unknown, or other
  misc_feature (670)..(670): n is a, c, t, g, unknown, or other
  misc_feature (671)..(671): n is a, c, t, g, unknown, or other
  misc_feature (709)..(709): n is a, c, t, g, unknown, or other
  misc_feature (735)..(735): n is a, c, t, g, unknown, or other
  misc_feature (773)..(773): n is a, c, t, g, unknown, or other
  misc_feature (818)..(818): n is a, c, t, g, unknown, or other
  misc_feature (819)..(819): n is a, c, t, g, unknown, or other
tggagctccccgcggtggcggccgctctagaactagtggatcccccgggctgcaggaattcgtctcacccctagaaaaaaccaacacaaagccaaagcgcagcgcagccagagtaagcagagagttgcacttggggaaaaaataccgtgcttcttcagttcttcttcctagcatgcactcgcttgtgaggcgtggcaatggctacggctacggctatggtggttacggcagcagcaatccccatatgaactaccaccgccaaaacaccgagtccgtgaccaccgtcgtcacggagatgaaccgaatggccgtcgacgacaagccctgctacggcggcggcgtgcagaagcaggcctgcaaggtggaggcgttccaggagcacgacgaagcgtacaagggcgccgtggccgtgcagcagaagcactcctccttcaaggaggacaaggaggaggtgcgcggtgctgctgccgccgtcagaagctggcacgacgagttatatcaaggaggaaggaggaggagaagcacgtcgtcgacacggagtacggtgcgcctacccggggggggtgcccgccgccgccgtgnagaaagccggggctacaactacaagcagcacgaggcatacggnngagaccgaaaggtgcangggtacgggctacnngcgcccggcgcnncggcggcgtgaagaagcaagcaggctacagctacgccncaggaggcgtgcggaagagagctacngcggcgctccacaccggtggtgccggtgccgcccgcgnaagactacgcctacgaccagcagcaggccctacagcacaagaacnncgcagggcccgggggccggggtacgttgcttcccttacg

SEQ ID NO: 75202 - protein, 169 aa, Zea mays
  misc_feature: Ceres CLONE 1559634
  misc_feature (137)..(137): Xaa is any aa, unknown, or other
  misc_feature (152)..(152): Xaa is any aa, unknown, or other
  misc_feature (157)..(157): Xaa is any aa, unknown, or other
  misc_feature (162)..(162): Xaa is any aa, unknown, or other
  misc_feature (167)..(167): Xaa is any aa, unknown, or other
MHSLVRRGNGYGYGYGGYGSSNPHMNYHRQNTESVTTVVTEMNRMAVDDKPCYGGGVQKQACKVEAFQEHDEAYKGAVAVQQKHSSFKEDKEEVRGAAAAVRSWHDELYQGGRRRRSTSSTRSTVRLPGGGARRRRXESRGYNYKQHEAYGXDRKVXGYGLXAPGAXAA

SEQ ID NO: 75203 - DNA, 829 bp, Zea mays
  misc_feature: Ceres CLONE 1559636
  misc_feature: Encodes the peptide sequence at SEQ ID NO. 75204
  misc_feature (646)..(646): n is a, c, t, g, unknown, or other
ctggagctccccgcggtggcggccgctctagaactagtggatcccccgggctgcaggaattcgtctcacccctagaaaaaaagccagtggacgcgagtgagtgaacaccagccgtattgtcccgaccccgaccgatcctcgcctgctgctgccatggcgacctccgcagtgctctctatcgccgccaatcccacccagctctgccggtcccgcgcttcgctgggcgagcctgtgaaggggcttggcctgagtcatgggccgcgagcgcgcgcagcggagcattgtgtgcctagtgtggcgaagcagcatctccgccgatcgcgtccaccacgtggagaaccgcacagtctgatgaacctcctcctcctcggcgccatctcgttgcccaccggcgggagggtcgtcccctacggcgcctctctcgtccctgccggctccggaaacatcggatgcttgacctccgctaacgacttgctgggcaccgacatcgcagtcgagagtctgatcacagttcatagctacacttaccgttgactcgagaaggagctcttgcgtgaacacacggttcgttcgctggagcgaccttgtacgctggtcgcctacgggttgacgacgtgtgcaatcacctacggacggttaaagttgngggaacggatccagatacaactcatctgccatgacacggatccctcagtgcacatcctgggcagggaggtcttggtaccgtgaaccctgttgctagccccgggtgctccccccgggccagattttccaagaacctttcgttccggggtttaaagcccaattggggatcccgaaaaacccaggg

SEQ ID NO: 75204 - protein, 126 aa, Zea mays
  misc_feature: Ceres CLONE 1559636
  misc_feature (62)..(94): Pfam Name: CytB6-F_Fe-S Pfam Description: Cytochrome B6-F complex Fe-S subunit
  misc_feature: SWISSPROT Homolog: EC 1.10.99.1 Plastoquinol--plastocyanin reductase
MATSAVLSIAANPTQLCRSRASLGEPVKGLGLSHGPRARAAEHCVPSVAKQHLRRSRPPRGEPHSLMNLLLLGAISLPTGGRVVPYGASLVPAGSGNIGCLTSANDLLGTDIAVESLITVHSYTYR

SEQ ID NO: 75205 - DNA, 895 bp, Zea mays
  misc_feature: Ceres CLONE 1559638
  misc_feature: Encodes the peptide sequence at SEQ ID NO. 75206
  misc_feature (566)..(566): n is a, c, t, g, unknown, or other
  misc_feature (773)..(773): n is a, c, t, g, unknown, or other
ctggagctccccgcggtggcggccgctctagaactagtggatcccccgggctgcaggaattcgtctcacccctagaaaaactgctttgctcccgttcccatgctgatttttttaggcggctgctggcctgcctgtctccactggaagctccggattacgtagaaaaggggcgggcggcatgaggatccagtgcgacgcgtgcgaggccgcggcggccgcggtggtgtgctgcgccgacgaggcggcgctgtgcgcgcgctgcgacgtggagatccacgccgccaacaagctcgccagcaagcaccagcggctcccgctcggcgacgccgcggcgctccccgccagcctcccgcgctgcgacgtgtgccaggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgccggcgccgcccaagggcagctccnagcccgcggccgtcgtcagcgcgccagctgcggggacgaccacaaaacaggacggtcaaggagcgctgccgcaagaggtgccgtcctcgcgtttctgccaccgtccggttgggccgtcgaagacttcctcgagctgtcggactacgaatccggcaacagaaaaactcctctctttggctcagggaactggatggtttcaagacatcnaactgtttcacccccattcgcagctaaacctgcctggcggaattcctcccctccccccacccggggaaaaacccgggttttaaaagggaaagggggccccctttttcaaagcccgggagagg

SEQ ID NO: 75206 - protein, 225 aa, Zea mays
  misc_feature: Ceres CLONE 1559638
  misc_feature (55)..(102): Pfam Name: zf-B_box Pfam Description: B-box zinc finger
  misc_feature (1)..(47): Pfam Name: zf-B_box Pfam Description: B-box zinc finger
  misc_feature (130)..(130): Xaa is any aa, unknown, or other
  misc_feature (199)..(199): Xaa is any aa, unknown, or other
MRIQCDACEAAAAAVVCCADEAALCARCDVEIHAANKLASKHQRLPLGDAAALPASLPRCDVCQERPAFIFCVEDRALLCRDCDEPIHVPGTLSGNHQRYLATGIRVGFSSVCGASAEGLPPAPPKGSSXPAAVVSAPAAGTTTKQDGQGALPQEVPSSRFCHRPVGPSKTSSSCRTTNPATEKLLSLAQGTGWFQDIXLFHPHSQLNLPGGIPPLPPPGEKPGF

SEQ ID NO: 75207 - DNA, 853 bp, Zea mays
  misc_feature: Ceres CLONE 1559639
  misc_feature: Encodes the peptide sequence at SEQ ID NO. 75208
ctggagctccccgcggtggcggccgctctagaactagtggatcccccgggctgcaggaattcgtctcacccctagaaaaacccgtccgtctctcgttctctccttcctatcggctccacacctccacgcaactggaagcttcgctgcaatctgccctactcctcttccgccgcctccaacaccgcagacgcagctgccgcgggcgggagcttggacgtgctacgctgctctcatctcgtttccgcgcagttcaggaattgttctcaatggcccgcgtgtatgttggcaacttggattcacgggtgacttctggggaactcgaagatgagttccgcgtgtttggagttctgcgaagtgtttggattgcacgtaaaccacctggctttgcatttattgattttgacgacaggaggaatgcggaggatgctattcgtgatctagatggtaagaatggatggagagttgaactatctcgtaattccagtggtcgtggtggtcgtgatcggtatggtggatctgagtcgaagtgctatgaatgtggtgagactgggcactttgcacgtgaatgtcgtctgcgcattggctctggaggtctaggcagtggaagacgtcgcagtcgcagccgcagtcgcagtcgcagtcgcagcaggagcaggagcagaagccgcagccctagataccgcaggagtccaagctatagtagaaggagctatagccctcgttatcgctctccaaggcgccgtagtccttcgccagctcgcgcgcgcagctatagcaagtcaccatagtacaactgcaacgatgctgttatgcacaggtaatggtggcaggtactggtgtagcaggagctagc

SEQ ID NO: 75208 - protein, 173 aa, Zea mays
  misc_feature: Ceres CLONE 1559639
  misc_feature (4)..(70): Pfam Name: RRM_1 Pfam Description: RNA recognition motif. (a.k.a. RRM, RBD, or RNP domain)
  misc_feature (86)..(103): Pfam Name: zf-CCHC Pfam Description: Zinc knuckle
MARVYVGNLDSRVTSGELEDEFRVFGVLRSVWIARKPPGFAFIDFDDRRNAEDAIRDLDGKNGWRVELSRNSSGRGGRDRYGGSESKCYECGETGHFARECRLRIGSGGLGSGRRRSRSRSRSRSRSRSRSRSRSPRYRRSPSYSRRSYSPRYRSPRRRSPSPARARSYSKSP

SEQ ID NO: 75209 - DNA, 872 bp, Zea mays
  misc_feature: Ceres CLONE 1559640
  misc_feature: Encodes the peptide sequence at SEQ ID NO. 75210
  misc_feature (557)..(557): n is a, c, t, g, unknown, or other
  misc_feature (785)..(785): n is a, c, t, g, unknown, or other
ctggagctcaccgcggtggcggccgctctagaactagtggatcccccgggctgcaggaattcgtctcacccctagaaaaattaattctccagaagaaattaaccaggtagcaaccatttctgcaaacggtgaaaaggaaattggagatctaatatcaaaagctatggaaaaagttggaaaggatggagtcattactattgttgatggcaaaacattggacaatgagcttgaagcagtacagggaatgaagctgtccagaggatacatatctccttactttgtgactgatcaaaagactcagaaatgtgagatggagaaccctcttattcttatccatgacaagaaaatctcaaacatggattctctccttccagcattagaaatttctatcaagaatcgcaagcctcttctcattgttgctgaggatgttgaaggagatgctctgtcaatgcttgtactgaacaagcatcgtgctggactcaaggtatgtgctgtcaaagctcctggatttggtgaaaatagaaggcacaatctagatgacatggctgtgatgactnggaggagaggttattagcgaggaacgcggtcttgatcttggcaaagttcaattacaaatgcttggcactgctaaaaaggtaagtgtatcccttgatgatactatcatcctagaatggtggaggtgacaaacgcagattagaggagaggtgccaacagcttagagactcaattgacacaagcactgctgtattcgacaaagaaagggcccaagagcgtttatctagttnattctgggaggtgttgctgtaactcaagattgggtggagctaggtgaaagctgaaagttgtgagaaaaaagatagggtgacagatgc

SEQ ID NO: 75210 - protein, 136 aa, Zea mays
  misc_feature: Ceres CLONE 1559640
  misc_feature (132)..(132): Xaa is any aa, unknown, or other
MEKVGKDGVITIVDGKTLDNELEAVQGMKLSRGYISPYFVTDQKTQKCEMENPLILIHDKKISNMDSLLPALEISIKNRKPLLIVAEDVEGDALSMLVLNKHRAGLKVCAVKAPGFGENRRHNLDDMAVMTXRRGY

SEQ ID NO: 75211 - DNA, 789 bp, Zea mays
  misc_feature: Ceres CLONE 1559641
  misc_feature: Encodes the peptide sequence at SEQ ID NO. 75212
  misc_feature (539)..(539): n is a, c, t, g, unknown, or other
  misc_feature (542)..(542): n is a, c, t, g, unknown, or other
  misc_feature (543)..(543): n is a, c, t, g, unknown, or other
ctggagctcaccgcggtggcggccgctctagaactagtggatcccccgggctgcaggaattcgtctcacccctagaaaaaatctcgactctcccaagtcacaaccctcgacctcccccctactccaactactggaagcgccgatccatcaggttctgatcgattcttctgccccgatccgcagcggcaagcggagatgaactgcgagacctgtcagctgaaagaactggagctggaactgacggagatcagggatgttctgcgctgtattttgcacaccatattcttccatagaaccctcagcctggttcgccccaaagatgttgactgtgatttcctcgatattacttatgtacaatgtggtctaccggaactagaaaaggaagttgacgaaaagatagaccagttcagtgcatgggtggagaaacacccagaccgcagaagccagatctgcctctcctttttcgacgagaagcacagacaccctggttgggttgatcacaaaacagagcgcatctattgggagcaatggctcatcanttnngcagtcatgttccccaaaagatacagtcagtcaaacagcttccaagggctgacaaacatccaagcaaatgcgctggagaagaccgcccaaaggcgtgcttcattggaagggtcaataaacaaatgggtggttccggaacctaaagtcccccaaccgaaaaaaggacccatttctgggtttccttggaggggtttttcatcccgaaaacctgagtcccaacccgggaattctgattttgggtgggaa

SEQ ID NO: 75212 - protein, 198 aa, Zea mays
  misc_feature: Ceres CLONE 1559641
  misc_feature (9)..(141): Pfam Name: DUF1649 Pfam Description: Protein of unknown function (DUF1649)
  misc_feature (115)..(115): Xaa is any aa, unknown, or other
  misc_feature (116)..(116): Xaa is any aa, unknown, or other
MNCETCQLKELELELTEIRDVLRCILHTIFFHRTLSLVRPKDVDCDFLDITYVQCGLPELEKEVDEKIDQFSAWVEKHPDRRSQICLSFFDEKHRHPGWVDHKTERIYWEQWLIXXAVMFPKRYSQSNSFQGLTNIQANALEKTAQRRASLEGSINKWVVPEPKVPQPKKGPISGFPWRGFSSRKPESQPGNSDFGWE

SEQ ID NO: 75213 - DNA, 888 bp, Zea mays
  misc_feature: Ceres CLONE 1559644
  misc_feature: Encodes the peptide sequence at SEQ ID NO. 75214
  misc_feature (453)..(453): n is a, c, t, g, unknown, or other
  misc_feature (467)..(467): n is a, c, t, g, unknown, or other
  misc_feature (470)..(470): n is a, c, t, g, unknown, or other
  misc_feature (608)..(608): n is a, c, t, g, unknown, or other
ctggagctccccgcggtggcggccgctctagaactagtggatcccccgggctgcaggaattcgtctcacccctagaaaaagcgccgcttgctttgtccgttgtcgcagagcgaggaagcacgcagagagtgagtaaaagaaagagagggatgccgatggagaggtcggtgtcgtgcgcggagaggggcagcacgttcggcggcggggcggcggtggacgtccggagctacagcgcctcctacgcgaggccccagccgcggccgccgacgtccagggtgcagcgcgccaggagcgtgagcgcgtggacgcgcccggcgccgccgcccgtgcagcggaccgggagcaccaagagcggcgccgccgcggcccgccccaccccggggctcaacctgcgctcgtacagcgcctcctacgcggcctcctacggccccagccttgtcggcggcggcggcngggcggcggtggcngcngggaagctgaagcgctccggcagcgtcaccaactggacctccgccaaccgccgctccgtcaacctcagggggtacacgccgtccttcgccgcgctggacgacaccgccgcggcggtcccggcgcccaggaaggtgcangcggtgatggacgacgccgagctgcagcggaggaagcgcctggtcgtgtacaagacctacgacgtcgaggggaaggtccgggagtcggtgcgccgcggcgtgaactgggatcagggcagtgctccagcgtggtgtacggcttggtggtgatcgctagcttcatcgtccgcctagcccaccccgccacgggcgatctctccgccgttccggtccaccagagtggtactactaccctatgagttgagctttttcttggtgccacgccaccgtacctccttct

SEQ ID NO: 75214 - protein, 202 aa, Zea mays
  misc_feature: Ceres CLONE 1559644
  misc_feature (102)..(102): Xaa is any aa, unknown, or other
  misc_feature (153)..(153): Xaa is any aa, unknown, or other
MPMERSVSCAERGSTFGGGAAVDVRSYSASYARPQPRPPTSRVQRARSVSAWTRPAPPPVQRTGSTKSGAAAARPTPGLNLRSYSASYAASYGPSLVGGGGXAAVAAGKLKRSGSVTNWTSANRRSVNLRGYTPSFAALDDTAAAVPAPRKVXAVMDDAELQRRKRLVVYKTYDVEGKVRESVRRGVNWDQGSAPAWCTAWW

SEQ ID NO: 75215 - DNA, 860 bp, Zea mays
  misc_feature: Ceres CLONE 1559646
  misc_feature: Translation starting site: 252
  misc_feature (683)..(683): n is a, c, t, g, unknown, or other
ctggagctcaccgcggtggcggccgctctagaactagtggatcccccgggctgcaggaattcgtctcacccctagaaaaaagccagccaggcccaggagcgcgagttctgtgcctgtgcctctgctccacctcccctgcccctgcgccccaagtccacgtccaccactcagcactcacgctgctcgctcgctcgctcgtacacgcgcccgcttcgcgcagggaaggaaccgtgggagggaagcggacggacatgatgcacgccaagtcggagtcggacgtgacgagcctggcggcgtcgtcgccgcctcggtcgccgaagcggggcggcggcggcgccggcaacggcggctactacgtgcagagcccgtcgcgggagtcgcacgacggcggctacaagtcctcgtcgatgcagcccacgccggtctacaacagccccaacgagtcgccgtcgcacccctcctacggccgccactcccgctcctcctccgtcagccgcttctccggcaacctccgcaagggcgccgccggggaccgcaaggtgctcaacgacaaggggtggcccgagtgcaacgtcatcgaggaggagggcccgtacgaggacctcgccggcgatagcggcctctcccgccgctgccagatcatactcggcttcctcaccttcgtcctcctcttcaccgtctcntgggcctcatcatctgggggcgccgcccgggccgtacgaagcccgaggtcatcgtcaagaagcttggtgatggacgactttctacgcgggtgaaggcacggaaccacagcggcgttccaacaaaattggtcacaacaaactgttctctgcacataggctgtctacaaccctgccaca

SEQ ID NO: 75216 - DNA, 753 bp, Zea mays
  misc_feature: Ceres CLONE 1559647
  misc_feature: Encodes the peptide sequence at SEQ ID NO. 75217
  misc_feature (520)..(520): n is a, c, t, g, unknown, or other
  misc_feature (524)..(524): n is a, c, t, g, unknown, or other
  misc_feature (608)..(608): n is a, c, t, g, unknown, or other
  misc_feature (612)..(612): n is a, c, t, g, unknown, or other
aagctggagctccccgcggtggcggccgctctagaactagtggatcccccgggctgcaggaattcgtctcacccctagaaaaaaggcagagatgccaacagaagtcacgtcgacaccagccagccggccggactgcagctcgtcgtcgtcgatgacggccgggaccatgcgtgtgctaggcggggaggtcagcccgttcacggcgcgggcgcgtctggcgctggatctgcgcggcgtggcgtacgagctcctcgacgagccgctggggcccaagaaaagcgacagactcctcgctgccaaccccgtctacgggaagatccccgtgctgctcctccccgacggccgcgccatatgcgagtccgcagtcatcatccagtgcatcgaggacgtggcgcgtggaagcggcggcgccgaggctagcagcctgctgctgccggacgacccctacgagcgcgccatgcaccgcttctggaccgccttcatcgaccaacagttttggcgggcgctgatgccgtctccntggncgcgaccccgggagcacgcgcgcaggccgtggaagacaaccgcgccgcgctgagcctctgggaggtggcgttcaagggacgcanccancggcaaggctttccttctccggtggccaaccccgggccaggccctccctggaacttggccttttggatggcttcctgccggggccttagggggctggggaaaaaggtttcaccgggcctttcattttattggaaccggttc

SEQ ID NO: 75217 - protein, 141 aa, Zea mays
  misc_feature: Ceres CLONE 1559647
  misc_feature (4)..(79): Pfam Name: GST_N Pfam Description: Glutathione S-transferase, N-terminal domain
  misc_feature: SWISSPROT Homolog: EC 4.4.1.5 Lactoylglutathione lyase
  misc_feature (125)..(125): Xaa is any aa, unknown, or other
MTAGTMRVLGGEVSPFTARARLALDLRGVAYELLDEPLGPKKSDRLLAANPVYGKIPVLLLPDGRAICESAVIIQCIEDVARGSGGAEASSLLLPDDPYERAMHRFWTAFIDQQFWRALMPSPWXRPREHARRPWKTTAPR

SEQ ID NO: 75218 - DNA, 806 bp, Zea mays
  misc_feature: Ceres CLONE 1559649
  misc_feature: Encodes the peptide sequence at SEQ ID NO. 75219
  misc_feature (682)..(682): n is a, c, t, g, unknown, or other
ctggagctccccgcggtggcggccgctctagaactagtggatcccccgggctgcaggaattcgtctcacccctagaaaaacgcaccaccgccgcgccgcccaaatcacagccaccgccgccatggccgcctccagccgccctctcgtctccgtgaaagccctggagggcgacatggtcacggacgcccccggcatcgccttgccgcccgtcttcggtgcgccgatccgcccggacgtggtccgcttcacccacaagctgctgtcctgcaacaagcgccagccttacgcagtctcccgccgcgctggccaccagacgtcggccgagtcctggggtacgggccgcgctgtgtcccgtatcccccgcgtccccggcggcggcacccaccgcgccggccagggagcattcggcaacatgtgccgcggcggacgcatgttcgcgcccaccaagatctggcgcaagtggcaccgccgcgtcaacgtcaacctccgccgcgtcgccgtcgcctcggcgctcgccgccaccgccgtcccggccctcgtccaggcgcgcggccaccgcatcgagaccgtcccagagatgcccctggtcatctccgactcggcggagtccatcgagaagacctcccaggcgctcaagatccctcagcaggtcggcgcctacgccgacgccgagaaggccaanggactcgtcggcatccgccccgggcagggtaagatggcgcaccgccgctacattaaccgcaggggcccgctcgtcgtctacggcacaaaaggctcaaggtcgttcaggctttccgcacctcccc

SEQ ID NO: 75219 - protein, 228 aa, Zea mays
  misc_feature: Ceres CLONE 1559649
  misc_feature (23)..(226): Pfam Name: Ribosomal_L4 Pfam Description: Ribosomal protein L4/L1 family
  misc_feature (187)..(187): Xaa is any aa, unknown, or other
MAASSRPLVSVKALEGDMVTDAPGIALPPVFGAPIRPDVVRFTHKLLSCNKRQPYAVSRRAGHQTSAESWGTGRAVSRIPRVPGGGTHRAGQGAFGNMCRGGRMFAPTKIWRKWHRRVNVNLRRVAVASALAATAVPALVQARGHRIETVPEMPLVISDSAESIEKTSQALKIPQQVGAYADAEKAXGLVGIRPGQGKMAHRRYINRRGPLVVYGTKGSRSFRLSAPP

SEQ ID NO: 75220 - DNA, 881 bp, Zea mays
  misc_feature: Ceres CLONE 1559655
  misc_feature: Encodes the peptide sequence at SEQ ID NO. 75221
  misc_feature (182)..(182): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
ctccccgcggtggcggccgctctagaactagtggatcccccgggctgcaggaattcgtctcacccctagaaaaaggtcaggtgaggggtaggtgaagtgggaaggcgcgcggaggggaggagaggagaggaggatggctgcggcagcggggaggaaagtggcggtcgccgccgtgcagttcncctgcaccgacctcgaggcggagaacgtcgccaccgccgagagggtggttagggaaagcaacaagaaaggtgcggagattgtactcgctcacgcattgttttaggggggcgattttttccacctccccaaaaacggaattttttttgcgggctaggccttacaaggccacccacctcttataaagatgcaacgcttgcaaaaagactcggaaagtaggccgatctctcctgcgtttttcgaagaagcaaacatgcacattataatttcggtggctaattatccatgctgaatggcgctcaaactttggactctcattcgccaattccccccttttcccagggggcccgggatatttcagaagagnnnnnaattttttttcccacaccccgggggaaacctcgggtgtttatagatactacggggnnnnnnncaacaccgtatggccccacccattggttgttgaatctgcctggggatcagtgggtttttcaaagggtgccagaaaccaatgccccttctggggggcttgaaaatactggtttttatcccccctggcaatttggtccccaaaccccccggatatgtaaaccccggaatttcccgtgaccatttgggaaaacgggtttattccaaggggccctggctggttgccccacctcttggggccccccctcggttgcttttccaacccggatgtg

SEQ ID NO: 75221 - protein, 50 aa, Zea mays
  misc_feature: Ceres CLONE 1559655
  misc_feature: SWISSPROT Homolog: EC 3.5.1.53 N-carbamoylputrescine amidase
  misc_feature (17)..(17): Xaa is any aa, unknown, or other
MAAAAGRKVAVAAVQFXCTDLEAENVATAERVVRESNKKGAEIVLAHALF

SEQ ID NO: 75222 - DNA, 831 bp, Zea mays
  misc_feature: Ceres CLONE 1559660
  misc_feature: Encodes the peptide sequence at SEQ ID NO. 75223
  misc_feature (633)..(633): n is a, c, t, g, unknown, or other
ctcaccgcggtggcggccgctctagaactagtggatcccccgggctgcaggaattcgtctcacccctagaaaaactactctactctccttcggcaaagaaagcaagtcagcctcaccctctcacaccaccgccactcactcagtgctccaccccaagaaccaagcagctcacccccatggcatcctacgacaaggccttcgaatcctacaagaaggccctcaccaccgccgcgtccgtcgctgcgtccatgatgctggtgcgcagcgtcatgaacgagttggtgccgcccgagttgcgcgatctgatcttctccggcttcggctacctgcgctcgcgcacgtcgtccgaccacaccatcatcgtcgagaagaagaacgacgggttcgctaacaactacgtctactgcgctgtgaagacttacctcgccacgcgcatgaacaccgacatccagcagcgcctgcgcgtcagcagcatggacgaggacgacaagatgatggtcagcatggatgagggcgacgagatgctcgatgtttatcaaggcacggagttcaagtggtgccttgtctgcaaagacaactcagatgactccctcaacagcagccagaacgagtcccacttcttcgagttgaccnttcagcaggaagcacaaggacaaagccctcagatcggaactcccgtttcatttgggccaagccaaggcccttaaagccccaggaaaaaaccctcatggaaccacatgactggaattccggaattggggcccccaatggaacttcaccccccatctaaattccgaaaagcttggccttggaaacaaaaagctgaaacct

SEQ ID NO: 75223 - protein, 176 aa, Zea mays
  misc_feature: Ceres CLONE 1559660
  misc_feature (153)..(153): Xaa is any aa, unknown, or other
MASYDKAFESYKKALTTAASVAASMMLVRSVMNELVPPELRDLIFSGFGYLRSRTSSDHTIIVEKKNDGFANNYVYCAVKTYLATRMNTDIQQRLRVSSMDEDDKMMVSMDEGDEMLDVYQGTEFKWCLVCKDNSDDSLNSSQNESHFFELTXQQEAQGQSPQIGTPVSFGPSQGP

SEQ ID NO: 75224 - DNA, 901 bp, Zea mays
  misc_feature: Ceres CLONE 1559664
  misc_feature: Encodes the peptide sequence at SEQ ID NO. 75225
  misc_feature (1)..(1): n is a, c, t, g, unknown, or other
  misc_feature (678)..(678): n is a, c, t, g, unknown, or other
  misc_feature (695)..(695): n is a, c, t, g, unknown, or other
nctggagctcaccgcggtggcggccgctctagaactagtggatcccccgggctgcaggaattcgtctcacccctagaaaaagaacagcatcagctgccacctccttccttccttcctgcataggttgctacacgtatatattctgaagaagagatcgagatgaccagcgtgtggaagaccaaggttctgcctggcctcaacaagatctttgacaaggatggcaagaaggctgcagctgcaggcttcttgaagtccttcaacaaggaggagattgacaaggagattgaggacaagaagacagagctggagcccaaggtcgtggaggcctacgaagcatctcctcctgaggtcaaggctctgttcaaggataagaagccagtcaaggtcagcaagaagaactcggctgcagtcaccaagttcctcgatgagctggctaagattgacttccctggagccaaggtggtgagcgaggcggtggccaagtccggcacctcgcccctgcttccggcgatcaccttcatcttggacaaggtcgcaccgtttatccccaaggaggagcccaaggcggagccggcggcggaggccacctcccgggaagtcgccgtggaggagaagaaggaggaggccgagccagctgcagcgacggaggcggcaccggcgccggcagagacaccgtcngaaggcggccgtggtanaacgagaagaagggagcagagaagaacgaagaaggaggataagccggctgccgaaagaggctgcgccgccagcagaagcagcagctgctgctgaaggagaagtgatccctgttgacggatcgagcatgcaaagctctcccctcctcgctccccttgcttgctatgcttgccttgctgctggtaaaattaaaattaagttgccgggg

SEQ ID NO: 75225 - protein, 209 aa, Zea mays
  misc_feature: Ceres CLONE 1559664
  misc_feature (2)..(196): Pfam Name: DREPP Pfam Description: DREPP plasma membrane polypeptide
  misc_feature (179)..(179): Xaa is any aa, unknown, or other
MTSVWKTKVLPGLNKIFDKDGKKAAAAGFLKSFNKEEIDKEIEDKKTELEPKVVEAYEASPPEVKALFKDKKPVKVSKKNSAAVTKFLDELAKIDFPGAKVVSEAVAKSGTSPLLPAITFILDKVAPFIPKEEPKAEPAAEATSREVAVEEKKEEAEPAAATEAAPAPAETPSEGGRGXTRRREQRRTKKEDKPAAERGCAASRSSSCC

SEQ ID NO: 75226 - DNA, 1313 bp, Zea mays
  misc_feature: Ceres CLONE 1559665
  misc_feature: Encodes the peptide sequence at SEQ ID NO. 75227
actccatctccactccacccttacccggctgcctgcccctcccctctctcctctctctctctctctcccatccaggcctcctctcccctctctgcctgtcgcccatgaggatcaggcggcggccgcagcccgccgcctcagatctggccgcatccaccgcgccgcagatcccgccgccgaatgccgcgaggaaccgcgggtggctgctggcaggcgagggcgagggcgaggacgaggatcgcgaggccaggatgctgcgtgcgagcgcggatctcgcgcacgaatctggagccagcaggcgcatggcattgccgcaggacgacaatgcggcggccgtgctggtggtggatcgcggcggcaggagcttgggcgcaccgcgtggcgctgctgatggccgcatgagaatcagtgcggtgaacggctacgatccggcggcggcggcggtgaaggcggaggcggaggcacgacgggagacgagcaacggctccgtgcatcccgccgcgccggcgccggcgccgcccgtggccgtggcggcggcctccaaggacgaggggaggaagcagcagcaggccgccggcaagaagcggcgcggccccgcggtgctgctggaggggtcgcggtgcagccgcgtgaacgggcgcgggtggcggtgcagccagccgacgctggtcggctactcgctctgcgagcaccacctcggcaagggccgcacgcggaccgcggcgggtgccgccttggcccgtggcgccgccgccggcggcgtgggccggctcgggcgcaccgagcacggggccgccgccgccatcgccacggcgccgccgctgcccaaggccgagggccccagcctgccgggctgctagcaggctagctaggcgggtcgggactgcggaactctttcgtatcgtccgatcggtgtgggtggcggtggtggtcgtcgctcgtcgggcgatgtgaaccctcgcccgccgcgtttcgtgggagtttggatgtcggcggtggcatggcatggacgcacagtgaagcgacccggcgttcgtggcgtggtgggtctctcgctctctgtctctgctgccgaccgacgccgtgccagaattattgcggctatatatatatacaatacacatatgcgagttagttccgcgcaacttgtatcattcatcggtgcaacttggggggtgtaaaaaattgctggaggcggcgagcatgaaaaaatgtagagaaacggagaactgcaagctgggattcatgcaatcaatcaatcaataacgctacgggcgggcacaccttttcgaattcaaaaaaaaaaaaaaaaa

SEQ ID NO: 75227 - protein, 251 aa, Zea mays
  misc_feature: Ceres CLONE 1559665
  misc_feature (167)..(212): Pfam Name: WRC Pfam Description: WRC
MRIRRRPQPAASDLAASTAPQIPPPNAARNRGWLLAGEGEGEDEDREARMLRASADLAHESGASRRMALPQDDNAAAVLVVDRGGRSLGAPRGAADGRMRISAVNGYDPAAAAVKAEAEARRETSNGSVHPAAPAPAPPVAVAAASKDEGRKQQQAAGKKRRGPAVLLEGSRCSRVNGRGWRCSQPTLVGYSLCEHHLGKGRTRTAAGAALARGAAAGGVGRLGRTEHGAAAAIATAPPLPKAEGPSLPGC

SEQ ID NO: 75228 - DNA, 817 bp, Zea mays
  misc_feature: Ceres CLONE 1559667
  misc_feature: Encodes the peptide sequence at SEQ ID NO. 75229
agctccccgcggtggcggccgctctagaactagtggatcccccgggctgcaggaattcgtctcacccctagaaaaaatcgccgcaagccaatctgtctccgccaggcgccaagccaaccctcaccaccacccgtccacccccatcagtgcatcaccgctcacagcctttactcgccaccgcagcaccccctgctcggccgcccgctcccgcgttcccacatctctctctctctggctctctgctcgccacgcgccgtaccagcgccgcgcgccacatggctccctcgttcactagcctcctctcggccgcgaactccgccgccgcctcgcggctcccctcggccgccgccggacgggcatccactttcgtgcgcttcccgcatcacccgacgggctgggctggggcctccgtcgcggcgccgcgtacggcgcgcaagcgggcacccggcgtcgcctacgccaccgcagctaccgagaagagcatctacgactacaccgttaaggacattgatggaaaaagatgttcctcttaaaaagttccaagaataaggggttgctgaatgttaaaccttccttctccaaggtggggttgccaaccgccaaatttcacctgaaaattttttctattttttggaaaagttcaaaaccccgggggttggaaaatcttgaattttttttgaaaaaaattttggggcccaaaaaacccggggaaaaaaaaccccaaaaaaaaacctttttgcgttggtaaaaaaaataaaagacgggaaattttccccaaatttttttaaaaagggggtgggtttcctcccgcgggccc

SEQ ID NO: 75229 - protein, 85 aa, Zea mays
  misc_feature: Ceres CLONE 1559667
  misc_feature: SWISSPROT Homolog: EC 1.11.1.12 Phospholipid-hydroperoxide glutathione peroxidase
MAPSFTSLLSAANSAAASRLPSAAAGRASTFVRFPHHPTGWAGASVAAPRTARKRAPGVAYATAATEKSIYDYTVKDIDGKRCSS

SEQ ID NO: 75230 - DNA, 887 bp, Zea mays
  misc_feature: Ceres CLONE 1559668
  misc_feature: Encodes the peptide sequence at SEQ ID NO. 75231
  misc_feature (849)..(849): n is a, c, t, g, unknown, or other
aaagctggagctccccgcggtggcggccgctctagaactagtggatcccccgggctgcaggaattcgtctcacccctagaaaaacaaaactagaaaaattcgaggagacgctgtaccagaagacctccgacgggaagccgttcgtggacgtgctcatcgcgggcggagtggtccctgggatcaaggtcgacaagggcaccgtggagatcgcgggcaccgacggcgagaccaccacgcagggcctcgactccctgggcgcgcgctgcgccaagtactacgaggccggcgcgcgcttcgccaagtggcgcgccgtgctcaaggtcggccccgcggggcaggggcagccctccgagctcgccgtcaggcagaacgccgagggcctcgcgcggtacgcgctcatctgccaggagaacgggctggtgcccatcgtggagcccgagatactcaccgacggcggccacgacatcgggacctgcgccgccgccacggagcgcgtcctcgccgccctctacaagtcgctcagcgaccacaaagtcctgctcgaggccacgctcctcaagaccaacatggtcacccccggttccgatagccccaaggtctccgcggaggtgatagcggagtacacggtggcggcgctgcggcgcaccgtgccgccggcggtgcccgggggtggtgttcctgtcgggcgggcaaagcgaggaggaagcgacgcaaaacctggacgctatgaacaagctggaggtgctcaagcccctggacgctgtccttctccttcggccgcgcgctgcagcagagcacccttcagaagtgggtcggcaagaaggagaacgtcgccgccgcgcaggccanccttcgtcgtccgctgcaacggccactccgaggcggcc

SEQ ID NO: 75231 - protein, 107 aa, Zea mays
  misc_feature: Ceres CLONE 1559668
  misc_feature: SWISSPROT Homolog: EC 4.1.2.13 Fructose-bisphosphate aldolase
  misc_feature (95)..(95): Xaa is any aa, unknown, or other
MVTPGSDSPKVSAEVIAEYTVAALRRTVPPAVPGGGVPVGRAKRGGSDAKPGRYEQAGGAQAPGRCPSPSAARCSRAPFRSGSARRRTSPPRRPXFVVRCNGHSEAA

SEQ ID NO: 75232 - DNA, 852 bp, Zea mays
  misc_feature: Ceres CLONE 1559672
  misc_feature: Translation starting site: 366
ctggagctccccgcggtggcggccgctctagaactagtggatcccccgggctgcaggaattcgtctcacccctagaaaaaacactcgcttgagcatatagtgtgctcttctcttcctcttccagttggtattctttatctgaaacatagtacagaggaggagaggagaacgagagctaagaagatgaccggcaaggttctccttgtggccgtccttatcttggtgggcgtggcctctcgatgctcgggcagtaggggcctgcagggcgatcacgttgctgaacagaagttcggtggcggtggctatggaggtggcggtgggtacggaggctacggcggcggtggaggaggaggggttggtggggtatgcccggcggcggcacccaccgcgccggccacccagcattcggcaacatgtgccgcggcggacgcatgttcgcgcccaccaagatctggcgcaagtggcaccgccgcgtcaacgtcaacctccgccgcgtcgccgtcgcctcggcgctcgccgccaccgccgtcccggccctcgtccaggcgcgcggccaccgcatcgagaccgtcccagagatgcccctggtcatctccgactcggcggagtccatcgagaagacctcccaggcgctcaagatcctcaagcaggtcggcgcctacgccgacgccgagaaggccaaggactccgtcggcatccgcccccggcaagggtaagatgcgcaaccgccgctacattaactgcaagggcccgctcgtcttctacggcacaaaaggctccaaggtcgtcaaggcctttcgcaacctccccggcgtggaccgtcttcaacttcgagcgcctcaaatggctcga

SEQ ID NO: 75233 - DNA, 1645 bp, Zea mays
  misc_feature: Ceres CLONE 1559677
  misc_feature: Encodes the peptide sequence at SEQ ID NO. 75234
aaccgggcagagcggaggggtgccggtgtccggactccggagagaatggcggccactcttctcccgaccttatcgccgcccgtttcgcgcgccgccgccgctttcctcctccgacgagccccactgaagccctcccattatgtgcacccaccttctactctccgccgcttactcatctcctcctatccagcaatccctgccatgtgccccctctccaccatgtcgtccaccactgccgctcgcgccgtcccggtccgccgtgacctcctcatgctcggcatcgagaccagctgcgacgacactgcggctgctgtggtgagaggtgatggcgagatccttagtcaagtagtatcttcccaagcggatttgctcgcgaggtatggtggtgttgcccctaagatggccgaggaagcacacgcccttgtgattgaccaggttgttcaaaaggctcttgacgatgcaaaattgtcagaaagtgatctttctgcagtcgctgtgaccattggaccaggacttagtctatgccttagagttggtgttcataaagctagacaggtagcaaaagcatttggcttgcctattgttggagttcatcatatggaagcacacgcattagtttccaggctagcgaataaggaccttgatttcccatttctggctcttctaatttccggaggacacaaccttcttgttctcgctcatggtcttgggcattacattcaactggggactactatagatgatgcgattggtgaggcatatgacaaatcagcaagatggttgggccttgatatgcggaaaggtggtggtcctgctcttgaagagcttgctctagaaggtgatccaaatgctgttaagttcagagttccaatgcgacagcataaagattgcaatttttcttatgctggactgaagactcaagttcgattggcaattgaatctaagaacttatgtacagaggatattcccgtttcggctgcatcggaggaggacagacaatcaagggcgaacattgctgcctcttttcagcgagttgctgtgttacatttggaagaaaggtgtgagcgagcagttgaatgggcattgaatatggaaccttccatcaaatactttgttgtttcaggaggtgtcgcatcaaacaagtatgttacgactcgcttgaatcatgttgctgggaataatggcctacaacttgtatctcctcctccaagcctttgtactgacaatggtgtcatgattgcttggactgggattgagcattttgttgccgggaggtttgaggacccacctgctgctgatgagtctgatgatatgcagtatgagctgcggccaagatggcctcttggtgaggaatattcaaaaggaagaagtgttgcacgatcattgaagactgctcgagtccatccatcactaacgtccatgatacagggctcccttcaaaagtagttgagttggaagttggaaactaattattggtctcagctgctttatgcagttgagtttcccgtcttctagttttgggttcacaaatcagctgatttatctgtattcgctgaattgaagtaacaaacctgcaaaagggccgaactagtttaatagtagatgaggctatatacaaattcagttcgaaaaaaaaaaaaaaaaa

SEQ ID NO: 75234 - protein, 466 aa, Zea mays
  misc_feature: Ceres CLONE 1559677
  misc_feature (96)..(400): Pfam Name: Peptidase_M22 Pfam Description: Glycoprotease family
  misc_feature: SWISSPROT Homolog: EC 3.4.24.57 O-sialoglycoprotein endopeptidase
MAATLLPTLSPPVSRAAAAFLLRRAPLKPSHYVHPPSTLRRLLISSYPAIPAMCPLSTMSSTTAARAVPVRRDLLMLGIETSCDDTAAAVVRGDGEILSQVVSSQADLLARYGGVAPKMAEEAHALVIDQVVQKALDDAKLSESDLSAVAVTIGPGLSLCLRVGVHKARQVAKAFGLPIVGVHHMEAHALVSRLANKDLDFPFLALLISGGHNLLVLAHGLGHYIQLGTTIDDAIGEAYDKSARWLGLDMRKGGGPALEELALEGDPNAVKFRVPMRQHKDCNFSYAGLKTQVRLAIESKNLCTEDIPVSAASEEDRQSRANIAASFQRVAVLHLEERCERAVEWALNMEPSIKYFVVSGGVASNKYVTTRLNHVAGNNGLQLVSPPPSLCTDNGVMIAWTGIEHFVAGRFEDPPAADESDDMQYELRPRWPLGEEYSKGRSVARSLKTARVHPSLTSMIQGSLQK

SEQ ID NO: 75235 - DNA, 856 bp, Zea mays
  misc_feature: Ceres CLONE 1559678
  misc_feature: Encodes the peptide sequence at SEQ ID NO. 75236
  misc_feature (800)..(800): n is a, c, t, g, unknown, or other
  misc_feature (822)..(822): n is a, c, t, g, unknown, or other
ctggagctccccgcggtggcggccgctctagaactagtggatcccccgggctgcaggaattcgtctcacccctagaaaaactctcgctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttggcgatggaggagaagcagatccagcagaacatccagatgagcgtgaacttccttgtttcccttctgaagaagaactggcagaatgtgagatgcctctacgtcaagagcaccatggggaagccatacagggtgttctaagtatngctcttttgtgaagtctgctanggtctggcaccgaggttttattgaattaaactct

SEQ ID NO: 75236 - protein, 216 aa, Zea mays
  misc_feature: Ceres CLONE 1559678
  misc_feature (9)..(212): Pfam Name: Ribosomal_L1 Pfam Description: Ribosomal protein L1p/L10e family
MSKLQSESVKDAISQIVGDAKEKNRKFTETVELQIGLKNYDPQKDKRFSGSVKLPHIPRPKMKVCMLGDAQHVEEAEKMGLDYMDVEALKKMNKNKKLVKRLAKKYHAFLASEAIIKQIPRLLGPGLNKAGKFPTLVTHQESLESKVNETKATVKFQLKKVLCMGVAVGNLAMEEKQIQQNIQMSVNFLVSLLKKNWQNVRCLYVKSTMGKPYRVF

SEQ ID NO: 75237 - DNA, 824 bp, Zea mays
  misc_feature: Ceres CLONE 1559679
  misc_feature (72)..(72): n is a, c, t, g, unknown, or other
  misc_feature (283)..(283): n is a, c, t, g, unknown, or other
  misc_feature (657)..(657): n is a, c, t, g, unknown, or other
  misc_feature (658)..(658): n is a, c, t, g, unknown, or other
tggagctccccgcggtggcggccgctctagaactagtggatcccccgggctgcaggaattcgtctcaccctnctagaaaaatatcagacacaaacacagtctaggaggcttcttccgctcgctcaggtaggtgtactgtactgtactgtagtaggttggttctccattcatcattcagctcacaggtccctccgcctccgccgtatcggagggagatgaagccgaaggcttggaaggagaagagaatgctgtgcggcacgctgaagaagaatacgactacctngctcagggtgtgctgatcggggactcgggcgtcggcaagtcaaacttcctctccagctttcacccgcaacaaggtcttgctctgagttcaagttccccaattcggctttcaaattccccccacggaaacctccttgtttgagggcaaaaaatataaagggcccaaaaattgggaaccccgccacggccaagaaaccggaaaccggggggaaatcccaagggccccacaattttccgggggccccttgggaccccctccccctgtcttttttaacgggggggggaacccccccccccccttttgaaaaaaataaacccccgggggggttaaaaggaagatatttcgggggaacacccccctaaattttaaaaaanngggggttttttttctccccccccccaaaaaaaaaaacccccccctgtggggggcccccctcccgggggggggttctcccccccccaaaaaagaatttttagaaggtgtttccttttataagaaaaaaaaaaaaaacccttcttcttctcttctaatattaaaggag

SEQ ID NO: 75238 - DNA, 772 bp, Zea mays
  misc_feature: Ceres CLONE 1559680
  misc_feature: Encodes the peptide sequence at SEQ ID NO. 75239
  misc_feature (416)..(416): n is a, c, t, g, unknown, or other
ctggagctccaccgcggtggcggccgctctagaactagtggatcccccgggctgcaggaattcgtctcacccctagaaaaaagctcgcactcactcacacccgcagcgaaggagggagcttgcacgggccaacgcacacacaacacaagctcgtcgtcgatggcgcggtgggctgcggtgctggcgctggccgcggccacggccatcgccgtggcgtccgtggcgggcggcgacatgaacgcggacaagacggagtgcgcggaccagctggtgggcctggcgccgtgcctgcagtacgtgcaggggcaggcccgcgcgccgccgcccgactgctgcggcggcctgcgccaggtgctggggaagagccccaagtgcctgtgcgtgctcgtcaaggacaaggacgacccccaacctgngcatcaagatcaacgccacccctcggcgctcgcgcttccccaacgccttgcgggcgccacccgcgccaaacgtctccccactggcgctcaggctcctgcaatattccccccggggctcccaaagaagcccccccgtctttcaagtccccgggcaggcgaacaaaggggcttcccacttgcccggcttcccaagccaaaaggaaaaaaactttcgaacgggggtaaaacaaaaccggaaattcccccgggcgcggcttttgacagggggcaaaaaccaccccggggaaaaaccccggggggttttttcccccttccccctcggggggggggggaaaaaaccccccccccggggtggg

SEQ ID NO: 75239 - protein, 204 aa, Zea mays
  misc_feature: Ceres CLONE 1559680
  misc_feature (33)..(121): Pfam Name: Tryp_alpha_amyl Pfam Description: Protease inhibitor/seed storage/LTP family
  misc_feature (86)..(86): Xaa is any aa, unknown, or other
MARWAAVLALAAATAIAVASVAGGDMNADKTECADQLVGLAPCLQYVQGQARAPPPDCCGGLRQVLGKSPKCLCVLVKDKDDPQPXHQDQRHPSALALPQRLAGATRAKRLPTGAQAPAIFPPGLPKKPPRLSSPRAGEQRGFPLARLPKPKGKKLSNGGKTKPEIPPGAAFDRGQKPPRGKTPGGFFPLPPRGGGEKTPPPGW

SEQ ID NO: 75240 - DNA, 805 bp, Zea mays
  misc_feature: Ceres CLONE 1559685
  misc_feature: Encodes the peptide sequence at SEQ ID NO. 75241
  misc_feature (583)..(583): n is a, c, t, g, unknown, or other
  misc_feature (663)..(663): n is a, c, t, g, unknown, or other
  misc_feature (735)..(735): n is a, c, t, g, unknown, or other
tggagctccccgcggtggcggccgctctagaactagtggatcccccgggctgcaggaattcgtctcacccctagaaaaagaaccactgtccgctgcgtgctttccttcctctcaacgccagccttgccgagaggccgagaccaatcgccgccatctcccggaatgacggggtgacgaaaccgcgccgcaccagacaagacagaggagccgccgccgcgacccacaggccaccgggtcgccgaggaggggatccagcgagccatgtcgaccgacgtgcccatgagccccgagctcgagcaggtggacggcgagatccaggacatcttccgagcgctccagaatgggttccagaagatggacaagatcaaggactccagcaggcagtccaagcagctggaggatctcacggccaagatgagagagtgcaagcgcttgatcaaagagtttgaccgtatactcaaggatgaggagaaaaagaacacccctgatgtcaacaagcagctcaatgacaagaagcagttcatgatcaaagaactcaactcctatgtgacctaaggaaaacgtacagagcagcctgggtaantagagatcgaactattcgatccgggtaatgacaggtggctgagggaactccagtttcaatggcatcagaaatgtcaaatncagaactcattagcacggagaggaaacaaatggaccaaactgatcaagctattgagcgctcaaaaaatggtngtagcccaaaccttgttgagtttggagctccaactggttgcaaattttgacccagccaacggaaccaaag

SEQ ID NO: 75241 - protein, 97 aa, Zea mays
  misc_feature: Ceres CLONE 1559685
MSTDVPMSPELEQVDGEIQDIFRALQNGFQKMDKIKDSSRQSKQLEDLTAKMRECKRLIKEFDRILKDEEKKNTPDVNKQLNDKKQFMIKELNSYVT

SEQ ID NO: 75242 - DNA, 785 bp, Zea mays
  misc_feature: Ceres CLONE 1559689
  misc_feature: Encodes the peptide sequence at SEQ ID NO. 75243
  misc_feature (586)..(586): n is a, c, t, g, unknown, or other
  misc_feature (587)..(587): n is a, c, t, g, unknown, or other
ctggagctcaccgcggtggcggccgctctagaactagtggatcccccgggctgcaggaattcgtctcacccctagaaaaaacaaatactcctctctccacttaacgagcaccaccagttccttgttcggtcggaacgcagcgcagcggcggcggcgatagggagagaggagagagtctgcaggatccagcaggccgagggaggagtcagcggcgggccggagaatatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccaggaaccccagccgattgattgggagtactacagaaaaggaattggatcaaaagtggtggatatgtacaaagaggcttttgaaagcatcgagatcccgaagtacgtcgacacagttactccccagtacaagccaaagtttgatgctgtggatgctgaaattaaaggaggcttgaaaaagagcatcnnaagggattccgaaagggataaagaaaggaactttgcctgaaattggagggaaatgggggaaaaaaagttccggtccccatggaccggccgaaatgattccccttttgaggaagttccctcttaaacttccgggaaaaaaaatttttggccaaataaaaaaaccccggaaaaacaaaaaaaccgggggggaaattttta

SEQ ID NO: 75243 - protein, 133 aa, Zea mays
  misc_feature: Ceres CLONE 1559689
  misc_feature (121)..(121): Xaa is any aa, unknown, or other
MSGNGAKKVVDAAVKAGRTIIDWDGMAKLLVTDEARKEFAALRRAFDDVNHQLQTKFSQEPQPIDWEYYRKGIGSKVVDMYKEAFESIEIPKYVDTVTPQYKPKFDAVDAEIKGGLKKSIXRDSERDKERNFA

SEQ ID NO: 75244 - DNA, 832 bp, Zea mays
  misc_feature: Ceres CLONE 1559691
  misc_feature: Encodes the peptide sequence at SEQ ID NO. 75245
ctggagctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgactcgctgtaccctggcggcagcttcgaccccctcggcctggccgacgacctccgagcccttcgccgagctcaaagtgaaggagctcaagaacggcccgcctcgacatgtttttccatgttcgggctttctcgttcagggccatcgtcaacgg

SEQ ID NO: 75245 - protein, 233 aa, Zea mays
  misc_feature: Ceres CLONE 1559691
  misc_feature (61)..(212): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGGPLGEVVDSLYPGGSFDPLGLADDLRALRRAQSEGAQERPASTCFSMFGLSRSGPSST

SEQ ID NO: 75246 - DNA, 862 bp, Zea mays
  misc_feature: Ceres CLONE 1559697
  misc_feature: Encodes the peptide sequence at SEQ ID NO. 75247
  misc_feature (828)..(828): n is a, c, t, g, unknown, or other
  misc_feature (829)..(829): n is a, c, t, g, unknown, or other
  misc_feature (844)..(844): n is a, c, t, g, unknown, or other
ctggagctccccgcggtggcggccgctctagaactagtggatcccccgggctgcaggaattcgtctcacccctagaaaaaattattacaaccgaccaacgcgctttgcaacgcctccgctgcaatcagcccccgcggcgagattgccctgcccctgagtgctagttctcgccgttacgtaaggcttcttggccttgcgtcctccgtctttcgttgctgatacatcgaggtattaaagaagctgcctggttccgggcagcagaggtcgccgccgcctgcagcaatggccgacttctcctggctcacggtgcttggcttcctattcctcaccttcaactcaggcatggcgatttatcggtccaacggtgacgccggctccgtcgctttcgtcgtggtatcttatctcgacctggtggccctgttcgcctgcttgcgctactacgagcagttggatcagcagcactcccaaaagcgcgcgagggtcaaggctggggtttggagcctcacgaccctccttactatcatgttcagttacaaggtggctgagattatgcccctgccagtcaaacttgttgtctggtcgatggcagccgctaccacctgtggcggcttctacgctttcttcgtccacagcgagaagcctgtcatgccagcggcggcgccacggcccgccgcggccaaggatgcagcctccaactagctgtcgcctcggttgttttagcttgccggcgtggacagactggcagatctggagctcggcgcgaccagatcccgtgctgctgtgcccgatggcagaagagatctctctggtttactctgctaagagtcnnaagagagctgatgancgacactaagctttgggt

SEQ ID NO: 75247 - protein, 138 aa, Zea mays
  misc_feature: Ceres CLONE 1559697
MADFSWLTVLGFLFLTFNSGMAIYRSNGDAGSVAFVVVSYLDLVALFACLRYYEQLDQQHSQKRARVKAGVWSLTTLLTIMFSYKVAEIMPLPVKLVVWSMAAATTCGGFYAFFVHSEKPVMPAAAPRPAAAKDAASN

SEQ ID NO: 75248 - DNA, 752 bp, Zea mays
  misc_feature: Ceres CLONE 1559701
  misc_feature: Encodes the peptide sequence at SEQ ID NO. 75249
  misc_feature (319)..(319): n is a, c, t, g, unknown, or other
ctggagctccccgcggtggcggccgctctagaactagtggatcccccgggctgcaggaattcgtctcacccctagaaaaagacaacaccgcgcgcgcaatacacgggacacacgcagatccaagctaaccaccgcagatccgagattatccagccggagcgaccttttcttttttcttttacacagcgggacagagaaaggagtcaggcagccaaagccacccaccgcttttaccgatcggcgttgccgccaccgctagcattgtcggcttcagctccatccaaatccaccgccagcaagcaagccggcgccatgggtnctgccgatgaggagggagagggacgcggaggcggagctgaacctgccgccggggttccggttccaccccaccaacgacgagctggtggagcactacctgtgccgcaaggcggcggggcagcgcctccccgtgcccatcatcgccgaggtggacctgtacaggttcgacccctgggacctgccggagcgcgcgctcttcggggcccgcgagtggtacttcttcacgcccaggggacgcaagtaccccaacgggttcccgcccccaaccgggccgcgggtaacggggtacttggaaagggcaaccgggggcccaaacaagccccgttcccggcccgcgccgggcccccaaccccttcggggaaattaaaaaaggggggcttggtttttttcaaacccccgggaaaagggggccccccccgggggggggatcaaaa

SEQ ID NO: 75249 - protein, 119 aa, Zea mays
  misc_feature: Ceres CLONE 1559701
  misc_feature (13)..(110): Pfam Name: NAM Pfam Description: No apical meristem (NAM) protein
MRRERDAEAELNLPPGFRFHPTNDELVEHYLCRKAAGQRLPVPIIAEVDLYRFDPWDLPERALFGAREWYFFTPRGRKYPNGFPPPTGPRVTGYLERATGGPNKPRSRPAPGPQPLRGN

SEQ ID NO: 75250 - DNA, 865 bp, Zea mays
  misc_feature: Ceres CLONE 1559703
  misc_feature: Encodes the peptide sequence at SEQ ID NO. 75251
ctggagctccccgcggtggcggccgctctagaactagtggatcccccgggctgcaggaattcgtctcacccctagaaaaaatcccttggttgccgcagcctccaaagccactcccaaacccccgcttccagaaccttctcgaagctccccgccgcctcctccactcgcaccgatggcgaaggaaccaatgcgcgtgctcgtcactggcgccgcaggacaaattggatatgccctggttcccatgattgctaggggtgttatgcttggtgcagaccagcctgttattctgcacatgcttgacattccgccagcagctgaagcccttaatggtgttaagatggagttggttgatgctgcgtttcctcttctgaagggagttgttgctacaactgatgttgtggaagcctgcactggggtcaatgtggccgtcatggttggtggattccccaggaaggagggaatggaaaggaaagatgttatgtcgaaaaatgtttcaatctacaaatcccaagcatctgcccttgaagcccatgcagctcccaactgcaaggttctggtggttgccaacccagcaaacaccaatgctcttatcttgaaagagtttgctccatctattccagagaagaacgttacttgcctgacccgactggaccacaacagggctcttggccagatctctgagagacttaatgtccaagttagtgatgtgaagaatgttaacatctggggtaaccactcgtgctctcagtaccctgatgttaacatgccacagtgaagacttcctagtgagtagcctgttcgtgagcttgtctctgatgacgagtgacttactgatgaattcatcacaactgtcctgacagagtgg

SEQ ID NO: 75251 - protein, 200 aa, Zea mays
  misc_feature: Ceres CLONE 1559703
  misc_feature (6)..(155): Pfam Name: Ldh_1_N Pfam Description: lactate/malate dehydrogenase, NAD binding domain
  misc_feature: SWISSPROT Homolog: EC 1.1.1.37 Malate dehydrogenase
MAKEPMRVLVTGAAGQIGYALVPMIARGVMLGADQPVILHMLDIPPAAEALNGVKMELVDAAFPLLKGVVATTDVVEACTGVNVAVMVGGFPRKEGMERKDVMSKNVSIYKSQASALEAHAAPNCKVLVVANPANTNALILKEFAPSIPEKNVTCLTRLDHNRALGQISERLNVQVSDVKNVNIWGNHSCSQYPDVNMPQ

SEQ ID NO: 75252 - DNA, 803 bp, Zea mays
  misc_feature: Ceres CLONE 1559705
  misc_feature (312)..(312): n is a, c, t, g, unknown, or other
  misc_feature (343)..(343): n is a, c, t, g, unknown, or other
  misc_feature (357)..(357): n is a, c, t, g, unknown, or other
tggagctccccgcggtggcggccgctctagaactagtggatcccccgggctgcaggaattcgtctcacccctagaaaaaagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcnggagaaagcccgcccagggcatgaaaagggnaaggccggcaaggnaccccaacaagcccttaggaggggctcccaggcggcttttctttcgtggtttcatggggagggaaaatttccccagggggggtttccagggggaaaaaaaaacccttaaaaaacaaatttttgttcccctttcggggggggaaaaaccttcctggggcccaagggggggaaaaatcccttaaaacggattttggaaaaaaggggttccccctctttttgtgccccccgggggggataaaaaaaaggtcttaaagggttttggggggaaaaaacacaagaggggggcccctcgggggggggggcgcaaaaaaaaaaaaaaaggggggggggaaaaaaaaaaacccccttctccccccccacttaaaaaaaaaaaggatcttcccccccctcccccccggggggggggaaaaaaggggggggggagaaaaatatataaaaaagagggg

SEQ ID NO: 75253 - DNA, 830 bp, Zea mays
  misc_feature: Ceres CLONE 1559708
  misc_feature: Encodes the peptide sequence at SEQ ID NO. 75254
  misc_feature (153)..(153): n is a, c, t, g, unknown, or other
  misc_feature (745)..(745): n is a, c, t, g, unknown, or other
  misc_feature (756)..(756): n is a, c, t, g, unknown, or other
tggagctccccgcggtggcggccgctctagaactagtggatccccctgggctgcaggaattcgtctcacccctagaaaaaaaaaaaaaaaaaaaaaaaaaaaaaaaaaattgaagcacttataaaccaatggattggcaatgcagcacatgtntgagacaaaagtcatggctttgcaagatgcaaaaaattctggtgcgattgcaatgtttggagaaaaatacggtgaacaggtcagagtcgtagaggttcccgggatctcattggaactctgtggtggtactcacgtcagtaatactgctgagattcgtggtttcaagataatttcagaacaaggaatagcttctgggatcagaaggatagaagcagttgcaggtgatgcttttgttgactatgtgtgtgctcgggacaactacatgcggcgcttatgcttatcccttaaggttaaggctgaagatgtgaacagtagagtagaaacaattcttgaagagctaagagcaaccagaaacgaagcatcatctctacgcagcaaaattgcagtgctaaaagcagcttctcttgcaagtagagctacaactgtggagcctcagaatgtcaggattgtggtcgagaacatgggtgatgtagacgcagatgggcttgaaagcgctgccgagcatctcatagacaccctcaaagaccctgctggcgtgatttttaggatcagcccaggggaatggaaagtcaccctggttgcttgccttcanccctgcaatcntcaaaatggggcttcaggccggggaaaattcctaagtgggaatacccaaactctgcggcggaagggggggaaga

SEQ ID NO: 75254 - protein, 230 aa, Zea mays
  misc_feature: Ceres CLONE 1559708
  misc_feature (32)..(75): Pfam Name: tRNA_SAD Pfam Description: Threonyl and Alanyl tRNA synthetase second additional domain
  misc_feature: SWISSPROT Homolog: EC 6.1.1.7 Alanine--tRNA ligase
  misc_feature (5)..(5): Xaa is any aa, unknown, or other
  misc_feature (202)..(202): Xaa is any aa, unknown, or other
  misc_feature (206)..(206): Xaa is any aa, unknown, or other
MQHMXETKVMALQDAKNSGAIAMFGEKYGEQVRVVEVPGISLELCGGTHVSNTAEIRGFKIISEQGIASGIRRIEAVAGDAFVDYVCARDNYMRRLCLSLKVKAEDVNSRVETILEELRATRNEASSLRSKIAVLKAASLASRATTVEPQNVRIVVENMGDVDADGLESAAEHLIDTLKDPAGVIFRISPGEWKVTLVACLXPCNXQNGASGRGKFLSGNTQTLRRKGGK

SEQ ID NO: 75255 - DNA, 886 bp, Zea mays
  misc_feature: Ceres CLONE 1559710
  misc_feature: Encodes the peptide sequence at SEQ ID NO. 75256
  misc_feature (824)..(824): n is a, c, t, g, unknown, or other
ctccccgcggtggcggccgctctagaactagtggatcccccgggctgcaggaattcgtctcacccctagaaaaaaattccagtccgatttggacattgtcttcgtctccttcatcccctgcccacctgttctgctctgccgccgccgccgctgccgctcccgctgccgcaggaaccctagaccacgctgagcaacccccggcctacacggcgtagctttgcaggaaatggaatacggcgccgtcctcgccgccgcgccgctcgtcgcacggccgaactggctcctcctctcgccgccgccactggcgccgtctattcagattcagaatcgtctttattcgatctcgtcattcccactaaaggctggacctgtaagggcatgcagagctttagcaagcaactacacgcaaacatctgaaacagttgatttggactgggagaacctgggttttgggattgtgcaaactgattatatgtatattgctaagtgcgggacagacgggaatttttctgagggtgaaatggtgccttttggacctatagcgctgagtccatcttctggagtcctaaattatggacagggattgtttgagggcctaaaggcgtataagaaaactgatggatccatcctattatttcgcccagaggaaaatgctgagaggatgcggacaggtgctgagaggatgtgcatgcctgcaccctctgtcgagcagtttattgatgcagtaaaacaaacccgtctttgcaatagagatggattccctctactggtaaaggtctctgtatattagggccctaactatgggaagtgggggctgtcttggntcttgcactgctcctgagtaacattcataaaattggtctcctctggttgaaaactactttag

SEQ ID NO: 75256 - protein, 187 aa, Zea mays
  misc_feature: Ceres CLONE 1559710
  misc_feature: SWISSPROT Homolog: EC 2.6.1.42 Branched-chain-amino-acid transaminase
MEYGAVLAAAPLVARPNWLLLSPPPLAPSIQIQNRLYSISSFPLKAGPVRACRALASNYTQTSETVDLDWENLGFGIVQTDYMYIAKCGTDGNFSEGEMVPFGPIALSPSSGVLNYGQGLFEGLKAYKKTDGSILLFRPEENAERMRTGAERMCMPAPSVEQFIDAVKQTRLCNRDGFPLLVKVSVY

SEQ ID NO: 75257 - DNA, 865 bp, Zea mays
  misc_feature: Ceres CLONE 1559712
  misc_feature: Encodes the peptide sequence at SEQ ID NO. 75258
aaagctggagctcaccgcggtggcggccgctctagaactagtggatcccccgggctgcaggaattcgtctcacccctagaaaaaaaggccatagctagagcctagagcagcagcagaggcttgacctgaagctccacccgccatggcattcacgcccgctacggcctgctgcaaggcttccctggcgctggcaccgcgggcgtcgccccgcggcccggcggcctgcgcgcaggcggcgctcctctgcacgccctccacctccgtgttccgcggcctccgggcgcccgcatccgccgcgccggccccgcgccggcgccgctcggcggcgtccacgggcatagtctgcggcaaggtacgtggcctcgggaatggcgtgcgtgcgtgcgggaatccgtgttccacacatggcggtgattggtttggtagccgtggtcgtctcctcgatgcaggtcgccaatggcagcgtgccgccgaacttcaccctcaaggaccagaacggcaagcccgtgtcgctgaacaagttcaagggcaagcccgtcgtggtttacttctaccccgccgacgagacgcccggatgcacaaagcaggcgtgcgcgttcagggactcgtacgagaagttcaagaaggccgggggcggaggtgatcggcatcagccggccacgacgcggcgtctcaaaaggcggttcccgcagaaataccgggtgccgtttcagccagcttgaacgaaccaggggaaccaccatgccccaaggaatgggggcgttcccctacggaacctggttcgggaacccttcccggggggccccaaaaatattctttttttgggaaaagacagggggtgtctttgcaagaaacgtccctccca

SEQ ID NO: 75258 - protein, 117 aa, Zea mays
  misc_feature: Ceres CLONE 1559712
  misc_feature (30)..(118): Pfam Name: AhpC-TSA Pfam Description: AhpC/TSA family
  misc_feature: SWISSPROT Homolog: EC 1.11.1.15 Peroxiredoxin
MACVRAGIRVPHMAVIGLVAVVVSSMQVANGSVPPNFTLKDQNGKPVSLNKFKGKPVVVYFYPADETPGCTKQACAFRDSYEKFKKAGGGGDRHQPATTRRLKRRFPQKYRVPFQPA

SEQ ID NO: 75259 - DNA, 859 bp, Zea mays
  misc_feature: Ceres CLONE 1559715
  misc_feature: Encodes the peptide sequence at SEQ ID NO. 75260
  misc_feature (675)..(675): n is a, c, t, g, unknown, or other
  misc_feature (827)..(827): n is a, c, t, g, unknown, or other
ctggagctccccgcggtggcggccgctctagaactagtggatcccccgggctgcaggaattcgtctcacccctagaaaaagccatcacctaccaaatccggcgggcgtccagcggatctccatctggtcggcgtggatcggatcttcggtggtgtttctcgtcttcacggcgattagtggcggcgagccgaccacgtccccgcagcagcagtcagcggcggcttgacgcggtcggacgggtacctctagttggcatcagcgagtgggcgcggggcgccgcaagtctcaccgtccgctggtgtagaggccccgagtctcggcgctatggagtgtaggccgcgtgtctccgcttagggagggccaggggtcaacaaagggacttgtcaagtgacaacatcgcggccttcgggtgttggagcctgcttggaggtgtccggcctattggtgccgtaccacaggattggttcattatttgtgggagatctatatttgtcttaccattttgttcccgcttctagtccccaaatcttcacgggctttgccagatcgctggccatctccttggcagccgcttccgctgtcgccagccatcaccaacctgcgcctcatagtggagcccaggaaaggcggtgggactgagcgagggaagaggagatgactagcttgtcgatcacngtgatgacgctgaacctgcatgaaggcgaacagccgagcgagagccccaacagctgggagaagcgccgggacatctgcgtcagcgtcatcaccagctactctcccaccatcctttgcacccagcaagggcttagatggcaactggactaccntacacagtgcttgccggggtatgaacagtttg

SEQ ID NO: 75260 - protein, 68 aa, Zea mays
  misc_feature: Ceres CLONE 1559715
  misc_feature (58)..(58): Xaa is any aa, unknown, or other
MTSLSITVMTLNLHEGEQPSESPNSWEKRRDICVSVITSYSPTILCTQQGLRWQLDYXTQCLPGYEQF

SEQ ID NO: 75261 - DNA, 830 bp, Zea mays
  misc_feature: Ceres CLONE 1559718
  misc_feature: Encodes the peptide sequence at SEQ ID NO. 75262
  misc_feature (605)..(605): n is a, c, t, g, unknown, or other
  misc_feature (675)..(675): n is a, c, t, g, unknown, or other
ctggagctccccgcggtggcggccgctctagaactagtggatcccccgggctgcaggaattcgtctcacccctagaaaaagtgctgtgccgccgttcgtctctgggtagcgtagcgacggcgccacggcggcttccggctcgtgcgcgcgcgcgcgtgtccgggcgagaagagctgccaagggatggaggcgctgaggaagcaggcgagcaagttcaaggagcaggtcgccaagcagcagcaggctgttataaagcaattcagtactactggctatgagcggtcagattccattgtaattgatgaggttgaactacagagacatcaacagcttgagaaattgtatacttctactcgttctgtaggggatttccagaaggacatagttagagcagctgaaggtttggtgtctattggaaacaaacatattgaagtgggaacaaaattttctgaggactgctatagatatggaagcgaaaataatgcaagcgacgaagcccttagaaaagcagcatcactatacggaggtgctttgagaaatattgagaaagagtatgaagatttcaacagaaatttatcttctcagactatagacccattgagagncatggctatggggtggacccctggaagatgctcgtggtcttgcacagcgctttagcaggatgagacatgnagctgagatcctctctacgtgaatttgctagagaaaggcacgggtaaaaaaagctccatttgctgaccccctaccaagctttcgccatccgaagcttggattgataagccccaaaccagcctggccctgttttagggaaggagccccccctttcc

SEQ ID NO: 75262 - protein, 158 aa, Zea mays
  misc_feature: Ceres CLONE 1559718
  misc_feature (141)..(141): Xaa is any aa, unknown, or other
MEALRKQASKFKEQVAKQQQAVIKQFSTTGYERSDSIVIDEVELQRHQQLEKLYTSTRSVGDFQKDIVRAAEGLVSIGNKHIEVGTKFSEDCYRYGSENNASDEALRKAASLYGGALRNIEKEYEDFNRNLSSQTIDPLRXMAMGWTPGRCSWSCTAL

SEQ ID NO: 75263 - DNA, 836 bp, Zea mays
  misc_feature: Ceres CLONE 1559719
  misc_feature: Encodes the peptide sequence at SEQ ID NO. 75264
ctggagctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcatcaagtacctcggccccttctccggcgagcccccgagctacctcaccggcgagttccccggcgactacggctgggacaccaccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctctcagatcttcagtcgaggcgggctggactatctcagcaacctcagcctgatccacacgcagagcatcctcagcatctgggcatgccaggtcgtgctcatagatgccgtcgagggctaccgcattgccagcaggacgactacgcaaagtcgactacccgctgtacccgggcggcaaactacaaccccttcgactggaccgacaacccccaaggccttctcccaacctttaggggatggaacttcagaacggccgcctcccccggtgtttccgggtttgggtttctaagaaaaaggcaatctccacgggaa

SEQ ID NO: 75264 - protein, 226 aa, Zea mays
  misc_feature: Ceres CLONE 1559719
  misc_feature (61)..(227): Pfam Name: Chloroa_b-bind Pfam Description: Chlorophyll A-B binding protein
MAASTMAISSTAMAGTPIKVGSFGEGRITMRKTVGKPKVAASGSPWYGPDRIKYLGPFSGEPPSYLTGEFPGDYGWDTTGLSADPETFAKNRELEVIHSRWAMLGALGCVFPELLSRNGVKFGEAVWFKAGSQIFSRGGLDYLSNLSLIHTQSILSIWACQVVLIDAVEGYRIASRTTTQSRLPAVPGRQTTTPSTGPTTPKAFSQPLGDGTSERPPPPVFPGLGF

SEQ ID NO: 75265 - DNA, 845 bp, Zea mays
  misc_feature: Ceres CLONE 1559721
  misc_feature: Encodes the peptide sequence at SEQ ID NO. 75266
ctggagctccccgcggtggcggccgctctagaactagtggatcccccgggctgcaggaattcgtctcacccctagaaaaaaacgcggcatcgatagcaaccggtccaacactttcacgctcatgcgctcagctctagcaatggctgcctacaccatggcgatctcctccacggccatggccggtacccccatcaaggtgggctccttcggcgagggccgcatcaccatgctcaagaccgtgggcaaacccaaggtggcggcgtccggcagcccctgatacggccccgaccgcgtcaagtaactaggccccttctccggcgagcccccaagctacctcaccggtgagttccccggcgactacggctgggacaccgccgggctgtccgccgaccccgagaccttcgccaagaaccgcgagctagacgtgatccactcccgctgggccatgctcggcgcgctcgggtgattcttccccgagctgctctccagcaacggcgtcaagttcagcaaggccatcaggatcaaggccggctcccagatcttcaccgagggcgggctggactaccttggcaaccccagcctgatacacgctcagagcatcatcaccatctgagcctgccaggtcgagctcatgagcgccgtctagggcaaccgtattgccggcgggacgctcggcgaggtcgtcgaccgactataccctggcagcagcttcgaccccctacggctggccgacgacccgaggccttctccgagctcaagtgcaagagctcatgagcgacgccacgacaagtgctcatgttcggcttctgcgtcaggacatcgtcacgtgcacggcccgctcaaga

SEQ ID NO: 75266 - protein, 45 aa, Zea mays
  misc_feature: Ceres CLONE 1559721
MAAYTMAISSTAMAGTPIKVGSFGEGRITMLKTVGKPKVAASGSP

SEQ ID NO: 75267 - DNA, 630 bp, Zea mays
  misc_feature: Ceres CLONE 1559723
  misc_feature: Encodes the peptide sequence at SEQ ID NO. 75268
tggagctcaccgcggtggcggccgctctagaactagtggatcccccgggctgcaggaattcgtctcacccctagaaaaaattcaaaatcgatcccgaccttccgctcccgcaagaaaggaggagaaaaggaacagcggaagcgaagcacaagcagtcagaggcggccgccgcagcccgccgcagtagcgacacgcaacccccccttcccctatcacgccacccggctccacggaggagcgagaccgcgcgccgcagatccttggtcgccgctagggttccggcgagatggacgtggtgaaggcggcgcagctgtcggggcggacgctggaacgtgttgtggtgcaccccctggtgctgctcagcatcgtcgaccactacaaccgcgtcgcccgcgacacccgcaagcgcgtcgtcgggcgtccttcttcgggcacctccctcccggcggctcccgtccgacgtcacccaactcctacggcggttgccggttttggagaaggattgacaaaggattcctagggaatctggggttccctttggacccaccaatttacccctggaaaatccaatgggtttcctcccagggttttccaagagggggatttaaaccccccccaggggggggccct

SEQ ID NO: 75268 - protein, 77 aa, Zea mays
  misc_feature: Ceres CLONE 1559723
MDVVKAAQLSGRTLERVVVHPLVLLSIVDHYNRVARDTRKRVVGRPSSGTSLPAAPVRRHPTPTAVAGFGEGLTKDS

SEQ ID NO: 75269 - DNA, 778 bp, Zea mays
  misc_feature: Ceres CLONE 1559724
  misc_feature: Encodes the peptide sequence at SEQ ID NO. 75270
  misc_feature (730)..(730): n is a, c, t, g, unknown, or other
tggagctccccgcggtggcggccgctctagaactagtggatcccccgggctgcaggaattcgtctcacccctagaaaaaatctcttctgcctccgtctcaatctcgaccggtcaccccatctccaccgccacatccgtcgtcttccgccgccgccgatggcccgcctcctcacgcaaaccctcaccctagcccgccccgcctcctccccctccactaccgccgcatccgcttccctccgtggcctcgccaccaaggtcgagatcatcgagatcgatctcgccgaggaagacgctggctcctcgtcccacggctccccctcctcgtccccgtcggtcgaggcggtcgggatccggcgcctggaggaggccatccacggcgtcatggtgcgccgcgccgcgcccgactggctccccttcgtgccgggagggtcctttctgggtgccccccgctgcgcccgcccgcacgggggtcgcccgagctcgttgggcgggatcgcggctgctggggggcaccgaagggggggcccggggcccttggggtgggcccggttccaaagtctttggaaactttgaccccccccccatgaaccggaaggaaacaagggcgttttttggttttctcccacccaccgcgggggggggggggccccctcgggcccttctttttctttcccctcccaaaagggggaaaaattctccccccctttttttgggggggggaaaatccccnaggaaaaaaaaggggggccaaaccccctaaaaactgtgggggaggaag

SEQ ID NO: 75270 - protein, 138 aa, Zea mays
  misc_feature: Ceres CLONE 1559724
MARLLTQTLTLARPASSPSTTAASASLRGLATKVEIIEIDLAEEDAGSSSHGSPSSSPSVEAVGIRRLEEAIHGVMVRRAAPDWLPFVPGGSFLGAPRCARPHGGRPSSLGGIAAAGGHRRGGPGPLGWARFQSLWKL

SEQ ID NO: 75271 - DNA, 581 bp, Zea mays
  misc_feature: Ceres CLONE 1559725
  misc_feature: Encodes the peptide sequence at SEQ ID NO. 75272
ctggagctccccgcggtggcggccgctctagaactagtggatcccccgggctgcaggaattcgtctcacccctagaaaaaatctccatccgacctgtcctcgcgtctcccttcccagatccatcgactcgctcgggccgcccctcccgtcgtccccgttcgaaggtgcggcagccggcaggcgagcgatttcattcgacatgaatcccgagtacgactaccttttcaaacttctgcttattggtgattctggtgttgggaaatcatgcttgcttctcagatttgcagacgattcttatttggacagctatatcagcacaaatgggggtttgattcaaaaatcgcacagtggaagcaagatggggaagaccataaaacttcaaaatttgggatactgctggggcaaagagcgcctttcggacaatttccctaggcggcttactaacccggggaaggttcatggggaaaacctttaatggggaaatgggaacgggggccccgaacccccaagaaaaggcctttcccaaaaaaaaggggggaaaaaaccaaaaggggttttttaaaccccgccaaattttttcc

SEQ ID NO: 75272 - protein, 91 aa, Zea mays
  misc_feature: Ceres CLONE 1559725
MNPEYDYLFKLLLIGDSGVGKSCLLLRFADDSYLDSYISTNGGLIQKSHSGSKMGKTIKLQNLGYCWGKERLSDNFPRRLTNPGKVHGENL

SEQ ID NO: 75273 - DNA, 805 bp, Zea mays
  misc_feature: Ceres CLONE 1559727
  misc_feature: Encodes the peptide sequence at SEQ ID NO. 75274
  misc_feature (612)..(612): n is a, c, t, g, unknown, or other
tccccgcggtggcggccgctctagaactagtggatcccccgggctgcaggaattcgtctcacccctagaaaaagtccgtccgcttctctctccccatctccatctgcaatcctcgctcgcccacactcggcagccatggcgtcgtcgcgcaccggagccggagccggcggccgtgtggtggtcttcccgttcccattccagggccacttcaacccggtgatgcggctggcccgcgcgctgcacgcccggggcctcgcgattaccgtcttccacagcggcgccctggacccggccgactaccccgccgactaccgcttcgtgcccgtgaccgtggaggcggacccgaagctgctggcgtccgaggacatcgccgccatcgtcaccacgctgaacgccagctgcgacgcccccttcagggcccgcctctcggcgctgctggccgccgaggggagggacagcgtccggtgcgtcttcaccgacgtcagctggaacgccgtgctgacggcgtccagcgacctcggcgtgcccgcgctcggcatgatgacggccagcgccgcctcgttacgcgactacatggcgtaccgcaccttgatcgacaagggctacctgccngtgaaagaggagcgccagggaggatcccgtacccgaggctacccccgaacctggtcaaagacctgcctccggggcaaaacttcgaacctggagggaattctcccaaaatgggggcccccacccctaaacaagggggggggggggccccgggggggtttattttaaaaaatttttcccgttgaaaagaaaaaaa

SEQ ID NO: 75274 - protein, 213 aa, Zea mays
  misc_feature: Ceres CLONE 1559727
MASSRTGAGAGGRVVVFPFPFQGHFNPVMRLARALHARGLAITVFHSGALDPADYPADYRFVPVTVEADPKLLASEDIAAIVTTLNASCDAPFRARLSALLAAEGRDSVRCVFTDVSWNAVLTASSDLGVPALGMMTASAASLRDYMAYRTLIDKGYLPVKEERQGGSRTRGYPRTWSKTCLRGKTSNLEGILPKWGPPPLNKGGGGPRGGLF

SEQ ID NO: 75275 - DNA, 799 bp, Zea mays
  misc_feature: Ceres CLONE 1559730
  misc_feature: Encodes the peptide sequence at SEQ ID NO. 75276
ggagctccccgcggtggcggccgctctagaactagtggatcccccgggctgcaggaattcgtctcacccctagaaaaacagcgagtataagctaacctgatcgttttcctcatttcaccttccaccctcccccactttctcctcaccgagtcacaaagccaaaccctaattcacggccgccggagatgggacaaggttctcccggcgggatgggcaagcagcccggcctcccgggcgaccgcaagcagggagacggcaagaaagagaagaaatatgaaccacccgctgccccttcccgtgtcggccggaagcagaagcggcagaagggctccgaggcggcggcgcggctccccgccgtggcgccgctctcaaagtgccgccttcgcctactcaagctcgaacgcgtcaaggactaccttctcatggaagaggagttcgttgccagccaggagcgcctgcgccccagcgaggataagacggaggaggacccgatcaaggtcgacgacctccgcggcactcccatgaacgtcggatcgctggaggagatcatcgacgagagccatgcccatcgtctcctcggacgtcggtccccaatactacgtcggggaaactttctttctttgaaaaaggaccaccctcgagcccgggattgggccctttctgaatgccccaaaaagggttccggaccagggggttgggtatttttgcaaaaaacaaaatttaaacccctgggggtccccgggaaagaaaaaggtttaaaaaagggccccctttttggaaaacttttaatgctggaaat

SEQ ID NO: 75276 - protein, 204 aa, Zea mays
  misc_feature: Ceres CLONE 1559730
MGQGSPGGMGKQPGLPGDRKQGDGKKEKKYEPPAAPSRVGRKQKRQKGSEAAARLPAVAPLSKCRLRLLKLERVKDYLLMEEEFVASQERLRPSEDKTEEDPIKVDDLRGTPMNVGSLEEIIDESHAHRLLGRRSPILRRGNFLSLKKDHPRARDWALSECPKKGSGPGGWVFLQKTKFKPLGVPGKEKGLKKGPLFGKLLMLE

SEQ ID NO: 75277 - DNA, 838 bp, Zea mays
  misc_feature: Ceres CLONE 1559731
  misc_feature: Encodes the peptide sequence at SEQ ID NO. 75278
  misc_feature (435)..(435): n is a, c, t, g, unknown, or other
  misc_feature (441)..(441): n is a, c, t, g, unknown, or other
  misc_feature (444)..(444): n is a, c, t, g, unknown, or other
  misc_feature (531)..(531): n is a, c, t, g, unknown, or other
ctggagctccccgcggtggcggccgctctagaactagtggatcccccgggctgcaggaattcgtctcacccctagaaaaaatctccactcgctagcactagcatagccgtctctttcttttctgcttccagacattgtccacgagctggtgcactggtgtcgctcgcaaccaaattaaggactgagccatggcatccaagggcgtcctcttcttggctctcaacctcctgttcttcacagtggccaacgcctgcggcagctgcccgaccccaacgcccccggtcgagccaccgccgccgcctcctgctaccccacccccttcatcctccagtgggaagtgcccgctgaacgcgctcaagttcggcgtgtgcgtcaatgcgctcggcctcgtcaaaggcgaggctggcaaggtaccagctgagccatgctgcaccntcatcnaangccttgcagaactcgagggccgcgtctgcctctgcacggccatcaagggcaacgtcctcggcgtcgtcttcgatgtccctatcaagnttcatgccctcgtcaactactgtgggcagtgcgtgcccaagggctacatgtgtgcgtaaagctccgcgcggtaaccgcctcgtagcgtttccggggcgtaattaagcatgcacctggctggcacacatggatttgggcgcccggcggatcccccccgggcccaatttgggcccccttagggttctaaaggccctaaaaaccttattccggggaaaatttttggccgtttacaaagtaaatggcccccctgggaaaaatcccaatttttttgggtgtttatttgggaataaaaaaacattttttttaa

SEQ ID NO: 75278 - protein, 133 aa, Zea mays
  misc_feature: Ceres CLONE 1559731
  misc_feature (51)..(132): Pfam Name: Tryp_alpha_amyl Pfam Description: Protease inhibitor/seed storage/LTP family
  misc_feature (83)..(83): Xaa is any aa, unknown, or other
  misc_feature (85)..(85): Xaa is any aa, unknown, or other
  misc_feature (86)..(86): Xaa is any aa, unknown, or other
  misc_feature (115)..(115): Xaa is any aa, unknown, or other
MASKGVLFLALNLLFFTVANACGSCPTPTPPVEPPPPPPATPPPSSSSGKCPLNALKFGVCVNALGLVKGEAGKVPAEPCCTXIXXLAELEGRVCLCTAIKGNVLGVVFDVPIKXHALVNYCGQCVPKGYMCA

SEQ ID NO: 75279 - DNA, 841 bp, Zea mays
  misc_feature: Ceres CLONE 1559733
  misc_feature: Translation starting site: 490
  misc_feature (749)..(749): n is a, c, t, g, unknown, or other
tggagctccccgcggtggcggccgctctagaactagtggatcccccgggctgcaggaattcgtctcacccctagaaaaattcctgatccagcacaacgtcaccggcaaggggcccttcgacaacctgctgcagcacctgtccgacccatggcacaacaccatcatccagaccctgtcgggttgagtctacggtccatcacgtcatgtggtccgagctgaaaggccgagactcgaagacagttcgtgtgatgcgttcttaatcgactgagggctaaggaatgtgacgtactggtatatgtacattagttgaagccgaggctataaagggtgtagagattgtttcatcagtatatatcatcagtcccgatgggttttgtttaaaaattcccaatctcgtcttgtgtcgttcggagcgggcagcaacacacagccccatcccaatcctagtcgatcttcttcccctcctcaaggaagaaaagaagctgaaccatggggaagagaaagtcaactgctaagccacctcctaagaagcggatggacaagcttgacactgtcttttcctgcccattctgcaaccacgggagtagtgttgagtgccgaattgacatgaagaatctgattggcgaagcatcttgtagaatctgtcacgacaacttcacacaaacatgtaatgcactcactgagcctattgatatatatagtgaatggattgatgaggtgtgagcgtgtcaccactgttcgaagctacnatgatgcgtgagcgtgagcttgcccccatgcgatgaaactgttacctatcatccgtatggaatgtgctggaattccccgagtgcataacccc

SEQ ID NO: 75280 - DNA, 885 bp, Zea mays
  misc_feature: Ceres CLONE 1559734
  misc_feature: Encodes the peptide sequence at SEQ ID NO. 75281
ctggagctccccgcggtggcggccgctctagaactagtggatcccccgggctgcaggaattcgtctcacccctagaaaaatttttttcctgcccctccccctccgcctttcctctctctcgctctcctcctctcctctcctctcctctccttccgcatcacacaccacgactcccaaccgccggttggctttgctgctccgagctcttcctcttccacacccgccctctctcttgggtcggcggccgagtgtctgcgtcgtccacggagatcagggatcggcggcggggtatggcgagggagcgacgggagataaagaggatagagagcgcggcggcgcggcaggtcacgttctccaagcgccgccgcggcctcttcaagaaggctgaggagctctccgtgctgtgcgatgccgacgtcgcgctcatcgtcttctcctccacgggaaagctctcccagttcgccagctccagtatgaatgagatcattgacaagtacagcacacattctaaaaacctggggaaagcagaacagccttcacttgacttgaacttagaacatagcagatatgcaaatttgaatgagcaacttgtggaagcaagccttcgactcaggcagatgagaggtgaagaacttgagggattgagtgttgaaagactccagcaattggagaagatctgggatctggtctgcatagggtgcttcaaacaaggatcaacattcttgggacagatcagcgactcggacaaaggattaccacactggcaaaggaaaaaaggcaactgaggaatacagtatcccccattcccccattgggaagcaatcattggcttaatccgaaaagttatcccctaaaaaggggaatcctttaaaaaaacagaaaggg

SEQ ID NO: 75281 - protein, 164 aa, Zea mays
  misc_feature: Ceres CLONE 1559734
  misc_feature (9)..(59): Pfam Name: SRF-TF Pfam Description: SRF-type transcription factor (DNA-binding and dimerisation domain)
MARERREIKRIESAAARQVTFSKRRRGLFKKAEELSVLCDADVALIVFSSTGKLSQFASSSMNEIIDKYSTHSKNLGKAEQPSLDLNLEHSRYANLNEQLVEASLRLRQMRGEELEGLSVERLQQLEKIWDLVCIGCFKQGSTFLGQISDSDKGLPHWQRKKGN

SEQ ID NO: 75282 - DNA, 827 bp, Zea mays
  misc_feature: Ceres CLONE 1559735
  misc_feature: Encodes the peptide sequence at SEQ ID NO. 75283
  misc_feature (692)..(692): n is a, c, t, g, unknown, or other
  misc_feature (736)..(736): n is a, c, t, g, unknown, or other
  misc_feature (738)..(738): n is a, c, t, g, unknown, or other
ctggagctccccgcggtggcggccgctctagaactagtggatcccccgggctgcaggaattcgtctcacccctagaaaaaccccactcctgcagtccttctccacctagctcccccgcgccaagaacacgccagctagcaagcgcgctcgatcgaataccgttaccgtgtcgccatggccgccaccgcgtctctatcagccgtcggggcgccgctgtcggtgcccgggctcaggaagccgctcggcgtgtcgtcgctccggcccctgcagccgagggcggcgaggatgacgacgacggccgtgcgggcgtcggcgtcgccctcgtccacgtccatcaaggagaaggctgcggccgggctgaccgcggcggccctggcggccgcgctggtgctgccggacgtcgcggaggccgcgcagtccggcgggctcacgccgtcgctcaagaacttcctcctcagcatcgtgtccaggtggggtcgtgctcgttggtattgtcggcgccgtcgtcgccgtctccaacttcaaccccgtcaagagggcctgatcggaatccatcgtatcgatcgtctcgtctgtgtcctgtcctgtagctgtgctgtctgtatcaactagtagtgctatatcccctgctgtgttactgattttagagaatgtcagacttatatctatgtctaacaaatggagtccagttnagggctacgaataacggcctccaagggtcggaaagggaaaaacncncccctgatgccccaaagtcgtaccgggggcctaccctgatatccccccgggaataaactggggtcaggggatgggggttccccccgccc

SEQ ID NO: 75283 - protein, 145 aa, Zea mays
  misc_feature: Ceres CLONE 1559735
MAATASLSAVGAPLSVPGLRKPLGVSSLRPLQPRAARMTTTAVRASASPSSTSIKEKAAAGLTAAALAAALVLPDVAEAAQSGGLTPSLKNFLLSIVSRWGRARWYCRRRRRRLQLQPRQEGLIGIHRIDRLVCVLSCSCAVCIN

SEQ ID NO: 75284 - DNA, 873 bp, Zea mays
  misc_feature: Ceres CLONE 1559740
  misc_feature: Encodes the peptide sequence at SEQ ID NO. 75285
  misc_feature (743)..(743): n is a, c, t, g, unknown, or other
ctggagctcaccgcggtggcggccgctctagaactagtggatcccccgggctgcaggaattcgtctcacccctaggaggcggtttcagttccttgcttgcttgcttgctctctctctctctctctctctctctctctctctctctcgctctctctctctctcgtggaagccagccacacaaggcagaaagagagagagagagagtgacgttgtgttccatcccgttccgctgaagcaaccgctctcctacaccaaaccaccccacaccactctagccgatgcgatggatgtggatccagcagcggagcagcggaggaagaacaagggcgggctggagtcagagctggagcgccactacgacgacctgcagcgggagatgatgctgatggccgccgatcggccgcacaagcaactgcaacagcatcgacgtcacgggcaccgctccgatctgctccagaactgcgacctgcccccaccggccaagctcttcggccccgtgcccactctgcagaggctggagaccgccgctgccaaggaacacaaggccgacgacggcctgctgcgggcgctgcgcctgtcgcagtcgcgcgcgcgggaggcggaggacaagctggcggccgcgggcgcccacaacgtcgaactcgcggcgctgctcgtgcgggactcggttgcgctctccgcccacggcggtggggttatgatgctgggaggccaaaaattccctgctccgagaaccacaaccnaaatgggggagggtccggaaaccggacaacggaacccggggggggggggcccccgtgggggggtcccccctttccgtttgggtttggggtaacccgggggttcgcgcctaacctctgggaagagttcccc

SEQ ID NO: 75285 - protein, 183 aa, Zea mays
  misc_feature: Ceres CLONE 1559740
  misc_feature (154)..(154): Xaa is any aa, unknown, or other
MDVDPAAEQRRKNKGGLESELERHYDDLQREMMLMAADRPHKQLQQHRRHGHRSDLLQNCDLPPPAKLFGPVPTLQRLETAAAKEHKADDGLLRALRLSQSRAREAEDKLAAAGAHNVELAALLVRDSVALSAHGGGVMMLGGQKFPAPRTTTXMGEGPETGQRNPGGGGPRGGVPPFRLGLG

SEQ ID NO: 75286 - DNA, 858 bp, Zea mays
  misc_feature: Ceres CLONE 1559742
  misc_feature: Encodes the peptide sequence at SEQ ID NO. 75287
  misc_feature (701)..(701): n is a, c, t, g, unknown, or other
ctggagctccccgcggtggcggccgctctagaactagtggatcccccgggctgcaggaattcgtctcacccctagaaaaaatcccaacccactcacagtctcacgctactatcgctatctagagctccggccgtcacagacacgagctagagctagagctgcagggaagaagaagaaggaggaggaggagaagatgagggcgtccgcgctggtctgcttcgtggcggtgtcggcgtgcatagcgtgcatcgcgcatggcggcaacttctaccaggacacggagatgacctgggggcaggggcgcggcaaggtggtggacggcgggcgcgggctggacctgagcctggacagggcctccgggtccgggttccagtccaaggacgagtacctgttcggcaagatcgagatgcagatgaagctggtgcctggcaactcggcgggcaccgtgacgaccttgtacctgtcgtcgcagggcgacgcgcacgacgagatcgacctggagttcctgggcaacgtgtcgggcgagccctacacgctgcacacgaacgtgttcacgcgcgggcgggggcagcgggagcagcagtcccgcctctggttcgacccccacgccgaacttccacactacctcggtgttgtggaacccggcgcacgtcatctttcgcggtggacgggacgcccggtgagggacttccccaaccccnaggcccgccgggggtggcgttcccccggaacccaccccatgcgggggttaccccacccttttggaacccccaacaaattgggccaccccaggccggccccccttcaaggggaaaatggggccccggggccccttttttttccccttcttttccgggg

SEQ ID NO: 75287 - protein, 221 aa, Zea mays
  misc_feature: Ceres CLONE 1559742
  misc_feature (25)..(195): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature (170)..(170): Xaa is any aa, unknown, or other
MRASALVCFVAVSACIACIAHGGNFYQDTEMTWGQGRGKVVDGGRGLDLSLDRASGSGFQSKDEYLFGKIEMQMKLVPGNSAGTVTTLYLSSQGDAHDEIDLEFLGNVSGEPYTLHTNVFTRGRGQREQQSRLWFDPHAELPHYLGVVEPGARHLSRWTGRPVRDFPNPXARRGWRSPGTHPMRGLPHPFGTPNKLGHPRPAPLQGENGAPGPLFFPLLFR

SEQ ID NO: 75288 - DNA, 875 bp, Zea mays
  misc_feature: Ceres CLONE 1559744
  misc_feature: Translation starting site: 577
  misc_feature (828)..(828): n is a, c, t, g, unknown, or other
ctggagctccccgcggtggcggccgctctagaactagtggatcccccgggctgcaggaattcgtctcacccctagaaaaaatttcctcgcagacgcatcgaaatccaaagtttgagccaacacacacagagagaggacaactcctcacaactctcccttccctcctgtaggggccaaaagggttagagaataggagaagtagttccctagcccaacacaagaaaaacaagctcgatctcctcatcaccctaatccaagcaactgctttgtgtgttgggaaattcttgtgacccctgttatattattatccgtgtagctactaccttcattcccccctttggacccatcaaatggctggcatgtctctgcaacacccctgggcgtttgctttcggtcaactacgaaacgtcatctccttaataacattactggccccaataccaacattataacacatctacaaaagaaagtcaacggaaggcttccagtcagtaccctaagtagttgccctgatcagcgccatgctgtggatcttctaagcactgatcaagtccaacgagaccttcctcatcacacatgaacggcgccggctgcgtcatcgagaccatctacgtcgtcatgtactacgtctacgcgcccaagaaagccaagctgttcacggccaagatcatggtcctcctcaatggcggcgtctttggggtcatccgtctgctcacccttctcatctacagggcagtaagcacgttgtgctgcttggctggatctgcgtcggttttctctgtcagtgtcttcgtcgcgtcactcagcatcatgcagacgagtgatcantacgaataagcgtggagtacatgccaatctgcatctacctgtactga

SEQ ID NO: 75289 - DNA, 859 bp, Zea mays
  misc_feature: Ceres CLONE 1559745
  misc_feature: Encodes the peptide sequence at SEQ ID NO. 75290
  misc_feature (760)..(760): n is a, c, t, g, unknown, or other
  misc_feature (761)..(761): n is a, c, t, g, unknown, or other
ctggagctccccgcggtggcggccgctctagaactagtggatcccccgggctgcaggaattcgtctcacccctagaaaaaaggtgtgagcctcagcacgacgggattgcgcccacacgcgacgccaaacgaaacagctagccagcccccattcttctccggctccggtgcattccgtgtcctgtcctgtcctgtcctgatggaagcagcaatggctgccacgtcctccctactccttgcctccggctccaggaggtggccagcaaccttgcctccttccccctggccccagcagcagcgtctggttttctgcctcgctgcaagaacgaggccgctggacagcaagaggggtagctggaggcgctcttccagtgccaccggcggccggtcgaccgccgtctcgtcgtcgtcgtcatcggaaagatgggttctcgaccctgcaggagacggtgactggcgccacatcggctacaaagtcgcgcgccctggggcgatcgagatagtctcggaggacacggcggtgaccgtgggccgggtcgccgacaaggcggacatcgtgctccccgtcgccacagtttcaggcgctcacgcccggctggagaagaagggcggcagcctgctggtgacggacctggacagcaccaacggcacctacatcaacgagcgccggctcaacccggggcttccccgcgtccgtcgaccccggcagcctactcatcttcggtgacatccacttggccatgttccgtgtaaggaagacnngtgtggttgaggcgcccagtactagtaccgaggaggccgagggagctcagcaagagaccaccgcagctgaagtatttgacgacatgtgcctttattac

SEQ ID NO: 75290 - protein, 171 aa, Zea mays
  misc_feature: Ceres CLONE 1559745
  misc_feature (104)..(171): Pfam Name: FHA Pfam Description: FHA domain
  misc_feature: SWISSPROT Homolog: EC 1.14.13.90 Zeaxanthin epoxidase
MAATSSLLLASGSRRWPATLPPSPWPQQQRLVFCLAARTRPLDSKRGSWRRSSSATGGRSTAVSSSSSSERWVLDPAGDGDWRHIGYKVARPGAIEIVSEDTAVTVGRVADKADIVLPVATVSGAHARLEKKGGSLLVTDLDSTNGTYINERRLNPGLPRVRRPRQPTHLR

SEQ ID NO: 75291 - DNA, 837 bp, Zea mays
  misc_feature: Ceres CLONE 1559746
  misc_feature: Encodes the peptide sequence at SEQ ID NO. 75292
  misc_feature (515)..(515): n is a, c, t, g, unknown, or other
  misc_feature (521)..(521): n is a, c, t, g, unknown, or other
  misc_feature (523)..(523): n is a, c, t, g, unknown, or other
  misc_feature (534)..(534): n is a, c, t, g, unknown, or other
  misc_feature (535)..(535): n is a, c, t, g, unknown, or other
  misc_feature (540)..(540): n is a, c, t, g, unknown, or other
  misc_feature (543)..(543): n is a, c, t, g, unknown, or other
aagctggagctccccgcggtggcggccgctctagaactagtggatcccccgggctgcaggaattcgtctcacccctagaaaaatcccctggtgatacaactcgggccgttcatttcgtctttccgtagggatatgagggccgctccaaccgatccgcccacggcgccggcgaagtcgatgctgaggcggctgttcgatcgccagctcctgcggatctcaccagcggagcgtctaccatcggcgggggcgggagagaaggatgaggcggagccgagctccgtgtgcctggacggcatggtgcgcagcttcatggaggacgacgtcggcagcgagaaggctgcccacgggggccggtactgtaactgcttccacggaggcgataattcagatgacgaggaggacgacgaagcggcggcggcggcctccgacgtcgccgagacgatcaagggcctcgtccactgcgccacgcttcgggagcgcaacctcctcgccgacgtgtgcgcgcacctggagcngcatcncnaggcgggggcnncggcngcncgacctcctccgcctggtagcctcgtcgctgcgcggcgcggggcacgacgcctcccgtctgcgtctcccgctgggaaaaagtccccgtccccacccggtcggggaaggcccccttacatcgaacgtggctccctccgggggggccttggaaaccccgggccccctccaaaacccattccctggggggaaaattgggaacttcccgggttgggggggtttttaggggggcgccggcgaccccacccaaagggggggaaaccccgggcccccctttttttaaggggggtttttccc

SEQ ID NO: 75292 - protein, 235 aa, Zea mays
  misc_feature: Ceres CLONE 1559746
  misc_feature (128)..(128): Xaa is any aa, unknown, or other
  misc_feature (130)..(130): Xaa is any aa, unknown, or other
  misc_feature (131)..(131): Xaa is any aa, unknown, or other
  misc_feature (135)..(135): Xaa is any aa, unknown, or other
MRAAPTDPPTAPAKSMLRRLFDRQLLRISPAERLPSAGAGEKDEAEPSSVCLDGMVRSFMEDDVGSEKAAHGGRYCNCFHGGDNSDDEEDDEAAAAASDVAETIKGLVHCATLRERNLLADVCAHLEXHXXAGAXAARPPPPGSLVAARRGARRLPSASPAGKKSPSPPGRGRPPYIERGSLRGGLGNPGPPPKPIPWGENWELPGLGGFLGGRRRPHPKGGKPRAPLFLRGVFP

SEQ ID NO: 75293 - DNA, 886 bp, Zea mays
  misc_feature: Ceres CLONE 1559748
  misc_feature: Encodes the peptide sequence at SEQ ID NO. 75294
  misc_feature (354)..(354): n is a, c, t, g, unknown, or other
  misc_feature (419)..(419): n is a, c, t, g, unknown, or other
  misc_feature (420)..(420): n is a, c, t, g, unknown, or other
  misc_feature (432)..(432): n is a, c, t, g, unknown, or other
  misc_feature (448)..(448): n is a, c, t, g, unknown, or other
  misc_feature (468)..(468): n is a, c, t, g, unknown, or other
ggagctccccgcggtggcggccgctctagaactagtggatcccccgggctgcaggaattcgtctcacccctagaaaaaagccgaaagcacaagcacgccatggcagaggagaagaagaggcacaagcacaagcacaaggagaaggacaagcaggcgggcggcggcacggagcaggcggcgcacttcaagccgtgcggcgacgtgaagggcatccggttcgggggccagttcatcgtgaagtcgttcacggtgcggcgggcgtcgcccctggagctgctgcggctgctgggcatcccgccgtcgtacctgagcgagtgccagagccctgcgttcccgtccccacacgcctacatngccacgggctttcacatcctgggcgcaccagcgtggcacacgctgacgctgggcctgggcaccanncagtccaaggcngcgctcctcgtgttcnaatcccagggcatgaaagcnggcctggaacgcctgttggccgggccttaccccggtttgggaaattcaaaacgaaaggtcattccggggctttaccgggaaagaaaaagggccccctttaaatttcgcaaagggttgccccaaccatttaaattttaacccccggggccccgggtttgggcccccccggggttatttgcacccaaaaaatcctggggggggggtgtgaaaaccctctttcaaaatccaaggagtttttttgggaaaaccaaacctgggttttcccctccccgaggcgaaaaaaaattcccctttgattttccccgaaaaaagggtggttttcctttaaagaagagaaatcgtctccacgggggtttttccctcttccaaaaccccgggttgtttttttatttttttttaagcccccccaaaaaccctc

SEQ ID NO: 75294 - protein, 168 aa, Zea mays
  misc_feature: Ceres CLONE 1559748
  misc_feature (85)..(85): Xaa is any aa, unknown, or other
  misc_feature (107)..(107): Xaa is any aa, unknown, or other
  misc_feature (117)..(117): Xaa is any aa, unknown, or other
MAEEKKRHKHKHKEKDKQAGGGTEQAAHFKPCGDVKGIRFGGQFIVKSFTVRRASPLELLRLLGIPPSYLSECQSPAFPSPHAYXATGFHILGAPAWHTLTLGLGTXQSKAALLVFXSQGMKAGLERLLAGPYPGLGNSKRKVIPGLYRERKRAPFKFRKGLPQPFKF

SEQ ID NO: 75295 - DNA, 922 bp, Zea mays
  misc_feature: Ceres CLONE 1559749
  misc_feature: Encodes the peptide sequence at SEQ ID NO. 75296
  misc_feature (382)..(382): n is a, c, t, g, unknown, or other
  misc_feature (444)..(444): n is a, c, t, g, unknown, or other
  misc_feature (745)..(745): n is a, c, t, g, unknown, or other
  misc_feature (756)..(756): n is a, c, t, g, unknown, or other
ctggagctccccgcggtggcggccgctctagaactagtggatcccccgggctgcaggaattcgtctcacccctagaaaaagcgcaaaacacctcgccttttgtactcttgcgtctctgccctcgcgttatcgccttcgtcacgctcgctcgcctggctggcttgtgccttgccttgctcggcgtacgcgaacgcagcgagagggaggagcaaggaaatagagagagacagagagagagagagaaaaaatcaagtcatccccctttcctctgagctcgttccatggagaactcttctcacaagcgggcgcgggaggcgggcgacctcgtcgttggcggctgcggagaggagggctcgccgcaggctgacgccaagaggctgcngccgcaggacctgctcgacatgcttgaagacgacaccgacgcggccgcggccggcgacctancgtcggtcatgcggagacctggaggaggaaataacccagctttcaaccaagcccccgaagggcccggcccctggccccggaacttgggctttcctggcctgaaggcctcgaaccacaaaattgggggttccccccccccccttccctttttccaaaaaagaaaaaaagcccgggccccccgggggggcccccttctcccccccccggctttaaaaaggcaaaaaattgggggttttccaaagaaaaaaattctgggaacgagaggggggttttggggggggtttcttcccaagaagggcgnggggcccgggncctttttcctccccccccccccccccccccgggggggaaaaaaaaaagtttttttggcggccgcgcttttttttttttttgggggggaaaaaaaaaccggggggggggcccccaaaaaaaaatctgccgcccctccccccccaaaaaaaaatatttctctcttttt

SEQ ID NO: 75296 - protein, 213 aa, Zea mays
  misc_feature: Ceres CLONE 1559749
  misc_feature (34)..(34): Xaa is any aa, unknown, or other
  misc_feature (55)..(55): Xaa is any aa, unknown, or other
  misc_feature (155)..(155): Xaa is any aa, unknown, or other
  misc_feature (159)..(159): Xaa is any aa, unknown, or other
MENSSHKRAREAGDLVVGGCGEEGSPQADAKRLXPQDLLDMLEDDTDAAAAGDLXSVMRRPGGGNNPAFNQAPEGPGPWPRNLGFPGLKASNHKIGGSPPPLPFFQKRKKARAPRGGPLLPPPALKRQKIGGFPKKKILGTRGGFWGGFLPKKGXGPGXFFLPPPPPPRGGKKKVFLAAALFFFFGGEKKTGGGAPKKKSAAPPPPKKNISLF

SEQ ID NO: 75297 - DNA, 866 bp, Zea mays
  misc_feature: Ceres CLONE 1559750
  misc_feature: Encodes the peptide sequence at SEQ ID NO. 75298
  misc_feature (735)..(735): n is a, c, t, g, unknown, or other
  misc_feature (736)..(736): n is a, c, t, g, unknown, or other
  misc_feature (834)..(834): n is a, c, t, g, unknown, or other
ctggagctccccgcggtggcggccgctctagaactagtggatcccccgggctgcaggaattcgtctcacccctagaaaaaatcccaccccacccacctccttcctcttcccgcccgctaaaacccacgccaccgccgcgcgccgccggcagcgcaagggacgcacgatggccatgcaggtggtgcgcaacctcgacctggagcggtacgcggggcggtggtacgagatcgcgtgcttcccgtcccggttccagcccaagacgggcaccaacacgcgcgccacctacacgctgaacccggacggcactgtgaaggtggtgaacgagacgtgggccgacgggcgccgcggccacatcgagggcacggcctggcgcgccgaccctgccagcgacgaggccaagctcaaggttcgcttctacgtgccgcccttcctccccctcatccccgtcaccggcgactactgggtgctccacatcgacgccgactaccagtacgcgctcgtcgggcagccctccaggaactacctctggatcctttgcaggcagcctcacatggacgagtccgtgtacaaggaactggtggagcgtgccaaggaggaagggtacgacgtgtcgaagctccgcaagacggcaccctgacccgccgccggagagcgagcagagccccagggacggcgggatgtggtgggtcaagtccatctttggcaagtagcccttgtggtggtggggtgggcacnncgggtgctgcccgtgcccgagcaggcgagcgcacgcaagagatgccctgtgaccgtcgggttccgcgtgtacattcagcactagcctggggattaagntgggtttcgttgttggctgttcgcgatctgca

SEQ ID NO: 75298 - protein, 156 aa, Zea mays
  misc_feature: Ceres CLONE 1559750
  misc_feature (9)..(156): Pfam Name: Lipocalin_2 Pfam Description: Lipocalin-like domain
MAMQVVRNLDLERYAGRWYEIACFPSRFQPKTGTNTRATYTLNPDGTVKVVNETWADGRRGHIEGTAWRADPASDEAKLKVRFYVPPFLPLIPVTGDYWVLHIDADYQYALVGQPSRNYLWILCRQPHMDESVYKELVERAKEEGYDVSKLRKTAP

SEQ ID NO: 75299 - DNA, 842 bp, Zea mays
  misc_feature: Ceres CLONE 1559752
  misc_feature: Encodes the peptide sequence at SEQ ID NO. 75300
  misc_feature (534)..(534): n is a, c, t, g, unknown, or other
  misc_feature (640)..(640): n is a, c, t, g, unknown, or other
ctggagctccccgcggtggcggccgctctagaactagtggatcccccgggctgcaggaattcgtctcacccctagaaaaaccctatcacggcggcggcggcggaagagtagcagcagcaggcggcgccgagtagcgtctccccacctcgagcttgccaccatggctagaggattgaagaagcatttgaagaggctcaatgcgcccaagcattggatgctggacaagcttggcggagcttttgctcccaaaccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaacgagaactacaggctgctgtatgacactaagggccgcttccgccttcacccaatcagggatgaggatgctaaaagtcagctttgcanggttaggtctgttcagtttgggcagaagggcatcccgtacctgaacacgtatgacggccgcaccatccgctaccctgaccccgctcatcaggccacgacaccatcnagatcgatctggagaccaacaagatggtggacttcatcaagtttgatggtggcaacgtcgtcatgggtaccggggggaagggaaccctggcccgggggggggtgttttcaaggaaaacggggaaaaccccagggggccgctttttaaacccttttcccttgggaggactcccccggggcccccccatttttgccccccccta

SEQ ID NO: 75300 - protein, 208 aa, Zea mays
  misc_feature: Ceres CLONE 1559752
  misc_feature (94)..(164): Pfam Name: Ribosomal_S4e Pfam Description: Ribosomal family S4e
  misc_feature (3)..(40): Pfam Name: RS4NT Pfam Description: RS4NT (NUC023) domain
  misc_feature (42)..(90): Pfam Name: S4 Pfam Description: S4 domain
  misc_feature (125)..(125): Xaa is any aa, unknown, or other
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKSQLCXVRSVQFGQKGIPYLNTYDGRTIRYPDPAHQATTPSRSIWRPTRWWTSSSLMVATSSWVPGGREPWPGGGCFQGKRGKPQGAAF

SEQ ID NO: 75301 - DNA, 800 bp, Zea mays
  misc_feature: Ceres CLONE 1559753
  misc_feature (570)..(570): n is a, c, t, g, unknown, or other
  misc_feature (571)..(571): n is a, c, t, g, unknown, or other
ctggagctccccgcggtggcggccgctctagaactagtggatcccccgggctgcaggaattcgtctcacccctagaaaaagttggacgtgccattgccgaccgagcctgaaatcgttctatcctcgccgccgccgccgccgccgccgtttgttatcgctcggagtttctccgttcccgtctctccggccgctgcaggtacgcctagcaacggcgtcaatcgcttcctcccaacccgcaggttatcaaatacggtgaaccttgtgttcctgtgaaattttgcagctcattatacattgaaggcagaaagtcattctccaatctgaaggcgaaacaaggtgtgcacatatatgttctagaggataaagttcactgagctgctgttgggcattggagagcccagttgtggttctatgcctgaaaggaattctttgtaattttctcctgtatctggttctgttatcatcattattttcctggtgtggggcaatcatgtcagagagcgagttagcagtaataaaaccagaggcattgaaaacttatatctgggctcagtgctttgatggctccanntacacagtggaggaaagaagttgccatgtttctgcccctatgatatgtcggggaaattatgaaaaaatgggaacaggttcatctaaagaatctggctatagttcttacccggaagaaagttaatcccggcaagttttgaattttgaattcctggaataattgggccggtttccaatcagggccccctgggggccctttcaaaaaaggggagggggaaattcctttttca

SEQ ID NO: 75302 - DNA, 854 bp, Zea mays
  misc_feature: Ceres CLONE 1559754
  misc_feature: Encodes the peptide sequence at SEQ ID NO. 75303
ctggagctccccgcggtggcggccgctctagaactagtggatcccccgggctgcaggaattcgtctcacccctagaaaaaacgaagagcaggcgatgaaaatgtccgcttccgttgcggccgcctcccccaccctccgcttctcctccgccactcatcctctccaccgaccgctccgccggcggctcccgtcggttcgatgctccctcgccgccgccgccggccccggtgtccgggcgccccctgagctcgtcgactccatcctctccaaggtgaagggaactgaccgaggagtgctgctgccaaaagatgggcaccaggaagtggctgaggtcgcgctgcagctggggaagtactgcatagacgaccccgtcaagtccccgcttatattcggagaatgggaggttgtgtactgctcggtgccaacctcgccgggagggctctaccggacgccccttggccgcctggtattcaaaaccgacgagatggtccaggcggtggaagcgcctgacgtggtcaggaacaaggtgtcgttctccgtctttggcctagagggcgcagtgtcattgaaaagtaagctgaatgtgctggacagtaaatggattcaggtcgtgttcgaagcaccagaactgaaagtcggctcctttggggttcagtacggtggcgagagcgaagtcaagctggagatcacctatgtcgatgagaagatcaggctaggggagaggggtcagaggctcgcttttcgtcttccttagacgatgatagaatggcatgcattgtgtgtgagacttcagaaccacaacacccatgaggggtggcgcttacccggtcgttttgtacaaactggggttcagg

SEQ ID NO: 75303 - protein, 219 aa, Zea mays
  misc_feature: Ceres CLONE 1559754
  misc_feature (50)..(217): Pfam Name: PAP_fibrillin Pfam Description: PAP_fibrillin
MKMSASVAAASPTLRFSSATHPLHRPLRRRLPSVRCSLAAAAGPGVRAPPELVDSILSKVKGTDRGVLLPKDGHQEVAEVALQLGKYCIDDPVKSPLIFGEWEVVYCSVPTSPGGLYRTPLGRLVFKTDEMVQAVEAPDVVRNKVSFSVFGLEGAVSLKSKLNVLDSKWIQVVFEAPELKVGSFGVQYGGESEVKLEITYVDEKIRLGERGQRLAFRLP

SEQ ID NO: 75304 - DNA, 850 bp, Zea mays
  misc_feature: Ceres CLONE 1559755
  misc_feature: Encodes the peptide sequence at SEQ ID NO. 75305
  misc_feature (731)..(731): n is a, c, t, g, unknown, or other
  misc_feature (732)..(732): n is a, c, t, g, unknown, or other
ctggagctccccgcggtggcggccgctctagaactagtggatcccccgggctgcaggaattcgtctcacccctagaaaaccgactcccagttccactctcgcttccttccttccctccctcccacgcaaatggtggccgctcgcctccgcctcgcgctgctactctccgtctgcctctgctccgcgtgggcgcgcccacgcctcgagcaggccatccgcctgccgtcgcagcgcgccgcggcggccgacgaaacggacgacggagccgtcgggacccgctgggctgtgctcatcgcaggctccagcggctactacaactaccgccaccaggcggacatctgccatgcataccagatcatgaagaagggcggactcaaggatgagaacatcattgtcttcatgtacgatgacatcgcgcatagcccggagaatccgaggcctggtgtcatcatcaaccatccccagggtggcgatgtctatgctggggtgccaaaggattacacggggcgagatgtcaacgtcgacaatttcttcgctgttctgcttggcaacaaaactgctctcaggggtgggagcggcaaggttgtggacagtggccccgatgatcatatctttgttttctacagtgaccatgggggtcctggtgtccttggaatgcctacgtatccatatctctatggtgatgacctcgtagatgtcctgaagaaagagcatgctgccgggacctacannaagctggtcttttaccttgaagcatgcgaaatctggaagcatctttgaggccctccctgcgaatgacatccatgtgtatgcgaacaccgcgtcaaatgcaaaagagagcagctggggg

SEQ ID NO: 75305 - protein, 216 aa, Zea mays
  misc_feature: Ceres CLONE 1559755
  misc_feature (50)..(215): Pfam Name: Peptidase_C13 Pfam Description: Peptidase C13 family
  misc_feature: SWISSPROT Homolog: EC 3.4.22.34 Legumain
  misc_feature (201)..(201): Xaa is any aa, unknown, or other
MVAARLRLALLLSVCLCSAWARPRLEQAIRLPSQRAAAADETDDGAVGTRWAVLIAGSSGYYNYRHQADICHAYQIMKKGGLKDENIIVFMYDDIAHSPENPRPGVIINHPQGGDVYAGVPKDYTGRDVNVDNFFAVLLGNKTALRGGSGKVVDSGPDDHIFVFYSDHGGPGVLGMPTYPYLYGDDLVDVLKKEHAAGTYXKLVFYLEACEIWKHL

SEQ ID NO: 75306 - DNA, 915 bp, Zea mays
  misc_feature: Ceres CLONE 1559756
  misc_feature: Encodes the peptide sequence at SEQ ID NO. 75307
  misc_feature (481)..(481): n is a, c, t, g, unknown, or other
ctggagctccccgcggtggcggccgctctagaactagtggatcccccgggctgcaggaattcgtctcacccctagaaaaaacacacccattcaaattctgctgctgattgtgatccagcaccccgagtcgtacacaagatctactctgcagaacttgcgggagcggatcacaactaagtgcatagaacaggacatatggctactccagcagtgaaggtttacgggtgggctatctcgccgttcgtatcgcgggctctgctggccctggaggaggccggcgtcgactacgagctcgtccccatgagccggcaggatggcgaccaccgccgcctggagcacctcgccaggaaccctttcgggaaggtgccggtgctcgaggatggagacctcatgctctcccaatggcgtgggatcgcgaggcatgttctccgaaagcactaaccggatctgctggggcggcgtcaggctggaacaaacttgnatggtggaattgtgtcttggagtggaagcccaccatctgaacccgccgggaattgccattgtggggggagggcgtgttccgcgcctttcttgggccgcgagcgccaccgggcggggggggggacaaaaactttgtaaaaacttaagaagggggtttgggagttgtagaaaggcccgcatgggcacagtgacatttccttagcggaggaaattaataaagcctcgcccgaagttgggccccttttagccacatatggattggctcttgtggccccccgaatttcgcccggggtttgttgggatggcccgtccaactcacattaaaaggtgcctgggggggaggggggctccacctggtgcgcggcgggtgagtagaaaatgagagtgtcggaatattgcagagggcaggaggtggggtaagagaaatatgacaaa

SEQ ID NO: 75307 - protein, 81 aa, Zea mays
  misc_feature: Ceres CLONE 1559756
  misc_feature (4)..(79): Pfam Name: GST_N Pfam Description: Glutathione S-transferase, N-terminal domain
  misc_feature: SWISSPROT Homolog: EC 2.5.1.18 Glutathione transferase
MATPAVKVYGWAISPFVSRALLALEEAGVDYELVPMSRQDGDHRRLEHLARNPFGKVPVLEDGDLMLSQWRGIARHVLRKH

SEQ ID NO: 75308 - DNA, 918 bp, Zea mays
  misc_feature: Ceres CLONE 1559758
  misc_feature: Encodes the peptide sequence at SEQ ID NO. 75309
  misc_feature (784)..(784): n is a, c, t, g, unknown, or other
  misc_feature (918)..(918): n is a, c, t, g, unknown, or other
agctccccgcggtggcggccgctctagaactagtggatcccccgggctgcaggaattcgtctcacccctagaaaaaatctctctctctctctctctctctctcttcatcgccgcagtgcgcgctcctacaacccatcgctcaccaccacctgctcctccagcggcggcgtccagggtgaacccgaatccccaacaccatggcggggggcaagatccagaagaagcgccacggcgcggcgggaggcgcccggctgcagggcggtatcccgttcgagaagtccaaggggcagcacatcctgcggaacccggcgctggtggactccatcgtcgccaaggcccggtctcaaacccacccacacccgtcctggagatggggggcggggcacagggaaaccctccccaagtgccctccctcaaaggctgggtggttaagggcccctcctccccccctccaagcttccaacccccccccaatggggggtttcgaaagcccaaacccgggggggtttcccaggggggcaacccccgtttcttcccttttgggggcctcttcaggggggttttccccaagggggaggaaagttttccccccccaaaagaggggggaatatccctccccccgaaacatattttgggagaaaattatgaggggggggggagaaaaaaaaactttctctcggaatacacacaaaaaagattatagtcctccccccgccttgaaaatgtttcaagagagcggtgttgtggtggaaaacccccccctctcaaaaaaatttttttatangggagggtggctccgcttaaaaataaattgtttctcccaaaacccgcgaaacaatatttcccccccgtaagaacagagaattgggggggagacgacacacccccggcggaggaaaaataaagaccctcctcccn

SEQ ID NO: 75309 - protein, 218 aa, Zea mays
  misc_feature: Ceres CLONE 1559758
  misc_feature (196)..(196): Xaa is any aa, unknown, or other
MAGGKIQKKRHGAAGGARLQGGIPFEKSKGQHILRNPALVDSIVAKARSQTHPHPSWRWGAGHRETLPKCPPSKAGWLRAPPPPLQASNPPPMGGFESPNPGGFPRGATPVSSLLGASSGGFSPRGRKVFPPQKRGEYPSPRNIFWEKIMRGGGEKKTFSRNTHKKDYSPPPALKMFQESGVVVENPPLSKKFFYXGGWLRLKINCFSQNPRNNISPP

SEQ ID NO: 75310 - DNA, 986 bp, Zea mays
  misc_feature: Ceres CLONE 1559759
  misc_feature (797)..(797): n is a, c, t, g, unknown, or other
  misc_feature (852)..(852): n is a, c, t, g, unknown, or other
  misc_feature (854)..(854): n is a, c, t, g, unknown, or other
  misc_feature (883)..(883): n is a, c, t, g, unknown, or other
  misc_feature (911)..(911): n is a, c, t, g, unknown, or other
  misc_feature (937)..(937): n is a, c, t, g, unknown, or other
  misc_feature (941)..(941): n is a, c, t, g, unknown, or other
ctccccgcggtggcggccgctctagaactagtggatcccccgggctgcaggaattcgtctcacccctagaaaaaatctcttccagtcttcctacgctcctgtcggcgcgtcctccgcatcccggtgaccggtgtgttctccgatttgaggggcgtccctcgcacgctccggtctgctgctcctccgccctccggagtccattccagcggagcgcgctacggcacagatcggccgccgtccatccctttcccagctctccagagcctccgctgccgcgtccggtgagcacgtctcgaccggtttccaggtagtcacgtaccgcacctgtgcctctatctatcctctcctcgccgtatgcctcttggcgatttctattagtttttcattggcccttagtttaaatcagctgctggggctgttctcgccggtctttccatacgggtagggccatgggcttccgctattaagctctgaaacgggtttggggggcccaccagttccccataatggcttggtccgaactggtgggaactaaaaacttaggtccttctgggggggttttctccccaagaggatttatttggggcgctttaaaaaaataggtttgagggtggggcccatcattttttttaccccaaaaaacagagatttaagggtggaaaaaaaggtttttttctccaaaaggaaaacaggaagttttcccccccgggcccgaagaaaaacctttgattgtggcaccatgtgtttgttaaaacaataatcggtaaactctttttggggacaagcttctcgctccntaaaaactccccgcccttgaaaaacggggcgcccaaaaaaaataaaagactcaananccccccccccaccccccccgcccgccccnatataatgggttgaggagaattatccangccacccaaaaaaacaaaaaaaaagnagantaggtattagatatttggggaggcggcgaacaaaatctgcgcagg

SEQ ID NO: 75311 - DNA, 876 bp, Zea mays
  misc_feature: Ceres CLONE 1559760
  misc_feature: Encodes the peptide sequence at SEQ ID NO. 75312
  misc_feature (729)..(729): n is a, c, t, g, unknown, or other
aaagctggagctccccgcggtggcggccgctctagaactagtggatcccccgggctgcaggaattcgtctcacccctagaaaaaaagccaggccggcgaggctgcgtgtgcgtgcatgcggcgacgtcggccgggggctgcagcatggccccgatcgacctcgggcgaggcggccgcgcctcaggcactggctcgggggccgcgccgggcacaccccggctcgtgatggtcgtcgtcgaccccgtccgcgagtcgacggcggcgctggagtgggcgctctcccacgccattgtcgagggcgacgacatcctgctcctccacgtcaacatgccgtacccgcacaacggggccgcgggcagatccgggccctcacgctcctcgtctggcgggagcaccggttccccgatcgccgcgctcctaggcggaggtggaggcggcggatcgggcgccggcgcggatccggcggacttcatggaggagatgtgcgccgcgtgcaaggcgcggtacccccgcgcgcgggtgaacgcggagcgcgtcgagcccgctaccgagggccgggaagccaaggcgcagaccatcctcgccgagtcccagcgacgcggcgtcgagctcctcgtcataggcctgcgccgcgcgtcctctttctttgggttaagaagcccgagcgggtcgtcgagccgcgggcacgacagcacggcggagttcttgatcgagcatagcaagtgcctngtgcgtaagcgtccagaagaagggccagaatgccggatacctgctcaacaccaagacccacaaaaacttctggctactagcatgaacgtacatgtacctttcatgatcgatcgatcagaactgttttcatggaatgtgtaatgtgta

SEQ ID NO: 75312 - protein, 241 aa, Zea mays
  misc_feature: Ceres CLONE 1559760
  misc_feature (24)..(191): Pfam Name: Usp Pfam Description: Universal stress protein family
MAPIDLGRGGRASGTGSGAAPGTPRLVMVVVDPVRESTAALEWALSHAIVEGDDILLLHVNMPYPHNGAAGRSGPSRSSSGGSTGSPIAALLGGGGGGGSGAGADPADFMEEMCAACKARYPRARVNAERVEPATEGREAKAQTILAESQRRGVELLVIGLRRASSFFGLRSPSGSSSRGHDSTAEFLIEHSKCLVRKRPEEGPECRIPAQHQDPQKLLATSMNVHVPFMIDRSELFSWNV

SEQ ID NO: 75313 - DNA, 732 bp, Zea mays
  misc_feature: Ceres CLONE 1559761
  misc_feature: Encodes the peptide sequence at SEQ ID NO. 75314
ctggagctccccgcggtggcggccgctctagaactagtggatcccccgggctgcaggaattcgtctcacccctagaaaaaagaatcctttgccaaatcaacgccagcaacagcaaagcaactacagagagtaggagatgcttactctccacaccattcagtcatgcccctcgctgcgcagatcctctctgttccggcgtgctctgctaggcaggaagagatctttcatttctgccagcagttctgaggatgccgaatccggcactcccccgccgcttggtggcgacaaacaccagcaggaggttcttgcacagatcgccatgcttcagacgcagaaggtgcgcatcacagacttcttgggacgagccgctctgctttacctgacccagttcgccaaaggacgcccaactcggagtttcaaccttgattggggccaaaaaccccatgaaaaaaacttgatgcccttggtgaccccaatctgggaaaagttccaccgcaaaattcaagctttccaggaaccggttaaggtccaccgccaaaaaaaaaaaataacccaaaaggggtttaaaggattttcaaaactgggtttttgaagggggaaaaacccggggggtggtttttttaaaaacctttgggaaagggtaacaacccccggaacacaagggggaaaaaaaagggggaaaaaaccccggggggggggacccccccaagggggtaaaaaaaaaaatttcca

SEQ ID NO: 75314 - protein, 151 aa, Zea mays
  misc_feature: Ceres CLONE 1559761
MLTLHTIQSCPSLRRSSLFRRALLGRKRSFISASSSEDAESGTPPPLGGDKHQQEVLAQIAMLQTQKVRITDFLGRAALLYLTQFAKGRPTRSFNLDWGQKPHEKNLMPLVTPIWEKFHRKIQAFQEPVKVHRQKKKITQKGFKGFSKLGF

SEQ ID NO: 75315 - DNA, 706 bp, Zea mays
  misc_feature: Ceres CLONE 1559762
  misc_feature: Encodes the peptide sequence at SEQ ID NO. 75316
  misc_feature (255)..(255): n is a, c, t, g, unknown, or other
  misc_feature (351)..(351): n is a, c, t, g, unknown, or other
  misc_feature (363)..(363): n is a, c, t, g, unknown, or other
  misc_feature (369)..(369): n is a, c, t, g, unknown, or other
  misc_feature (370)..(370): n is a, c, t, g, unknown, or other
ctggagctccccgcggtggcggccgctctagaactagtggatcccccgggctgcaggaattcgtctcacccctagaaaaacttttttgtcgcctccgtgcgtgccccgggggccttgatcgcgcgcaccggtcagctcagcccgtctgattcgcgtgctgccagccctccgccgatcgtgaaacacaaccgtcggtggtttgcttgcttgatcgctgatcctcgcggaacgctcacggtcatggcgcctcagccntttgcgcgctccgaggctgagcgcccccgctggccacgcggcgtgcagggttgctcggccgcgccgctattcgggaagcgggcgcccccgtcgtcncgttccccgcgncgtagnncgcgcgccgtcccctcttgctcgcctgcaggagtcgtccacttccacccctggtacaaaaaaaaggatcccccggacgggcccaaggagccccaaccgaagcggggaaacccgggccccggccccaaacccaaaaaagggcgcggggcttccccctttccgggaaaatattccccccggggaaatttcccccccccttaaaagggacccttttgaagggggggagaaaaaaatttttccccggggggggtcttccccttccacaaaaaaaaaaaaccgtgggggggggggctctctttcttaaaaaaaaagaaacccccccccccttttttttttt

SEQ ID NO: 75316 - protein, 109 aa, Zea mays
  misc_feature: Ceres CLONE 1559762
  misc_feature (43)..(43): Xaa is any aa, unknown, or other
  misc_feature (44)..(44): Xaa is any aa, unknown, or other
MAPQPFARSEAERPRWPRGVQGCSAAPLFGKRAPPSSRSPRRXXRAVPSCSPAGVVHFHPWYKKKDPPDGPKEPQPKRGNPGPGPKPKKGRGASPFPGKYSPRGNFPPP

SEQ ID NO: 75317 - DNA, 791 bp, Zea mays
  misc_feature: Ceres CLONE 1559763
  misc_feature: Encodes the peptide sequence at SEQ ID NO. 75318
ctggagctccccgcggtggcggccgctctagaactagtggatcccccgggctgcaggaattcgtctcacccctagaaaaaatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgatcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgactgacatgatcacccacgccgacaccgacgtggtgatcgtgggcgccgggtacgcggggcatgtctgcgcgtacgagctgtccaaggacccctccgtgagcgtcgcatcatagaagcagtcctgtcatcggccgcggctcatgatgggccggcagctgtcatagccatggcggtgcccagccggctccactgttcctggacaaactgggcttgggcaacaacaagcccaggaattactggtggggcagcacccggggttgttcccttccccccgaagggcctggtcctggggcggccccaacgggaaagtgttcaaacccccgggcgggggaggaaccttatatggggggggggggccccttcgcggg

SEQ ID NO: 75318 - protein, 43 aa, Zea mays
  misc_feature: Ceres CLONE 1559763
MTRRYMTDMITHADTDVVIVGAGYAGHVCAYELSKDPSVSVAS

SEQ ID NO: 75319 - DNA, 860 bp, Zea mays
  misc_feature: Ceres CLONE 1559764
  misc_feature: Encodes the peptide sequence at SEQ ID NO. 75320
  misc_feature (749)..(749): n is a, c, t, g, unknown, or other
  misc_feature (751)..(751): n is a, c, t, g, unknown, or other
  misc_feature (793)..(793): n is a, c, t, g, unknown, or other
  misc_feature (823)..(823): n is a, c, t, g, unknown, or other
  misc_feature (826)..(826): n is a, c, t, g, unknown, or other
  misc_feature (832)..(832): n is a, c, t, g, unknown, or other
  misc_feature (833)..(833): n is a, c, t, g, unknown, or other
ctggagctccccgcggtggcggccgctctagaactagtggatcccccgggctgcaggaattcgtctcacccctagaaaaatttttagttccagagccctccagagcaaaaaaaatattatcgaatactaaagcattttcctcgtcgatagaatatagaattttaaaaagggagcgaaataggtttttcctttttgcagctccgtcgtccaccaacctcctccgatccggccgccgcagcgtagccgaattgtcccctcgctagcttctccggccggctagaggctgtttcaggcggcctcgatctcctccgcgcggctgaggaaggagatcacgcggttgctctggggctggggcgtgcatgatgggattttggttgattccgatggagactccggcgaggcttctgtggagcacgagcttcttccgccacaagatcgccgccatgctcgcctcctcctcctgcttcttatagatcccaccccctcgccgtcgtcgtcggcacggcagctagctcgctagcttctgtacataggtcgacgcgccatatagatactagtctcggattaagcgataattaaggcaaagaatctccaagtttgcttcgctcttgcattgaaccatggagtctggacggctcatcttcaacgcgccgggctctggcgccgggcagatgctcttcctcgactgcggcgcaggcggcggtcccggctgcggcttgttccatcgaggcgggagactgatgcttggncnatgaagaaagggcgcgcgtaaaacggccctttcttcactcgncagacgagctcctcgaggaagagtactacnacnagcgtnntcccggaaaagaagcggcgcctcaccc

SEQ ID NO: 75320 - protein, 43 aa, Zea mays
  misc_feature: Ceres CLONE 1559764
MESGRLIFNAPGSGAGQMLFLDCGAGGGPGCGLFHRGGRLMLG

SEQ ID NO: 75321 - DNA, 835 bp, Zea mays
  misc_feature: Ceres CLONE 1559765
  misc_feature: Encodes the peptide sequence at SEQ ID NO. 75322
  misc_feature (646)..(646): n is a, c, t, g, unknown, or other
  misc_feature (709)..(709): n is a, c, t, g, unknown, or other
  misc_feature (751)..(751): n is a, c, t, g, unknown, or other
  misc_feature (752)..(752): n is a, c, t, g, unknown, or other
ctggagctccccgcggtggcggccgctctagaactagtggatcccccgggctgcaggaattcgtctcacccctagaaaaactccgcgagggcctagggtctggcttgctgagctggagctgatggatctagggtttgggttgcggtgatggtcctgcagcgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctacagaagtacagagagatggagggtgatagcaagttaactgctaaatctagcgatggctcgattaaaaaggatgctcttggtcatgtgggagcaagtagctcagctgcagaagggggagcatacaaccnaaggaatgggttatatgcaacctcagtaccataacggggatatctcaaactaatgaaggtatnggaccttttctgcgacagctgctcttacctgaggcgattttnntttggtcttagtattactaaagacacccttgcgtgaccattaaagagttaccaatccccctcaataagtccctttttaatctc

SEQ ID NO: 75322 - protein, 168 aa, Zea mays
  misc_feature: Ceres CLONE 1559765
  misc_feature (34)..(99): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature (158)..(158): Xaa is any aa, unknown, or other
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAEGGAYNXRNGLYATSVP

SEQ ID NO: 75323 - DNA, 862 bp, Zea mays
  misc_feature: Ceres CLONE 1559767
  misc_feature: Encodes the peptide sequence at SEQ ID NO. 75324
  misc_feature (794)..(794): n is a, c, t, g, unknown, or other
  misc_feature (795)..(795): n is a, c, t, g, unknown, or other
  misc_feature (847)..(847): n is a, c, t, g, unknown, or other
ctggagctccccgcggtggcggccgctctagaactagtggatcccccgggctgcaggaattcgtctcacccctagaaaactgtgcaactcggcagtgcagtggcgtgcagcatcagtgcaactctgcacgccatcccgctggccaccctcagccgctggctagtggattaccaccaccgtctctgcgctacagaattttgtcatccggaatcagattcctcaggcagctcgcatgcaaaagtcaagcggctctacgttattccctcttcacttcattgtcagcaatcctaaaagctcgcagcagcagctagcagctcgttcttgttcgtcagctctagcctaccctgcgctggctcttctttaattctgcagggaagttccagtttcagctagagtgcaggcggagaaccaatgggggcggcgccgtcgtccgacgactcgtcacgcgccggagacggccgggctgtggcgagcagcgctgcctctggcactggcactggcagcaacagcaaccaggcccagtctgaagcgggcgccgccgcctcacaagttccacgagatagttgcgcaggaggcgacgacggccggcggcggcggcggcggcggcactgctgctgcagccgacctggaggatcaggcgtgcagcaccggggtctacctggctgggaaaaccaagaagtactgggtggacgagaagaccaggtgcaactgcttcgtgctgttcgctagagcgctgtccatcacttggggcgacgatcccagatactggatctggcatcccgtcagagaaaccnnagtacgtgctatctatacgtagtgcttgctccagcaattacatatacatgcnatgctcagttcagtg

SEQ ID NO: 75324 - protein, 105 aa, Zea mays
  misc_feature: Ceres CLONE 1559767
MGAAPSSDDSSRAGDGRAVASSAASGTGTGSNSNQAQSEAGAAASQVPRDSCAGGDDGRRRRRRRHCCCSRPGGSGVQHRGLPGWENQEVLGGREDQVQLLRAVR

SEQ ID NO: 75325 - DNA, 790 bp, Zea mays
  misc_feature: Ceres CLONE 1559768
  misc_feature: Encodes the peptide sequence at SEQ ID NO. 75326
ctggagctccccgcggtggcggccgctctagaactagtggatcccccgggctgcaggaattcgtctcacccctagaaaaaacggggaggactagtagtatgctcgccgccgcctggaggctgtcgcagcgagccgtcacgtctcctctcctaggcatcgggcgaccccaaatccgaaaccctttctccaccatggcgtctctctcgccggcagccgcctcgccgaagaggctgagggtctactcgtctgccgccgctgacggcgacggcgcggggagcggcaagcgcgtggggacccacaacggaagcttccactgcgacgaggcgctcggctgcttcctcatccgcctcacctcccagttcgccggcgccgacgtcgtccgcacccgcgattcccagatccttgatacattggatgctgttcttgatgttgggggtgtctatgatcccagtcggcatcgctatgatcatcaccagaagggcttcagtgaggattttggacatggattcaacacaaaacttagcagtgctggacttgtgtacaagcacttccgcaaagaagatattgctaaggagctttgggggttaatggagatcctgaagatgttcccctggtttgaatctcgggaatatataaaaagcttttgtttgagggcccttgattgcgatttggacaaggggaattcaatccaagtggggcccccgaattcaccccccccacaaaagttgggtggaaaaaaaaaaccacctttggttttttccccccgcggtggggggaccccgtttttttt

SEQ ID NO: 75326 - protein, 199 aa, Zea mays
  misc_feature: Ceres CLONE 1559768
  misc_feature (29)..(188): Pfam Name: UPF0160 Pfam Description: Uncharacterised protein family (UPF0160)
MASLSPAAASPKRLRVYSSAAADGDGAGSGKRVGTHNGSFHCDEALGCFLIRLTSQFAGADVVRTRDSQILDTLDAVLDVGGVYDPSRHRYDHHQKGFSEDFGHGFNTKLSSAGLVYKHFRKEDIAKELWGLMEILKMFPWFESREYIKSFCLRALDCDLDKGNSIQVGPPNSPPPQKLGGKKKPPLVFSPRGGGTPFF

SEQ ID NO: 75327 - DNA, 777 bp, Zea mays
  misc_feature: Ceres CLONE 1559769
  misc_feature: Encodes the peptide sequence at SEQ ID NO. 75328
  misc_feature (48)..(48): n is a, c, t, g, unknown, or other
  misc_feature (70)..(70): n is a, c, t, g, unknown, or other
  misc_feature (71)..(71): n is a, c, t, g, unknown, or other
  misc_feature (422)..(422): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
ctggagctcaccgcggtggcggccgctctagaactagtggatcccccngggctgcaggaattcgtctcanncccctagaaaaaaccaacctcagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccangaacctggccaagaatgagggccggcggcatcatccggcaccggggttcgaagtctttcgaaagtcaagtccacccccggtttgcaggccctaacaagggagggtggttcgggccctcccaggggttttccccgaagagggcaaaattttttccccgggggcccccgggggggccaattattttttccccccaccccttggggggccccctctttcttttttaaagggggggggtgccccccccccnnntcgcctcctcctctcttgaagacccccccccccccaaaagggagaaaatttttggggagagagggggcctcccccccccttgggggggggcgcccacctcctcttc

SEQ ID NO: 75328 - protein, 104 aa, Zea mays
  misc_feature: Ceres CLONE 1559769
  misc_feature (99)..(99): Xaa is any aa, unknown, or other
MASSVAAAASTFLGTRLADPAPQNGRIVARFGFGLGGKAKPAPKKVAKTSTSSDRPLWFPGAVAPDYLDGSLVGDYGFDPFGLGKPVEYLQFELDSLDXEPGQE

SEQ ID NO: 75329 - DNA, 854 bp, Zea mays
  misc_feature: Ceres CLONE 1559770
  misc_feature: Encodes the peptide sequence at SEQ ID NO. 75330
  misc_feature (605)..(605): n is a, c, t, g, unknown, or other
  misc_feature (623)..(623): n is a, c, t, g, unknown, or other
ctggagctccccgcggtggcggccgctctagaactagtggatcccccgggctgcaggaattcgtctcacccctagaaaaaaaaacccaccccacagcagccaaaaccgcgtccactttcaataacgagcggccaacccaacccaacccaacccaccactgcctccctccccgttccccagtccccaccccgaccggctgctcctcctcctttccccgcgccatcctcgaggcatcaccggcgccgcaacttcgttgaggaggaagcccgcacccgcccccgatccgatggccaacagcaacctcccgcggcggatcatcaaggagacgcagcgactgctcagcgagccagcgccggggatcagcgcgtcgccctcggaggagaacatgcgctacttcaacgttatgatccttgggccggcgcagtcgccctatgaaggtggagtttttaagcttgaactctttttacctgaggaatatcccatggctgccccaaaggttaggtttctgaccaagatttatcatcccaacattgacaagcttggtaggatatgcctcgacattctcaaggacaaatggagcccagcacttcagattcgaacagttncttttgagtatacaggcntctactgagtgcaccaaatccagatgaccctctctccgataacattgcaaagcactggaaaatccatgaaggagaagctgtttgaacagccaaagagtggactcgcctgtatgccaccggtgcatgaaaacccaatgctggttcttggggaaaaacccccatcaaacttcagttcctaatccgttggcttttgcctggaaaaaaacgactggaaaaatttggccaggggaa

SEQ ID NO: 75330 - protein, 114 aa, Zea mays
  misc_feature: Ceres CLONE 1559770
  misc_feature (9)..(114): Pfam Name: UQ_con Pfam Description: Ubiquitin-conjugating enzyme
  misc_feature: SWISSPROT Homolog: EC 6.3.2.19 Ubiquitin--protein ligase
  misc_feature (107)..(107): Xaa is any aa, unknown, or other
  misc_feature (113)..(113): Xaa is any aa, unknown, or other
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVXFEYTGXY

SEQ ID NO: 75331 - DNA, 793 bp, Zea mays
  misc_feature: Ceres CLONE 1559771
  misc_feature: Encodes the peptide sequence at SEQ ID NO. 75332
  misc_feature (551)..(551): n is a, c, t, g, unknown, or other
  misc_feature (552)..(552): n is a, c, t, g, unknown, or other
  misc_feature (560)..(560): n is a, c, t, g, unknown, or other
ctggagctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcggcccgcacggcgtcaaagtcggcgaagggcgtgtgggtcaaggnncggctccnagatcttcagcgaagggttggacttgaactaccttcggggaaccccgaaccctcattccacgccccaaaagcatcctctgcaatctggggcttggccagggcttggcctcaggggggccccttccaaggggttaacccaatttccccggggggccccgctttgggggaaggggtcttcaaaaccccctttttaatcccggggggggaagattttttaaacccccctcttcggc

SEQ ID NO: 75332 - protein, 145 aa, Zea mays
  misc_feature: Ceres CLONE 1559771
  misc_feature (65)..(143): Pfam Name: Chloroa_b-bind Pfam Description: Chlorophyll A-B binding protein
  misc_feature (135)..(135): Xaa is any aa, unknown, or other
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLGPHGVKVGEGRVGQGXAPRSSAKGWT

SEQ ID NO: 75333 - DNA, 802 bp, Zea mays
  misc_feature: Ceres CLONE 1559772
  misc_feature: Encodes the peptide sequence at SEQ ID NO. 75334
  misc_feature (388)..(388): n is a, c, t, g, unknown, or other
  misc_feature (402)..(402): n is a, c, t, g, unknown, or other
  misc_feature (403)..(403): n is a, c, t, g, unknown, or other
  misc_feature (462)..(462): n is a, c, t, g, unknown, or other
  misc_feature (496)..(496): n is a, c, t, g, unknown, or other
aagctggagctccccgcggtggcggccgctctagaactagtggatcccccgggctgcaggaattcgtctcacccctagaaaaagtcagggcctcttgatcatcagtcgccagaggagctgttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcngacgggaaggtggnntgctggcgccggcgaaccccaagggacgaagtacccagcactggatcaagggacatgcnggtgggagcacgaggcatcaaggaaccaagaaanggttaccccggcgtttcgcgcctggtgaacaaggccgaccgggggaggcccatcaagcactcgcttggggcagtcccaccccggggcgcctgggtgcccctacaacccgggacttccctggaaacaaattcgggggcttttggaaccggaaaaaaccccccaaccctccgggaaaaggggtttcccccgtttgggtcccgcatatggggaaaaaaaaaattttttaccctcaaaaatttttggaggggccccctccccgggggggaaaaaaaaagggggggacccgggggggggggttcccctgtt

SEQ ID NO: 75334 - protein, 209 aa, Zea mays
  misc_feature: Ceres CLONE 1559772
  misc_feature (72)..(72): Xaa is any aa, unknown, or other
  misc_feature (77)..(77): Xaa is any aa, unknown, or other
  misc_feature (108)..(108): Xaa is any aa, unknown, or other
MDGGYYGGRDQRYSGGYYGGGGIATPGYAPAVPYGMSQVNIEGNGCGRALPPQPTVKVYCRANPNYAMSVRXREGGXLAPANPKGRSTQHWIKGHAGGSTRHQGTKKXLPRRFAPGEQGRPGEAHQALAWGSPTPGRLGAPTTRDFPGNKFGGFWNRKKPPNPPGKGVSPVWVPHMGKKKIFYPQKFLEGPPPRGGKKKGGTRGGGFPC

SEQ ID NO: 75335 - DNA, 772 bp, Zea mays
  misc_feature: Ceres CLONE 1559773
  misc_feature: Translation starting site: 162
  misc_feature: SWISSPROT Homolog: EC 1.2.1.12 Glyceraldehyde-3-phosphate dehydrogenase (phosphorylating)
  misc_feature (445)..(445): n is a, c, t, g, unknown, or other
ctggagctccccgcggtggcggccgctctagaactagtggatcccccgggctgcaggaattcgtctcacccctagaaaaagaaaaaatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccgggtcacctgtcttttggcatcagggaaccctgaggaaatcccgtggggtgaggctggcnctgaatatgtcgtggaagtcacccggcgtcttcactgacagggactaggctgctgcacatctccagggtggtgctaggaaggttgtatctctgcctccagcaaagagccaccattgttgtttgttggggtcaatgaggaacaattacccctccggaagttaaaatttggtttccaaaggttaggtggcccaaaaaaaggggcctggttccccctgggtaaggggtaatttcagaaaacctttcgggtttttttttaaggggtttaaaagaaaaaggggtttaagggccttatatggggccccccccaaaaaaaatgttgtgaggggc

SEQ ID NO: 75336 - DNA, 813 bp, Zea mays
  misc_feature: Ceres CLONE 1559775
  misc_feature: Encodes the peptide sequence at SEQ ID NO. 75337
ctccccgcggtggcggccgctctagaactagtggatcccccgggctgcaggaattcgtctcacccctagaaaaactctccctctcttcgacacagccagccacggccaggtcctttctctccccttccctcttctgcctactctccaactccaggcgcgattcgaagcatagaactcccccaccgcttctcaaatctcaactcccctctgcgccctcgcctcttctcttttgttttacctgctgcggaatgcggtccacgactatggatcttcgagagattacttaaaaaaacacacacacaaatcttgcagcagcctccacacctgggattctcctccatagcgtgtgccgtcagccgtgtactactggcctccacggctccacccgcctttggttggattcctgttgccgcttcctcctcccgtgatcggccgcattgcgctgagggattctcgctcgctttttcccgacgccgcctgcggcactggttctttggtgggcggccatggcgaacggcggcgagcaatccgcgatcaccgcggccgtggagcggggccgcgtgaccggcgtctctcggcggctcgcgggggaggagagctccgacgacgacgacgaggggagccagcgcttctcggacgccgaggatcggtcctggcactctcactcgcgccaaggctccgccttggagttggaggactgtatctccacgtccgcgcccatcagccgcgacgccggcggcggggacacggtcacggccacggccgagcgcggcaggaagtcgtgcgtgtcggagtgctcgctggacggcgtcc

SEQ ID NO: 75337 - protein, 102 aa, Zea mays
  misc_feature: Ceres CLONE 1559775
MANGGEQSAITAAVERGRVTGVSRRLAGEESSDDDDEGSQRFSDAEDRSWHSHSRQGSALELEDCISTSAPISRDAGGGDTVTATAERGRKSCVSECSLDGV

SEQ ID NO: 75338 - DNA, 652 bp, Zea mays
  misc_feature: Ceres CLONE 1559778
  misc_feature: Encodes the peptide sequence at SEQ ID NO. 75339
  misc_feature (330)..(330): n is a, c, t, g, unknown, or other
  misc_feature (364)..(364): n is a, c, t, g, unknown, or other
  misc_feature (419)..(419): n is a, c, t, g, unknown, or other
  misc_feature (482)..(482): n is a, c, t, g, unknown, or other
ctggagctccccgcggtggcggccgctctagaactagtggatcccccgggctgcaggaattcgtctcacccctagaaaaacttcaccccacaccttcttcttcgtcgtcgtcttcccctgctgcggttagcctggccgtggccgcctcctgctcttcgatctcacgctgcgatggagcggtacgaggtgatcagggacatcggctcgggcaacttcggggtgacaaagctcgtccgggacgtcaggaccaaggagctcttcgccgtcaagttcatcgagagagggcaaaagattgatgagcatgttcagaggggagattatgaaccaccngggtccctgaagcaccccaaacataattagattncaggaaggtccgtgctaaactccaacgcattttgggcaatagtttatgggaatantgcttgctgggggggtgagcttattttgaaaagaaatctggcagtggcgggggaagattttanttggagggatgaaggccaagggtttctttctttccagcaacttgaattttcgggaggggaagctatttgccccttttccatggcaaagttttgccccttaaaggattttgaaaacctggaaaacacctttcccccaaaaaagggaaaaggggtccccaccccccggggct

SEQ ID NO: 75339 - protein, 62 aa, Zea mays
  misc_feature: Ceres CLONE 1559778
  misc_feature: SWISSPROT Homolog: EC 2.7.11.1 Non-specific serine/threonine protein kinase
MERYEVIRDIGSGNFGVTKLVRDVRTKELFAVKFIERGQKIDEHVQRGDYEPPGSLKHPKHN

SEQ ID NO: 75340 - DNA, 855 bp, Zea mays
  misc_feature: Ceres CLONE 1559779
  misc_feature: Encodes the peptide sequence at SEQ ID NO. 75341
  misc_feature (308)..(308): n is a, c, t, g, unknown, or other
  misc_feature (311)..(311): n is a, c, t, g, unknown, or other
  misc_feature (327)..(327): n is a, c, t, g, unknown, or other
  misc_feature (340)..(340): n is a, c, t, g, unknown, or other
  misc_feature (353)..(353): n is a, c, t, g, unknown, or other
  misc_feature (362)..(362): n is a, c, t, g, unknown, or other
  misc_feature (370)..(370): n is a, c, t, g, unknown, or other
ctggagctccccgcggtggcggccgctctagaactagtggatcccccgggctgcaggaattcgtctcacccctagaaaaaaagaacaacgtgctcgattctccatctcgaccgtcgctcaccgggaagctaccgctacgacgaagcatggcgtccgtcaccgcccgcgctcccggtcgcggccctgcgctcgtcggcgtctctcaagtcgtcgtcgtcgtcggcggcggccttccttggccactctagccgcctcggccgcactgctaccgcgtcgccgacgaagcgcagccctaaggctgaggccanggncgagtggctccggggncttccctccccgncttactcgacggnagcctgccngggtgacnatggcttccaccccttggggcctggccgaggaacccgaaaacctggagggtggtacttgcaggccggacctgggtaaacgggccggtggccaaaccttgggcctggccccgaattctaattcccggaagggcttgaaccaagggcggggttaaaaacaccccccccaagggggaccaacccccgccaaaataggaaaaaattttggtttttcctttaaaaccgtttttgaaacaaaggtttccctgtttttccaaaccggggaaaaaccccgggggggggggggaactaaaaaaaaccccgggggggtttacaaagaaccccccctttttaaaaaaaaaaaaaatgggccccccccaaagaaggggggggtctcccccgccgggggttttttatcacccccccaaattatttccgccccccccccctgggggggagggggagaaaaggggagccccctcccccggggggggggggccttttttcc

SEQ ID NO: 75341 - protein, 50 aa, Zea mays
  misc_feature: Ceres CLONE 1559779
MASTPWGLAEEPENLEGGTCRPDLGKRAGGQTLGLAPNSNSRKGLNQGRG

SEQ ID NO: 75342 - DNA, 873 bp, Zea mays
  misc_feature: Ceres CLONE 1559780
  misc_feature: Encodes the peptide sequence at SEQ ID NO. 75343
  misc_feature (591)..(591): n is a, c, t, g, unknown, or other
aagctggagctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacntcgggaacccgagcctcatccacgcgcagagcatcctcgccatctgggccttgcaggtcgtgctcatggggcgccgtcgagggctacggcatcgccggcggcccgcttggcgaaggcgtcgacccgttctatcccgggcggggctttcaacccgttgggcctccccgaagacccgaaggccttccttaacctcaaggggaaggacctaaaaacgggccccctcccctggtctcccggttgggaattttcccccaggccacccccccgggaaagggccccctc

SEQ ID NO: 75343 - protein, 215 aa, Zea mays
  misc_feature: Ceres CLONE 1559780
  misc_feature (65)..(194): Pfam Name: Chloroa_b-bind Pfam Description: Chlorophyll A-B binding protein
  misc_feature (147)..(147): Xaa is any aa, unknown, or other
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYXGNPSLIHAQSILAIWALQVVLMGRRRGLRHRRRPAWRRRRPVLSRAGLSTRWASPKTRRPSLTSRGRT

SEQ ID NO: 75344 - DNA, 857 bp, Zea mays
  misc_feature: Ceres CLONE 1559782
  misc_feature: Encodes the peptide sequence at SEQ ID NO. 75345
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
ctcaccgcggtggcggccgctctagaactagtggatcccccgggctgcaggaattcgtctcacccctagaaaaaaaaaaactgactgattgtctgattgtgattgcggcagcaccgccgaccacgagcccgccgaaaggctcctccgcctgccgttccagggtgcactgccgccattgctcatctccccgtggtgcggaggtccacccgggcgccaattggtctcctctttcgttggcagactgagtggcatccaatcctgaatcaatgaggggctggggtttgctcgtgttatcgctacatgttctttcatgcctggttagtggcgttgcttctggtcgaacaagctcttatgtgcgcacagagttcccatctacagatatacctctagaaagtgaatggtttcctattccaaagggatacaatgctccacagcaggttcatatcactcaaggtgattatgatggaaaggcagttatagtatcttgggttactccagaagaacctgggccaagtgaagtattttatggcaaggagaagctatatgaccagaaagcagaaagaaccaacacaaactatacgttttacgattacaaatctggatacatacaccattgccttgtcgatggccttgagtataacactaaatattattacaagatgggaaccggaaattcagctcgagaattctggtttaaacgcctccggcaattgatccagatgcctcatacacatttgggcatcataggtgatcttggggcaaaaatttaattctctctcaactcttccacattattaaaaaaacgggaggtcaaactgttctttttttttnnnaatcacataaagttgacgacacca

SEQ ID NO: 75345 - protein, 167 aa, Zea mays
  misc_feature: Ceres CLONE 1559782
  misc_feature: SWISSPROT Homolog: EC 3.1.3.2 Acid phosphatase
MRGWGLLVLSLHVLSCLVSGVASGRTSSYVRTEFPSTDIPLESEWFPIPKGYNAPQQVHITQGDYDGKAVIVSWVTPEEPGPSEVFYGKEKLYDQKAERTNTNYTFYDYKSGYIHHCLVDGLEYNTKYYYKMGTGNSAREFWFKRLRQLIQMPHTHLGIIGDLGAKI

SEQ ID NO: 75346 - DNA, 731 bp, Zea mays
  misc_feature: Ceres CLONE 1559783
  misc_feature: Translation starting site: 162
  misc_feature (731)..(731): n is a, c, t, g, unknown, or other
acccgcggtggcggccgctctagaactagtggatcccccgggctgcaggaattcgtctcacccctagaaaaactcgtccaaaaccctagccctcgcgccgccgccgccgtgcccagcgctcgagctcctcgcctgccgcgagctcgcgccgcaacgccaccatgaagttcaacatcgcgaacccgtctaccgggtgccagaagaagctggaaatcgatgacgaccagaaactacgtgccttttatgaccgaaggatctcccaggaggtcagtggtgatgctctgggtgaggagtttaagggttatgtcttcaagatcatgggtggatgtgacaaacaaggcttccaatgaagcaaggagttctgacttctggtcgtgtccgctttctgcttcacacaggcactccctgctttcgccggttatggcagggcgtaatgggtgaagcccagggagggaagtcctgtcccgggggttgtaattggggaacccaaaaaacctttttttgtttaatcaaacctggggtaaaattgggtaaaaaaaagggggggaaaaaaaccaaaacctggccccggggggttttaaaaacgggacacaccccggaaaaaaaaccccccaagggggatattaaaggggggggtgcccctcccaaaaaaaaggggggggccctctctccccacaaaagaaaatatcttggggggaaaggacccttgtttttttttttcaaaaaaattn

SEQ ID NO: 75347 - DNA, 868 bp, Zea mays
  misc_feature: Ceres CLONE 1559784
  misc_feature: Encodes the peptide sequence at SEQ ID NO. 75348
  misc_feature (848)..(848): n is a, c, t, g, unknown, or other
ctggagctccccgcggtggcggccgctctagaactagtggatcccccgggctgcaggaattcgtctcacccctagaaaaaccatgtcggccccactcgacctcgactacataggcctctcgccggcggcggctgccgccgctgcccactacgacctgaagggtaccgagctccgccttggtctgccggggtccggttcgccggaccgcacttgttgtggctgccaccgcaaccaccctggacctgctcccggctaacggcgcccagcgcgggttttctgacgacgcgcctaccccttcccccggtgcagcttccgagaatggaaataaggtagctgaacaagacgaccaccagaaggttgcagcaacaccgcagccggtcccaaaagctcacgtggctgggatggccaccattccccaagctaccgcaccgaatcgatgtctaccacccaagctgaatgtgcatgcaacgaggatgctaaggccaaatcagaccattggatcctgtacatcctggtcaacctgcatggcatgtcatacctcaagaatattgacctccagacttacaataactaccaggacctgtcgactgcacttgacaagatgttcaatgctttcagtgctgagcctgatggcttatctctagaccacttggatcgtgaatatgatctgactttcaaggacagggatggctattgtatgctcgtaggcaatgaaccatgctagatgttcgctgactcctgacgcgagtctcggatcatgaacagatcatatgcacttggacttgctacgaagccacctctataggtcgagtatcacaactagaatggctgcctcatacatgctgcantagcggccgatttcttggga

SEQ ID NO: 75348 - protein, 95 aa, Zea mays
  misc_feature: Ceres CLONE 1559784
MSTTQAECACNEDAKAKSDHWILYILVNLHGMSYLKNIDLQTYNNYQDLSTALDKMFNAFSAEPDGLSLDHLDREYDLTFKDRDGYCMLVGNEPC

SEQ ID NO: 75349 - DNA, 821 bp, Zea mays
  misc_feature: Ceres CLONE 1559791
  misc_feature: Encodes the peptide sequence at SEQ ID NO. 75350
  misc_feature (146)..(146): n is a, c, t, g, unknown, or other
  misc_feature (375)..(375): n is a, c, t, g, unknown, or other
  misc_feature (522)..(522): n is a, c, t, g, unknown, or other
ctggagctccccgcggtggcggccgctctagaactagtggatcccccgggctgcaggaattcgtctcacccctagaaaaacccccgcgagacctgtccgaatcgcgcccaggtccctcgctgggagtttcgccgagggccctcccngcctcccctagattcacgacggagatggcgtccgagctcacctaccgcggcggcgggacgtccacggccgccggcgccggcgccgggggatactcaccgaagccgtccaagccgctcgcgtggctgccccgcgcggcccgctacgccgtcgccgagcatcgcccgctcttcgcgctcgccgggatgctgatcgccgccgccgtcatctccatcgcctccccgtccgccntcctcctcctcctccaccctccacctccaccggcggcgcccgccctcgtcctactcccaacaacaacaaatcccgctcgccccgcttttccccgtcgaagcccggccccaccacccggggaacgtggggccacgcggggaaattttnttccggggggaaaggggcccccgggcgcctaaaacggaaagggctttccgggttctttgtaacccgggggggccccgggtttttttgggggacccacctggggggggacccccccccccttgaggggggggggaaaagggttattttccccccccaaaaaaaaatttttccccccggggcgccaagagagaaaaaattttttttcccccccccaaaaaacccacaaattttttaaaaaaaaccccccccccatttttttttcaagcaccccctcttgtgggtgggggggaaaaccaaaa

SEQ ID NO: 75350 - protein, 127 aa, Zea mays
  misc_feature: Ceres CLONE 1559791
  misc_feature (69)..(69): Xaa is any aa, unknown, or other
  misc_feature (118)..(118): Xaa is any aa, unknown, or other
MASELTYRGGGTSTAAGAGAGGYSPKPSKPLAWLPRAARYAVAEHRPLFALAGMLIAAAVISIASPSAXLLLLHPPPPPAAPALVLLPTTTNPARPAFPRRSPAPPPGERGATRGNFXPGGKGPPGA

SEQ ID NO: 75351 - DNA, 853 bp, Zea mays
  misc_feature: Ceres CLONE 1559794
  misc_feature: Encodes the peptide sequence at SEQ ID NO. 75352
  misc_feature (444)..(444): n is a, c, t, g, unknown, or other
tggagctcaccgcggtggcggccgctctagaactagtggatcccccgggctgcaggaattcgtctcacccctagaaaaactcccctccatcccggctcgagctccccgcggcagcaatggagaccctcctctccccctccacattgttcacgctatcactccgtggctccagcaggagaccgtctctggctgctagcgtctcgtccagacccaccgtgtcatgctccagcgcgctcaagaggccacaggccggcgccgtcgctgcctcctcccatggagacggcgtcggcaggaactgaatgtcgttcctgcaccacggcctggcggcggccgcgctgtcgctggccatcggcctggccccggcgccggcgccggcggtggcgtcggagttcgacgtgctgaacgacggggcccccgaggactcctacgtggtggacgacgcangcgtgctgagccgcgtcaccaagtccgacgtcaagcgggcttgcccgcgacctggaagcccgcaagaacattccgcctcaacttcatcactggtccgcaagctcaccagcaaaggttgacccgtttcgagtaccccggaccaagtcctgaaagaattggtaccccccgaatcggggaagggcaacaaacaaggggcatcggggtggctccttccaaagccaaaaaggagggcgcccttaccccgggggggccccgcttttattccagggccgttgggggaaacaaaattttcagaaacccccccgggttttggaaaaacctccaagtttccttcggggcgggacaagaaaatccaacggaggggggttttttttaaacccgggaaaaaacggtggggggggggggaaaa

SEQ ID NO: 75352 - protein, 87 aa, Zea mays
  misc_feature: Ceres CLONE 1559794
  misc_feature (49)..(49): Xaa is any aa, unknown, or other
MSFLHHGLAAAALSLAIGLAPAPAPAVASEFDVLNDGAPEDSYVVDDAXVLSRVTKSDVKRACPRPGSPQEHSASTSSLVRKLTSKG

SEQ ID NO: 75353 - DNA, 851 bp, Zea mays
  misc_feature: Ceres CLONE 1559798
  misc_feature: Encodes the peptide sequence at SEQ ID NO. 75354
ggagctccccgcggtggcggccgctctagaactagtggatcccccgggctgcaggaattcgtctcacccctagaaaaaaccgtcaccacacgcacacggcacacacaccttcttcgtccccttcaccccctgccgctagcctctccctcccctcggtcgtagccatggagaccacttcccctgcctcttcacctgggcacacctccctcccagctgctgcaggtaggactaagtagtaaatagccatatacataggttgagtggatcgttaagagacggtagccatatacataggagtactggatagtatacaagaacggtagatacagggcaggggacatgatgctgggaaagagatctgggcgcccgtcgccggcggcgcggcagcacatgcggcggaccacgagcatgacggagttcgcggcaccgcacgtgctggtagacgtcgcggaggaggaggaggacgaggagctgcagctgctgccggcgcacgccgaggccacaggggaggcggccgagcaggaggacccctacgggtgggccatcggcggcgccgcggcggccgggcgcgcggactggctggcggcgtaccgcgcccgcgcggcgccggcactggcggggctacgccggaactcggccgacttctcggctgccgagaccgccgcgttcctccgcgcctgcgggctctgcaaccgccgcctcggacccggccgcgacaccttcatgtacaggggcgacacggcgttctgcagcctcgagtgccggcagcagcacatcacgatcgaagagttgaaaagagaagtgcgcgctcgccaacgcgccgaaggcgccggcgttccgaaccgggtggg

SEQ ID NO: 75354 - protein, 170 aa, Zea mays
  misc_feature: Ceres CLONE 1559798
  misc_feature (95)..(153): Pfam Name: DUF581 Pfam Description: Protein of unknown function (DUF581)
MMLGKRSGRPSPAARQHMRRTTSMTEFAAPHVLVDVAEEEEDEELQLLPAHAEATGEAAEQEDPYGWAIGGAAAAGRADWLAAYRARAAPALAGLRRNSADFSAAETAAFLRACGLCNRRLGPGRDTFMYRGDTAFCSLECRQQHITIEELKREVRARQRAEGAGVPNRV

SEQ ID NO: 75355 - DNA, 799 bp, Zea mays
  misc_feature: Ceres CLONE 1559799
  misc_feature: Encodes the peptide sequence at SEQ ID NO. 75356
  misc_feature (365)..(365): n is a, c, t, g, unknown, or other
ctggagctccccgcggtggcggccgctctagaactagtggatcccccgggctgcaggaattcgtctcacccctagaaaaagtagaagcaggcaggcagaggcaagaggcccctcaccctcaggtgatcaggtcgctagctcccggcttaactagtaggcagccatgaatttcggtgggaatggcaacgcgacgatccggtgcaagtactgcagggcgagcctgagcgtgatccccggcgagcgcgccatccagtgcgcgcaatgcaactgcgtgacccgcatccggcgggccgaccgcatcccgcttggcgcgggccggcgcacgtgccgccggcgttccagcgcgcccggggcaagaagcgcgnccgtcctggtcggcatcacgtacgccggcgcgcgccggggctgcggcgacctgaggggcccccgtcaacgaacgtcaagtgcatgaggaaaccttcctctggcccgggctttagggttttccccgggaggggattatcctggctccctgaaaacccaaagggacccctttaggggttccccccaaggggaaactccccgaggggattcccttggttggggaaggggtttatttaaggaaacccccgggggtccccttttcggggataggggcccaggggggggaaaaaaaccggccaaaaggggggggggggcacaaaaggcccctcccccccgggggggcgttcccaaaagggggccccttctgtgggaaaaaaaaataaaaaaagaaattttttcgccccccccttgggtggaaggccccccgggttataac

SEQ ID NO: 75356 - protein, 95 aa, Zea mays
  misc_feature: Ceres CLONE 1559799
  misc_feature (68)..(68): Xaa is any aa, unknown, or other
MNFGGNGNATIRCKYCRASLSVIPGERAIQCAQCNCVTRIRRADRIPLGAGRRTCRRRSSAPGARSAXVLVGITYAGARRGCGDLRGPRQRTSSA

SEQ ID NO: 75357 - DNA, 875 bp, Zea mays
  misc_feature: Ceres CLONE 1559800
  misc_feature: Encodes the peptide sequence at SEQ ID NO. 75358
ctggagctccccgcggtggcggccgctctagaactagtggatcccccgggctgcaggaattcgtctcacccctagaaaaaaacgagccttccctcccaaacttgcacgctgcccccgctctcgcctccgcccccgatccagatccagggtggaatagggaacggccatacaccatggcggatttctccaaggaatcttgcccttctgtgaagaacattttacttctggattctgaaggaaagcgtgttgctgtaaagtatttctcagatgattggccgactaatgcatcaaagttagcctacgaaaagtctgtttttactaaaactctaaagacaaatgcacggacagaagctgagataacattgtttgatggttatattgtcgtttacaagtttgtacatgaccttcacttttttgtcaccgctggagatgatgagaatgagctcatcttagcaagtgtactacatggtttttctgattctgttggtcttctactcaggggtgatgttgagaagcggactgcgcttgagaacttggatttgatacttctctgcatcgatgaaaatgtagatggggggaatcatcctggaaacagatgcaaacaccatgctgggtaggttgcaaccaatgctgttgatggttctgtgcccttttctgagcagacgaaatctcaggcactagccacagctagggagcaccttgcaaatctctactgaaatgaacaaccgcaaattgtttgacgttttatattaacctttttgtggtgaaggttggccacctaaaggttgaggggctttttgtaaactttattcctccccaaaagtctttgctgtaacaaaccctattttaaaattccgagaggaatgggccacacg

SEQ ID NO: 75358 - protein, 147 aa, Zea mays
  misc_feature: Ceres CLONE 1559800
  misc_feature (11)..(143): Pfam Name: Clat_adaptor_s Pfam Description: Clathrin adaptor complex small chain
MADFSKESCPSVKNILLLDSEGKRVAVKYFSDDWPTNASKLAYEKSVFTKTLKTNARTEAEITLFDGYIVVYKFVHDLHFFVTAGDDENELILASVLHGFSDSVGLLLRGDVEKRTALENLDLILLCIDENVDGGNHPGNRCKHHAG

SEQ ID NO: 75359 - DNA, 799 bp, Zea mays
  misc_feature: Ceres CLONE 1559803
  misc_feature: Encodes the peptide sequence at SEQ ID NO. 75360
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (545)..(545): n is a, c, t, g, unknown, or other
ctggagctccccgcggtggcggccgctctagaactagtggatcccccgggctgcaggaattcgtctcacccctagaaaaagcctctttgccaccgtccattcccccgttccatccatccatccacccacccaaaagccacacacatggacagcagcggaagctaggcctaggcggcgtcgtcccgtccagctacgcacgcagctatagcctatagctcctccctcccgcaccatccccagcagcatgtcgtcgtcgtcgtcgtccagggcgcggcggggcgggagcgggagcctgcagcagttcccggtggggcggtggcggcacgtggcggtggtggacgccgggtgcggctgccggccgcgccgggccacaaccaggctgctgagccagctgccgtccttcctccgcccgtccccgaagccgccgcagccgccgccgccgccgcgcagcagctcgcgctcctcctcgggcttcttcccgtcctcggccgcctacacggcctcctcatcnnngcacaccttcgacaccacccactcctcccacntcaacagcaactacgactccctctacaccccacaccccaccggcaccaagcacctggcgtcggccgccgaacagccgtcagcgccgggcggcggttaggaagaagcagcatctgcaggggccacaccaccaccaccagggcaccaggaggaaagagccgtaccaagagatgggccgtcccgggcgcggaacccgaacccgaaaccgaaaccccccacaaaaaaaggggggcccttgggggcttggccctttaaa

SEQ ID NO: 75360 - protein, 132 aa, Zea mays
  misc_feature: Ceres CLONE 1559803
  misc_feature (90)..(90): Xaa is any aa, unknown, or other
  misc_feature (101)..(101): Xaa is any aa, unknown, or other
MSSSSSSRARRGGSGSLQQFPVGRWRHVAVVDAGCGCRPRRATTRLLSQLPSFLRPSPKPPQPPPPPRSSSRSSSGFFPSSAAYTASSSXHTFDTTHSSHXNSNYDSLYTPHPTGTKHLASAAEQPSAPGGG

SEQ ID NO: 75361 - DNA, 794 bp, Zea mays
  misc_feature: Ceres CLONE 1559808
  misc_feature: Encodes the peptide sequence at SEQ ID NO. 75362
  misc_feature (74)..(74): n is a, c, t, g, unknown, or other
  misc_feature (82)..(82): n is a, c, t, g, unknown, or other
  misc_feature (426)..(426): n is a, c, t, g, unknown, or other
  misc_feature (466)..(466): n is a, c, t, g, unknown, or other
  misc_feature (483)..(483): n is a, c, t, g, unknown, or other
tggagctccccgcggtggcggccgctctagaactagtggatcccccgggctgcaggaattcgtctcacccctangaaaaagntgcaaagtagggttcccaccgggacacaggccgcctccatcccatggcgcgcgccgccgcctccaggctcgccgccgtggcgaacttttcctctacgcgcgagttgttcgcccgccacctcgccgccgctgccgcctcggcgtggaccgcaccgccgcgtctgcctgaaccagggagggagcggcggagcccgtgctggtggtgtccgagcaggtcgtttcatgccacaaggcaggtgtatacaagggattactatgatgtgcttggagtaagcaaggatgcttctgcaccggatataaagaaggcatattatgcgctcgcaaaagaagttccatcctgatacntataaagatgatgatgcagaaaaaacatttcaggaagttnacccgtgcctatgaggntttttgaggaaccattgacaagccgtgaaaaaaatttgaatcagcttgggacccaaaaactttatcaaccgttcaaaggttccgggtgggggacccctggaaggggcgggggttttcccccgggggaaaacccccatttgggggaaccttcctttgggggggaaattcttttggaaaaagggcaaaaccaaggggggggcccaaaaaaagttttaaaagggttttttttgggaaaacacttttcttttctttgggggaaacccttttccccacaggggtgtgccgaaaaaaaaaaaaccttttttttttgc

SEQ ID NO: 75362 - protein, 98 aa, Zea mays
  misc_feature: Ceres CLONE 1559808
MARAAASRLAAVANFSSTRELFARHLAAAAASAWTAPPRLPEPGRERRSPCWWCPSRSFHATRQVYTRDYYDVLGVSKDASAPDIKKAYYALAKEVPS

SEQ ID NO: 75363 - DNA, 783 bp, Zea mays
  misc_feature: Ceres CLONE 1559809
  misc_feature: Encodes the peptide sequence at SEQ ID NO. 75364
  misc_feature (14)..(14): n is a, c, t, g, unknown, or other
  misc_feature (733)..(733): n is a, c, t, g, unknown, or other
  misc_feature (755)..(755): n is a, c, t, g, unknown, or other
  misc_feature (756)..(756): n is a, c, t, g, unknown, or other
ctggagctccaccntcggtggcggctcgctctagaactagtggatccccctgggctgcaggaattcgtctcacccctagaaaaatcctccctcacgccggcggcctgtatccctctccccatggctgctggactgggagcgcgcccctccgccaccttcgtggccggaaggttccggcctctctctgcccctctccgccccgtccgctccggcaagttcattgtgccaaagcgatgcttcattgtctccctcatgcttgcatgggtggaagatcagcttgtggagatacgacactcgcaagagcagacttcactacaatcacagacaaggtcaactttttgagcggtggaaaaggtttcccctacagttcttgtacggggtcacatttcaaggacccttttttattttaggtccaaaaagcattgcctgaaaccttggccaggggccaaatttccctgggaggcttaaagggaatttccttggaatgggaaaaattcttttttaaaaatttttcccttccccccgggttttctgggacacttcccgggggggcttttttgggaggacccccccctcctttttccccccaaaagggaatttttccgccccccccccccccccccaaaaaaaaataaacactctgggggggggggggggggggagaaaacccccctcccccccccccgtgggggcacatgggggggggttttcttccccaaaaaaaaaaaaattnttcttccccccccccctttccnnaaaaaaaaaaagtaaattgttttgttt

SEQ ID NO: 75364 - protein, 73 aa, Zea mays
  misc_feature: Ceres CLONE 1559809
MAAGLGARPSATFVAGRFRPLSAPLRPVRSGKFIVPKRCFIVSLMLAWVEDQLVEIRHSQEQTSLQSQTRSTF

SEQ ID NO: 75365 - DNA, 883 bp, Zea mays
  misc_feature: Ceres CLONE 1559811
  misc_feature: Encodes the peptide sequence at SEQ ID NO. 75366
  misc_feature (772)..(772): n is a, c, t, g, unknown, or other
  misc_feature (825)..(825): n is a, c, t, g, unknown, or other
  misc_feature (868)..(868): n is a, c, t, g, unknown, or other
agctcaccgcggtggcggccgctctagaactagtggatcccccgggctgcaggaattcgtctcacccctagaaaaaagccacaagcccacaaccattattcttattccactgcatcaggtccaagtccaactctccaagcggcaagcgccatgccttcttccgcgcaggttctgctctgcctcgccgccgtgctggcggcggcggcggccaccaccgccgaggcgcactcgcagtgcctggacaacccgccggaccggtccatccacggccgccagctggccgaggccggcgaggtcgtccacgacctccccggtggcctcagggcctacgtcagcggcgccgcgagctcgagccgcgccgtcgtcctcgcctccgacgtcttcgggtacgaggcgccattgctcagacagatagtagacaaggttgcaaaggcagggtacttcgtcgtcgtgcccgatttcttgaagggagactacttagacgacaagaaaaactttacagaatggctcgaggctcactctccggtgaaagctgcggaagacgctaagccactgttcgccgctttgaagaaggaagggaagtccgtcgcggtgggaggctactgctggggagggaagctgagcgtggaggtggggaagaccagcgacgtcaaagctgtgtgcctttcgcacccgtacagcgtcactgccgacgacatgaaagaggtgaaatggccgatcgagatcctgggggccagaacgacacgaccacgccgccgaaaagagtgtaccngttcgtgcatgtgctgcgtgaaagacacgaggttccctactacgccaagatcntccagggagtcgagcacgggttcgcctgcaggtacaacaccancgaccctttcgtcgt

SEQ ID NO: 75366 - protein, 244 aa, Zea mays
  misc_feature: Ceres CLONE 1559811
  misc_feature (57)..(243): Pfam Name: DLH Pfam Description: Dienelactone hydrolase family
  misc_feature (208)..(208): Xaa is any aa, unknown, or other
  misc_feature (240)..(240): Xaa is any aa, unknown, or other
MPSSAQVLLCLAAVLAAAAATTAEAHSQCLDNPPDRSIHGRQLAEAGEVVHDLPGGLRAYVSGAASSSRAVVLASDVFGYEAPLLRQIVDKVAKAGYFVVVPDFLKGDYLDDKKNFTEWLEAHSPVKAAEDAKPLFAALKKEGKSVAVGGYCWGGKLSVEVGKTSDVKAVCLSHPYSVTADDMKEVKWPIEILGARTTRPRRRKECTXSCMCCVKDTRFPTTPRSSRESSTGSPAGTTPXTLSS

SEQ ID NO: 75367 - DNA, 871 bp, Zea mays
  misc_feature: Ceres CLONE 1559812
  misc_feature: Encodes the peptide sequence at SEQ ID NO. 75368
  misc_feature (510)..(510): n is a, c, t, g, unknown, or other
  misc_feature (811)..(811): n is a, c, t, g, unknown, or other
ctggagctcaccgcggtggcggccgctctagaactagtggatcccccgggctgcaggaattcgtctcacccctagaaaaaattgtcctccatttgaaggcatcgacaaactctttggtgctctcaagctcgatgacaccggcaaggttgggaaaggggccggcatgccatgcttcctttgtcctcacccgacatgcaagcaatctatgatcactcagggagtttgtgcttgtcctgagtgtagtggtaccctgattcttgatccagttagtgcacccaaatggcggctttactgcaacatgtgtaattgcattgtattgctcccacatgctgctcacaggatcaccactacagataagaagtgcctaacatgtgaatctactatcattgaagttgatttcaacaagaaaaccacccctcttcaagatggagctacattgcatgagggatgtatcttatgtgatgatctgttgcattcactcattgaaatgaagcatggtaagtcattctnttattcggagagggagaggaagaggcagagggagaggtcggggcagaggaagcagccggggtagaggaagacgagggaactcaaggtatgatgatcctaaaatgagtttccgggatttttgaagattttggacaaccaacattcggtcactactcactactttgtctgcttcttcgtgactgctgccaagactgccccggctttggaacacaggaatttcacaggaattagttcaaaacataggaaaaaccatgattcaggaaattttgtttattccaaaggagctgtaagccatgcttangcaggaaactgaccatcatctgcaacttttgtcttgcggtcagttaccccccaagatgaa

SEQ ID NO: 75368 - protein, 136 aa, Zea mays
  misc_feature: Ceres CLONE 1559812
  misc_feature: SWISSPROT Homolog: EC 5.99.1.2 DNA topoisomerase
  misc_feature (116)..(116): Xaa is any aa, unknown, or other
MPCFLCPHPTCKQSMITQGVCACPECSGTLILDPVSAPKWRLYCNMCNCIVLLPHAAHRITTTDKKCLTCESTIIEVDFNKKTTPLQDGATLHEGCILCDDLLHSLIEMKHGKSFXYSERERKRQRERSGQRKQPG

SEQ ID NO: 75369 - DNA, 796 bp, Zea mays
  misc_feature: Ceres CLONE 1559813
  misc_feature: Encodes the peptide sequence at SEQ ID NO. 75370
  misc_feature (478)..(478): n is a, c, t, g, unknown, or other
  misc_feature (574)..(574): n is a, c, t, g, unknown, or other
  misc_feature (615)..(615): n is a, c, t, g, unknown, or other
ctggagctcaccgcggtggcggccgctctagaactagtggatcccccgggctgcaggaattcgtctcacccctagaaaaaagagcagcagaggcagcgacacgatcgcgagcgcacgcacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgnctgggcgcggtgggcgccatcgcccccggagatcttcggcaagatgggcatcatcccgcccggagacccgcgctgccgtgggttcaagaacggggncgtcatccccgccccgcggggcaccctacaactactggggnccgactccttacaaggctcttcgttttttaacatgggggctcaagggctttcgcccaaaacccggccccctccaggaatgggaaaaacccgggcttccatggggcaaaacagaactttccccggccctcaaaaagtttcccccgcgggttccggggaaaccggttcttaccccgggggggg

SEQ ID NO: 75370 - protein, 208 aa, Zea mays
  misc_feature: Ceres CLONE 1559813
  misc_feature (55)..(191): Pfam Name: Chloroa_b-bind Pfam Description: Chlorophyll A-B binding protein
  misc_feature (103)..(103): Xaa is any aa, unknown, or other
  misc_feature (135)..(135): Xaa is any aa, unknown, or other
MAAQALLSGRQLLGRPVQSAVSRSSARKAPFVVRASSSPPAKQGADRQLWFASKQSLSYLDGTLPGDYGFDPLGLSDPEGTGGFIEPKWLAYGEVINGRYAMXGRGGRHRPRRSSARWASSRPETRAAVGSRTGXSSPPRGAPYNYWGPTPYKALRFLTWGLKGFRPKPGPLQEWEKPGLPWGKTELSPALKKFPPRVPGKPVLTPGG

SEQ ID NO: 75371 - DNA, 855 bp, Zea mays
  misc_feature: Ceres CLONE 1559814
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (524)..(524): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaactggagctccccgcggtggcggccgctctagaactagtggatcccccgggctgcaggaattcgtctcacccctagaaaaactcgagcggaggcccactaccgcactagcactggagcaggtcctcgccgtccacaggcgccagttcgtctcccggataagacgataattcgagccgaaaaatatcaccacacagacacacaggtacgcaaggcacagcccaataccaccgcaccgcacctgcacaccgccagggatggcggcaaccgcgcacctcacccggtgtcctcggcgtgtcgtcgcccgccctctccgctccgtcccactgcagctgcagcggcgctaagaagcagaaagctgcctctctgcgntcaggggggccgggcagcaagaggaaaggccgccctcccggggtttggccccggggcccgttcaaaaggttgggaacgccgcccttttccccgcccggggcgccaacccggaaaaccccccgaaaggaaaagccccaaaaaaaaaaaaccccctttcccccgttcaaaaatttttttccgcggttttcgtttaaaaaacctctccccggggtttttttctttcccccggaaaaggggagaaaccccccgggaaaaaggtggcccacctaacccccaaaaaagggggcccccccccggggggggggggccaaaaaaaaaaccccttccacgg

SEQ ID NO: 75372 - DNA, 813 bp, Zea mays
  misc_feature: Ceres CLONE 1559816
  misc_feature: Encodes the peptide sequence at SEQ ID NO. 75373
  misc_feature (542)..(542): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (797)..(797): n is a, c, t, g, unknown, or other
ctggagctccccgcggtggcggccgctctagaactagtggatcccccgggctgcaggaattcgtctcacccctagaaaaaaccacgaactggcgttccactgccgagcccttcctcctcttcctcttcttctgaccccccgctggcttggaaaaagggagagaaaactcgcgcactcggttatcgaaagggaggagcgcgggcgagggtgaggtgtcgcccacacggagctgcgaggtgtttgtaggatctcctaggtgagcccctgctgcttggagacagccatggccaccggcgtggctccagctcctctcccacatgtcagagtgcgtcatgggggcgtcgggttcaccaggagcgtcgattttgcgaaggtcttgtctgctcccggtgccggcacgatgagagcaagctcctctagaggcagggcgctcgtggcgaagagctctagtactggctcggagaccatggagctcgagccatcttcagaaggaagcccacttttagtacccaggcagaagtactgtgaaatcacaaccagancaggaggaagaaaactcgaactgtgatgggtgggggaatgtgccactttggccatggatcctcccccttaggggttttaaaaccctgggggcccctttaaaaaccccgaggggtttttcccaacacacctttgagggagggggtgttgttgtattccccccaacaaaaaggggggcgggttctccttttttttttttataaaaaaaaaaaaaaccccccccccccccccccggggaggggggagggggagnnnanctcctttcattttctt

SEQ ID NO: 75373 - protein, 94 aa, Zea mays
  misc_feature: Ceres CLONE 1559816
  misc_feature (87)..(87): Xaa is any aa, unknown, or other
MATGVAPAPLPHVRVRHGGVGFTRSVDFAKVLSAPGAGTMRASSSRGRALVAKSSSTGSETMELEPSSEGSPLLVPRQKYCEITTRXGGRKLEL

SEQ ID NO: 75374 - DNA, 802 bp, Zea mays
  misc_feature: Ceres CLONE 1559817
  misc_feature (133)..(133): n is a, c, t, g, unknown, or other
  misc_feature (143)..(143): n is a, c, t, g, unknown, or other
  misc_feature (144)..(144): n is a, c, t, g, unknown, or other
  misc_feature (216)..(216): n is a, c, t, g, unknown, or other
  misc_feature (217)..(217): n is a, c, t, g, unknown, or other
  misc_feature (504)..(504): n is a, c, t, g, unknown, or other
  misc_feature (518)..(518): n is a, c, t, g, unknown, or other
  misc_feature (683)..(683): n is a, c, t, g, unknown, or other
  misc_feature (718)..(718): n is a, c, t, g, unknown, or other
tggagctccccgcggtggcggccgctctagaactagtggatcccccgggctgcaggaattcgtctcacccctagaaaaaaaaaaaagaaaaattgggggtgagggctctgctggtcaggtcacaaggaacatngcttgcaaanntgagggtgtccgttctttctacaaggggtttgtccgccggattgctgaggcaagcgacgtacacgactggcnntcgtcttggaatccctttaagggtttctaaactaaaccaaagccagttgaaaaaaaaaaatggaaggggaaggcccttttcccccttttttttcaaaaagccctttttttggggctccaccaccgcgggggccaaaatgggggccttgggtttggaaaacccccgcggttttggggccccccttataaaaaagagggcggggattttcccccccccccgtgttgtccccacaccccccccccccttaaaaaagaaaagtgtttttttaggaggcacacccccccccncccaaaaaaccctntaaaaaaaaaaaaaaaagaaggatcctcttctcctttttctttattaaaagaagggggggggggggggccccccccccccttcttggggggggggggaaaaaaaaaaaaaaccccccccccacaaaaaaaggagaggggggggtgttttgttttcttttccttcntccccaaaaaaaagaaagggggggtggggtgtgtntttttttttttttttttttaagaaaaaaaaaaaaaatttttttgcccggccgggggagaaaaagaaaataaaattttatttttt

SEQ ID NO: 75375 - DNA, 697 bp, Zea mays
  misc_feature: Ceres CLONE 1559819
  misc_feature: Encodes the peptide sequence at SEQ ID NO. 75376
ctggagctccccgcggtggcggccgctctagaactagtggatcccccgggctgcaggaattcgtctcacccctagaaaaaattcgtccccggccgccgccgctcccagtctccacgcggaagcagcgcctcgcaacgctcctacccaatggcgccgacgtcgaagctgtcgatgggcatcaagcgcgcgtcgcggtcgcacgcgtaccaccgccgtgggctctgggccatcaaggccaagaacggcggcgtcttccccaaggccgagaagcccgccgccgccgcggaacccaagttctaccccgccgacgacgtcaagcctcgcgttcccagcacccgcaagcctaatcccaccaagctcaggtcgagcatcacgcctgggacggtgctgatcctcctcgcggggcgcttcatggggaagagagtggtgttcctcaagcagctcaactccgggcctgctcctcgtctctggtccatttcagatcaatggagtaccgatccgtcgtgtcaacagaactatgtcattgctacatcaacaaggttgacttcctctggtgttgatgtcccgaaatttggatgacaaggacttttcccggggaaaaaaaaggcaaaaggggaaaaaaatccgaaggggggaagctttttttgggaaaaagaaaaaagggaggggggtccccaaaattcccctggcccctaaa

SEQ ID NO: 75376 - protein, 143 aa, Zea mays
  misc_feature: Ceres CLONE 1559819
  misc_feature (1)..(49): Pfam Name: Ribosomal_L6e_N Pfam Description: Ribosomal protein L6, N-terminal domain
MAPTSKLSMGIKRASRSHAYHRRGLWAIKAKNGGVFPKAEKPAAAAEPKFYPADDVKPRVPSTRKPNPTKLRSSITPGTVLILLAGRFMGKRVVFLKQLNSGPAPRLWSISDQWSTDPSCQQNYVIATSTRLTSSGVDVPKFG

SEQ ID NO: 75377 - DNA, 841 bp, Zea mays
  misc_feature: Ceres CLONE 1559820
gctggagctccccgcggtggcggccgctctagaactagtggatcccccgggctgcaggaattcgtctcacccctagaaaaaactacaccagggacacgcatcgcagcgcttgcgtcatgagtgtttgtgtgtcaaagctgagactgatggacagagagagaggtaggtgatggctctgccggcgcacgtgtgacgccggttgtccgctggtcctgtctctcttcctcctcctgacccggttgtgagccccaacgcccagccgctcgtgtgggccttcttctactcctgctactcgtccgtcgacgtcatgaagaactactacctccacacacatcttccggccaacttcccgcctctccgccgggattttccccatcttcttcccacactgcagttctgcggctgcaactggcgaccgatcttgtctggtacacactggggttcaatacctgtcctgccccgacgctccgcccacagcgtctgggctcatcctccacatccgcgccgacttcgcgtccgccgggtgtggctacgagtactgcaccgcacttatgtatctcgcgatcccggagtcccaccatctgtagtgctttacgtactacgagatgactctcgcggcggtggacggggtatcgcaggcgcgcatcatcctgtctgcacgctgtccgtcgtcaacttcggcgtcagcgacttcgtgcagactactacatacaccagctgctgttgagagacatacggcgatctcttgtcgaacacctgggggccagctaggcccctcgtcacgacctcttccctcgaggccgacacgtcggcttgacccggtgtccccctgggcttcctg

SEQ ID NO: 75378 - DNA, 765 bp, Zea mays
  misc_feature: Ceres CLONE 1559827
  misc_feature: Encodes the peptide sequence at SEQ ID NO. 75379
ctggagctccccgcggtggcggccgctctagaactagtggatcccccgggctgcaggaattcgtctcacccctagaaaaagtccggatccggacacgcgctcgaggcctcccgcgctgtcccgcctccggcagcgatggcggccgccgcgcgccccgcgtccgcccacctcctcctactggccccgctcccttctcctccccgcctttcgcatctcatccacacccgcagactctacgcactcgcccccgcccgccgccctgcggccgtgcgcgcgcgccgcgaaccctctcctccctccgcgccctccccttctgccccggctgactcgttcgattgcgtcggaactggctcggatgtcgagtgcttcgtcgacgccggcgccgaagacgccgctcccctccttcccgcgctctccgcaggcgcgtccaaggacgatgggaagagcgagggcgacgcggcggtctcggcttcccctgctgggagggagctctgggagtgggcatctctggtgtcgcccttcttcttctggggcacggctatggtggccatggaagggggtcatacccccgcacggggtcctttcttcttcgccgcgaaaccccttgcttccccgggggggcaacggcttatttgccctttccttgccccccccggggaaggaaaaccaccccccccccggtttggggaaggccttggtctttcccaactcctgggggttttggaaaaaaataataaagaccgggcttttttttttttggggggt

SEQ ID NO: 75379 - protein, 75 aa, Zea mays
  misc_feature: Ceres CLONE 1559827
MVAMEGGHTPARGPFFFAAKPLASPGGQRLICPFLAPPGEGKPPPPRFGEGLGLSQLLGVLEKNNKDRAFFFLGG

SEQ ID NO: 75380 - DNA, 745 bp, Zea mays
  misc_feature: Ceres CLONE 1559828
  misc_feature: Encodes the peptide sequence at SEQ ID NO. 75381
tggagctccccgcggtggcggccgctctagaactagtggatcccccgggctgcaggaattcgtctcacccctagaaaaaatcttgcgtatagagttgggcgcggagaatccccacgcaagacaacacagggtagagggagaggacaggagagcagaggacagcagccgcgcgctcgcctacgactaccgactactagcggccggcgcatatgtgcagcgcatgtccatgtctcatgtcgaccagcgtcaacggcggccgcgcgctgccgtctcttcaggccgtccggccggctccatacccgcggctaccgctgccgtcgtcgtcatcctcgtcaggctacaggcactccaagtccgtctccgtagaagacgctcgccccctgttcggcaaatcccaaggttccagacccgccccccgctaaaaaaaggtgcttccccccaggcccaaagccaaagggtttccaggatggatcttcgggcctccggcgggatcgtttcccaaggaaaaaactgttttcgccccctgccctttttggtttccccccgccccttggaaggccattcccgggaggggttcttgtcccgttaacccccagaagggggacccccttttgaaggggggggccttcccccccggggttttaccccccttcccccccccttggggcccccccccgcgccctccggggaagacgcgggggcgctttttttttttaaaaacagagggggttcccccccccccccc

SEQ ID NO: 75381 - protein, 62 aa, Zea mays
  misc_feature: Ceres CLONE 1559828
MSTSVNGGRALPSLQAVRPAPYPRLPLPSSSSSSGYRHSKSVSVEDARPLFGKSQGSRPAPR

SEQ ID NO: 75382 - DNA, 576 bp, Zea mays
  misc_feature: Ceres CLONE 1559830
ggagctccccgcggtggcggccgctctagaactagtggatcccccgggctgcaggaattcgtctcacccctagaaaaatcctccctcacgccggcggcctgtatccctctccccatggctgctggactgggagcgcggcccctccgccaccttcgtggccggaaggttccggcctctcgctgcccctctccgccccgtccgctccggcaagttcgttgtgccaaagcgatgcttcattgtatcaagcaggcttgcatgggtggaagatgagcttatggagatacaaaagtcacaagagcaaagtttcagtaaaaatcaaaagaaaaggcccaccttttgagggcgttggaaaaggttcttccccaacaaactttccctggtacccagggggcacatttccaaaggaaccaatcctttatggtttgggtggcccaaaaaagggattttgccccttgaaaaccttttttccaaaggggggccccccaattttcccccggggaggggcccccccaaagggggaaaatttttctcctgtgggaaaaaatttagaaaaaaaaacttttttttttttttttt

SEQ ID NO: 75383 - DNA, 827 bp, Zea mays
  misc_feature: Ceres CLONE 1559832
  misc_feature: Encodes the peptide sequence at SEQ ID NO. 75384
ctggagctccccgcggtggcggccgctctagaactagtggatcccccgggctgcaggaattcgtctcacccctagaaaaactcgctccatcctatctgataatccacaggatcagcagcaagagcaaccacccccacccccgccaccaccacctccagaaaatcaagattcttcagaagaccaagatgaggaagacgaagaccaagaggatgatgaagaagaaaatgaacaacaagaccaacagatacctgaggagttcatatttgatgctgaaggtggtttagtagatgacaaacttcttttctttgcccagcaagcacagagacgacgtggaaaagctgggcgagcaaagaatgtcatcttctcagaagataggggccgttacataaagcctatgcttcctaagggtccagtaaggaggttagctgttgatgccacgcttagagcagctgcaccataccaaaaactgcgcagagagaaagaacgtgacaaaacaagaaaggtttttgttgaaaagactgacatgagagccaaaagaatggctcgaaaagcaggtgctctagtcatatttgttgtggacgctagtggtagcatggctctgaatcgtatgcagaatgctaaaagtgcgggcgttgagttgctttgcagaagctacaccagcagagatcaggtttcattaatcccttttcctggagatatgctgaggttttgcttccaccattcagaatcttagcaatggcccggaaacgtctgggaagcgcaccaggggggggggggggtcccctttagcccagggccctaagtacagcttttcaaagggggtctga

SEQ ID NO: 75384 - protein, 112 aa, Zea mays
  misc_feature: Ceres CLONE 1559832
  misc_feature: SWISSPROT Homolog: EC 6.6.1.1 Magnesium chelatase
MLPKGPVRRLAVDATLRAAAPYQKLRREKERDKTRKVFVEKTDMRAKRMARKAGALVIFVVDASGSMALNRMQNAKSAGVELLCRSYTSRDQVSLIPFPGDMLRFCFHHSES

SEQ ID NO: 75385 - DNA, 855 bp, Zea mays
  misc_feature: Ceres CLONE 1559833
  misc_feature: Encodes the peptide sequence at SEQ ID NO. 75386
  misc_feature (682)..(682): n is a, c, t, g, unknown, or other
ctggagctcaccgcggtggcggccgctctagaactagtggaacccccgggctgcaggaattcgtctcacccctagaaaaaaacaagcgcataggcttcttgaatttgagcccagatgaagtgattcggagcttgttctacaacaagaacaacgattcccttattaccgtttcagtttatgcatctgacaatttcagcacattgaagtgcagaacaaccccggttgagtatattagaaggaatcagttagatgctgggtttcccctctttgaatcagagtctctgaaatggcctggatttgtggagtttgatgacgtaaatggaaaagtactcacatattcagcgcaggatggtatatataaggtctttgacttgaagaactactacttcctatattcaataccagatgaaaatgtgcaggagataaagatcagtccaggaatcatgctcttgatatacgacagaacaccaagttatgtcccattgaagatattatctattgaagatgggaaacaactgaaattttttaagcacttgttacatcgcaacaagaaaattgatttcattgagcagttcaatgagaagctccttgtcaagcaagaggacgaaaacttccagatacttgatgtgcggagttctgagctaattgaaagtcatgtctccaagtttatgccccctcagcnatcatttttctttatgagaactatctctttctgacattccgaaacagaacagtcgctgtatggaacttccgaaggagatcttgtgactttcatttgagggacaatttactttggcaatcatggatgtagcacccaacaaaatttacctcccctagcgaccagggatctttatt

SEQ ID NO: 75386 - protein, 237 aa, Zea mays
  misc_feature: Ceres CLONE 1559833
  misc_feature (227)..(227): Xaa is any aa, unknown, or other
GAHRGGGRSRTSGTPGLQEFVSPLEKNKRIGFLNLSPDEVIRSLFYNKNNDSLITVSVYASDNFSTLKCRTTPVEYIRRNQLDAGFPLFESESLKWPGFVEFDDVNGKVLTYSAQDGIYKVFDLKNYYFLYSIPDENVQEIKISPGIMLLIYDRTPSYVPLKILSIEDGKQLKFFKHLLHRNKKIDFIEQFNEKLLVKQEDENFQILDVRSSELIESHVSKFMPPQXSFFFMRTISF

SEQ ID NO: 75387 - DNA, 823 bp, Zea mays
  misc_feature: Ceres CLONE 1559835
  misc_feature: Encodes the peptide sequence at SEQ ID NO. 75388
  misc_feature (729)..(729): n is a, c, t, g, unknown, or other
ctggagctccccgcggtggcggccgctctagaactagtggatcccccgggctgcaggaattcgtctcacccctagaaaaagcccgcgccaccacaattcacaagccacccacgccccccgtgcccgtgcgcgcggcctatatatcgccccgtccgtccccgatgggcgcgcccgcgccgaggccgccgccgccgcgcgcaaccgcccgcgccctgctcgccgtctccgtcgccgtcgccgcgtggctcggcgcctccgcgggctcggacagcggcgccggcgtgctgcggcgggcgcggcgcggggagttcgcgtcgtggatggccggcgtgcggcgggccatccacgagcggcccgagctggcgttccaggagcacgagacgagcgcgctggtccggagggagctcgacgcgatgggcgtcgcgtacaggtacccggtcgccgggacgggcgtcgtcgcggccgtcggcaccggggcgccgccgttcgtcgcgctgcgcgccgacatggacgcgctcccgctgcaggaggaagtggagtgggagcacaagagcaaggaggcccggaagatgcacgcctgcggccacgacgcgcacaccgcaatgctgctcggtgccgccaggatcctccatgagcgccgcaacgacctgcagggcacagtagtcctcctttttcagccgggtgaggaggtcggtattggcgcaaaaaagattgtggaggcaggcgccntggagaacctggagcccatattcggggtccacgtcaccgtgctgctccccaccggcgtggtgggctccaggaccggcccgttgctgcccggtgc

SEQ ID NO: 75388 - protein, 220 aa, Zea mays
  misc_feature: Ceres CLONE 1559835
  misc_feature (111)..(214): Pfam Name: Peptidase_M20 Pfam Description: Peptidase family M20/M25/M40
  misc_feature: SWISSPROT Homolog: EC 3.5.1.14 Aminoacylase
  misc_feature (190)..(190): Xaa is any aa, unknown, or other
MGAPAPRPPPPRATARALLAVSVAVAAWLGASAGSDSGAGVLRRARRGEFASWMAGVRRAIHERPELAFQEHETSALVRRELDAMGVAYRYPVAGTGVVAAVGTGAPPFVALRADMDALPLQEEVEWEHKSKEARKMHACGHDAHTAMLLGAARILHERRNDLQGTVVLLFQPGEEVGIGAKKIVEAGAXENLEPIFGVHVTVLLPTGVVGSRTGPLLPG

SEQ ID NO: 75389 - DNA, 1454 bp, Zea mays
  misc_feature: Ceres CLONE 1559836
  misc_feature: Encodes the peptide sequence at SEQ ID NO. 75390
aattgtaaagttagtgtgataggaatcacattcaatggtacttctgcctacggtgaatctggaaagttccattacaacactagaagttaggctattccatcttctacctctgttttttacatgttgtatttgtattagttttggcgtaggtcaaacatttatatctttggccatcattttttttaaaatgtataggttaacaacataagatttatgtttttagattcactatgaaaaatactttcataatatatggttcacatgttgcaaaactacatagtttttttcctgaaactgatggtcaaagtaatgtttgacttaggacaaacttaatacggcttgtaaaataaatggatggagtatgttaggctaccttatcgaatttaaacatggatcaagggtacatattaggaatagctggcttggtcaagaaaccaaatatataggaaatgtttctgtccccaaaacatttacttacatttagttctgttaagggcacgttgatacggctgggacgtttaggggaatggataggggagattagcagagcttgggactgagggatggagcagattggatagggagatcggcgagaacagctactatcacccacgaccgatgaagccacgatgaccaaagccctctccgaaaggaaagcaacttcttcgatgaaatccctgcctttgatggaatctttgaagaaagctatggctgatgcaaaaaagcccaggtccatacaagacttgctgaaggagcaggtggctaaactcagagaacaagcatccggtggaggcggagggaatgggaatcgccgtggaggcagtggtggttctggtggcccagatgatgagtccttcaaggaagcattggatgaagtagtccaagttatcttagccactgttgctttcatacttgtgtacatccacataatcagaggggaggagctttaccgtcttgccagggactacaccagatatctcgtcactggtaagagaactgcccgactgaagcgttccatgcaaaagtggcacaacttctccgaaagcttcatgcagaaggaaggctcagaagaggaccaatatgagaaacctacatggtggcaacagcctcagaaacttgtgcatcttatggaggagctttgcaggggaaattggcgtccccatgcccaggagtcgtagttgatggtgtaccatcacgcccctcttttttttttgacccattgcagaatgcaaaataggaacgtgggctggtgcagtggagtaaggtcgcctggaccagtgttttttgttgttgttctttatcggctatttgtctctggtttcttaaaagtatgtagagagtgagtgaattcgtggcatttttgcagttgatgggaccgtgttttgagactgtaacctgccaatcaaacgttggagatacctttgcatctggtcgaccaaaaaaaaaaaaaaaaa

SEQ ID NO: 75390 - protein, 182 aa, Zea mays
  misc_feature: Ceres CLONE 1559836
MTKALSERKATSSMKSLPLMESLKKAMADAKKPRSIQDLLKEQVAKLREQASGGGGGNGNRRGGSGGSGGPDDESFKEALDEVVQVILATVAFILVYIHIIRGEELYRLARDYTRYLVTGKRTARLKRSMQKWHNFSESFMQKEGSEEDQYEKPTWWQQPQKLVHLMEELCRGNWRPHAQES

SEQ ID NO: 75391 - DNA, 839 bp, Zea mays
  misc_feature: Ceres CLONE 1559837
  misc_feature: Encodes the peptide sequence at SEQ ID NO. 75392
  misc_feature (754)..(754): n is a, c, t, g, unknown, or other
  misc_feature (798)..(798): n is a, c, t, g, unknown, or other
ctggagctccccgcggtggcggccgctctagaactagtggatcccccgggctgcaggaattcgtctcacccctagaaaaagtctcgccagaccattccaatccggcaactcctgctctgcctgagcctgagcgtaggcggctaccagagagaagggtaggggcggcgccggcggcgggagcaatagaagagcggtaaatccaagagagatcagagcctcggagggaaacagaagcgcacagagcatggagagcccgatctcgaggactaacctgaattgcatcagactggcggacccgaacgtccagaaatcagtggcgctcctcaagcaggcatgcctggattcaggcttcttctatgttgtggatcatgggataagccaagagttcatggatgaagtttttgcccagagcaagaagttctttgaccttcctcatagtgagaaaatgaagcttctccgagacgagaagaatagagggtacacacccatgctagatgaaattcttgatcctgaaaatcaagttaatggtgactacaaggaaggatatatattgggagttgaggtacctgcagatgatccagaagcaaacaggccattttatggtccaaatcagtggccttctaaagaagtattaccaaaatggagagaagtgatggagcaatatcacagggagggcgttgagagtagcaaaatcagtcgcaaggatcatcgctctcgctctagatctagatgtggacttcttcgacagacctgnaatgcttggcgagtcaatagccaccctaaagctcctgcctaccnaaagtaaggtgtcaattccttgcaaaggtggtttacggagc

SEQ ID NO: 75392 - protein, 186 aa, Zea mays
  misc_feature: Ceres CLONE 1559837
  misc_feature: SWISSPROT Homolog: EC 1.14.11.19 Leucocyanidin oxygenase
  misc_feature (170)..(170): Xaa is any aa, unknown, or other
  misc_feature (185)..(185): Xaa is any aa, unknown, or other
MESPISRTNLNCIRLADPNVQKSVALLKQACLDSGFFYVVDHGISQEFMDEVFAQSKKFFDLPHSEKMKLLRDEKNRGYTPMLDEILDPENQVNGDYKEGYILGVEVPADDPEANRPFYGPNQWPSKEVLPKWREVMEQYHREGVESSKISRKDHRSRSRSRCGLLRQTXNAWRVNSHPKAPAYXK

SEQ ID NO: 75393 - DNA, 865 bp, Zea mays
  misc_feature: Ceres CLONE 1559840
  misc_feature: Encodes the peptide sequence at SEQ ID NO. 75394
  misc_feature (729)..(729): n is a, c, t, g, unknown, or other
ctggagctccccgcggtggcggccgctctagaactagtggatcccccgggctgcaggaattcgtctcacccctagaaaaaacagccatcacacgcatactgcatacacaacgcagagcatcagaagcagctgcgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggcgagttccccggcgactacgggtgggacaccgcggggctgtcggcggacccggagaccttcgccaagaaccgcgagctggaggtgatccactgccgctgggccatgctcggcgcgctcgggtgcgtgttcccggagctgctcgcccgcaacggcgtcaagttcggcgaggcggtgtggttcaaggcgggctcccagatcttcagcgagggcgggctcgactacctcggcaacccgagcctggtccacgcgcagagcatcctggccatctgggcgtgccaggtggtgctcatgggcgccgtcgagggggtacccgcgtcgccggcggcccgctcgggggaggtggtcgaccccgctgtaccctggcggcagcttcnaacccgcttcggctccgcgaacaaaccgggaggcggttcgccgaagctcaagggtgaaggagatacagaaacggccgcctcccccatgttcctccatggttcgggcttcttcgtggcaaggctatcggtacccggc

SEQ ID NO: 75394 - protein, 240 aa, Zea mays
  misc_feature: Ceres CLONE 1559840
  misc_feature (63)..(229): Pfam Name: Chloroa_b-bind Pfam Description: Chlorophyll A-B binding protein
  misc_feature (195)..(195): Xaa is any aa, unknown, or other
MAAATMAITSRALVGKPAAGTRDVFGEGRITMRKTAAKPKPAASGSPWYGADRVLYLGPLSGSPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGVPASPAARSGEVVDPAVPWRQLXTRFGSANKPGGGSPKLKGEGDTETAASPMFLHGSGFFVARLSVPG

SEQ ID NO: 75395 - DNA, 813 bp, Zea mays
  misc_feature: Ceres CLONE 1559841
  misc_feature: Translation starting site: 210
  misc_feature: SWISSPROT Homolog: EC 1.11.1.7 Peroxidase
ctggagctcaccgcggtggcggccgctctagaactagtggaatcccccgggctgcaggaattcgtctcacccctagaaaaacgactgcacatgccctgacgcctacaacatcgtgaagcaggtcctgatcgaggcgcacaagtccgacgtgcgcatctacgccagcctcacccgcctccacttccacgactgcttcgtccagggctgcgatggctcggtgctcctggacgccgttccgggggtggccaactccactgagaagctggcgccggccaacaacaactcggcgcgagggttcccggtggtggacaaagtgaaggcggcgctggaggacgcctgccccggcgtcgtctcctgcgccgacatcctcgccctcgccgcagagatctcggtcgaactgtccggaggaccaaagtgggcagtgcttcttgggaggctagacagcaagaaggccgacttcaagagcgcggagaacctgccgtcgccgttcgacaacctgacggtgctggagcagaagttcgcggccgtgggcctccacaccgtggacctggtggccctctcgggagctcacacgttcgggcgggtcccagtgcagttcgtcacggggcggctgtacaacttcagcggcacgaaaccggccggacccacgctcaactccgggttaccgggcgttcctgggcccaaaagtgccccccaaaaggggagcccccttggcccctaaaagaactgggacccccccgaacgcccaaaccggtttgaaaacccctttttttcccccaccttgtgaggggaaaccgggggtttccctggggc

SEQ ID NO: 75396 - DNA, 805 bp, Zea mays
  misc_feature: Ceres CLONE 1559845
  misc_feature: Encodes the peptide sequence at SEQ ID NO. 75397
ctggagctccccgcggtggcggccgctctagaatagtggatcccccgggctgcaggaattcgtctcacccctagaaaaagcgctccccacttcaccgagcatcccgaaaaaaagctcggccactgcgccatctcgcccaccaagcaccagccaccagcagcggcgccatggccaccgcgccctacgcctcctccctcttcctggcttcctcccccatctcaactgcgccacgagccagcgccgggtccttccctccctccgcgcagccgttctccatgcgcctccggcctaggccgtcaccagccgtcgcggccgccgtccaggcggagcaccagcccgcggtggccgcgacgccgaagccgcccgcgctaccgttccgcgtgggccacggcttcgacctccaccgcctggagcccaacctcccgctcatcatcggcggcatcgacatcccccacgaccgcggctgcgaggctcactctgacggagacgtgctgctgcactgcgtggtggacgcgatttctcgcgcgctggggctgccggacatcgggcagattttctcggatcccgaccccgttggaagggcgctgaatcttcggtggtcatgaagggagctgtggaattgatgcatgaagcaggctacaagctgggcaaccttgaagctacgctgattcttgcaaaaacaaaaataaccccgtttcaggagaacattcgattgaatcggtgcaacctactttggggcagatcccttctgtgggccaatttcaagggccaaaaccccccaaaaaagttgaaagtctctggggga

SEQ ID NO: 75397 - protein, 109 aa, Zea mays
  misc_feature: Ceres CLONE 1559845
  misc_feature (34)..(110): Pfam Name: YgbB Pfam Description: YgbB family
  misc_feature: SWISSPROT Homolog: EC 4.6.1.12 2-C-methyl-D-erythritol 2,4-cyclodiphosphate synthase
MRLRPRPSPAVAAAVQAEHQPAVAATPKPPALPFRVGHGFDLHRLEPNLPLIIGGIDIPHDRGCEAHSDGDVLLHCVVDAISRALGLPDIGQIFSDPDPVGRALNLRWS

SEQ ID NO: 75398 - DNA, 870 bp, Zea mays
  misc_feature: Ceres CLONE 1559848
  misc_feature: Encodes the peptide sequence at SEQ ID NO. 75399
  misc_feature (802)..(802): n is a, c, t, g, unknown, or other
ctggagctcaccgcggtggcggccgctctagaactagtggatcccccgggctgcaggaattcgtctcacccctagaaaaaaggcaggctccatcagtacagatccaccgccaccaccaccaccaagcactccagtcccgcagcagcatggccggcagcgcgtcccgcctcgccatcctcttggtgctcctggcggcgtcaccgctgcttggcgcgacgcagaaggccgcgccagggccggcgtcgtcgtcgggctcgggcgcgggcgcggcggacgcggcgccgccgacggacgtgaacaaggcgctgaaggacgagcagttcagcgagttccggcagctgctgcacgacacgcgcgtggacacgcagatcaacgcgcagctgacggacagctacaacgggctgaccatcatggcgcccaccaacgccgccttcgacaagatgaaggcgggcgtgctgaacgggctgtcgccgcaggagcagatccagatggtgctctactgcgtgctgccccggttctacagcctgtccatgctcggcaccctcagcggcaaggtcaacacgcaggggtccggccacgacgggccctacaggtacgacatcaagcggtcggggaacaacgtcaacgtgtccacgggggtgaactggatgctgctgggcagccccgtcagcaaagacttcccgctcgccatctaccccgtcgacaaggtgccgctcccctacgaagctgtcgggcccaagccgcccacgccgggcgccgcgcgggcaccggcgcccggggcgggccaggccaagaccagaanaagaaagaatccgccgccatcgccgagcccgccacgggcgacgaacgacgacaccggctccactccga

SEQ ID NO: 75399 - protein, 241 aa, Zea mays
  misc_feature: Ceres CLONE 1559848
  misc_feature (58)..(191): Pfam Name: Fasciclin Pfam Description: Fasciclin domain
  misc_feature (219)..(219): Xaa is any aa, unknown, or other
MAGSASRLAILLVLLAASPLLGATQKAAPGPASSSGSGAGAADAAPPTDVNKALKDEQFSEFRQLLHDTRVDTQINAQLTDSYNGLTIMAPTNAAFDKMKAGVLNGLSPQEQIQMVLYCVLPRFYSLSMLGTLSGKVNTQGSGHDGPYRYDIKRSGNNVNVSTGVNWMLLGSPVSKDFPLAIYPVDKVPLPYEAVGPKPPTPGAARAPAPGAGQAKTRXRKNPPPSPSPPRATNDDTGSTP

SEQ ID NO: 75400 - DNA, 721 bp, Zea mays
  misc_feature: Ceres CLONE 1559849
  misc_feature: Encodes the peptide sequence at SEQ ID NO. 75401
  misc_feature (49)..(49): n is a, c, t, g, unknown, or other
ctggagctccccgcggtggcggccgctctagaactagtgggatcccccngggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctggggcatgctcggcgcgctcggctgcgtcttccccgagctgctctcccgcacggcgtccagttcggcgaagcccgtctggttcaagggcgggctcccagaatcttcagcgaagggcggcctgggattaccttggggaaacccccagcctggatcccccgccccaaaaaaaatcccctgccaatttggggggccttgcccagggtccggggccctcaagggggggcccccctcccaaggggggcccaccccccctttttttccccgggggggggcgcccccccctcg

SEQ ID NO: 75401 - protein, 195 aa, Zea mays
  misc_feature: Ceres CLONE 1559849
  misc_feature (61)..(172): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWGMLGALGCVFPELLSRTASSSAKPVWFKGGLPESSAKGGLGLPWGNPQPGSPAPKKIPCQFGGPCPGSGALKGGPPSQGGPTPPFFPRGGAPPP

SEQ ID NO: 75402 - DNA, 854 bp, Zea mays
  misc_feature: Ceres CLONE 1559850
  misc_feature: Encodes the peptide sequence at SEQ ID NO. 75403
  misc_feature (694)..(694): n is a, c, t, g, unknown, or other
  misc_feature (720)..(720): n is a, c, t, g, unknown, or other
tggagctccccgcggtggcggccgctctagaactagtggatcccccgggctgcaggaattcgtctcacccctagaaaaagtccgccctcctgctcactccactcgcctgccagccgcacaccaatcacctctgcggccggcggcgtctgcaacgccagtctctgatccgaccccgatcggcacacacgttctccatggcggagcagctcgcatcccaagatgctcccaatccccctgctccggcacagagggtactggtgacgaacacgcatggggagaaactcgtcggcctgctgcaccacatggggtctgacaaggttgtagttctctgccatggctttacgggctccaaggactatagcctcatcactgaccttgcggccgcactaacaaagcaagggattagtgtgtttcgctttgattttagtggaaatggagaaagtgaaggtgaattccagtacggcaactacaagaaggaggctgctgacttgcactctgttgtcttgtatcttcgccaggagaagtacgacgtagcagcaattgttggtcacagcaaaggtggagatgtggtcgttctatatgcctctatctacaaggatgtccccatggtggttaacctctctggccggtttcatttggagaaagcatttgagagcgccctaggcaagagtttatggatagaataaacaagaanggctacatcgatgtcaagacaaatcnaggaaatgttttgtacagagtacccaaggagagcttgatggaacggctgaacccataaatgcacgcaacgagcctttcaatcagaaaaaagggcaggttctttacatttcagggtccactgacagaatcatacc

SEQ ID NO: 75403 - protein, 163 aa, Zea mays
  misc_feature: Ceres CLONE 1559850
  misc_feature: SWISSPROT Homolog: EC 3.3.2.10 Soluble epoxide hydrolase
MAEQLASQDAPNPPAPAQRVLVTNTHGEKLVGLLHHMGSDKVVVLCHGFTGSKDYSLITDLAAALTKQGISVFRFDFSGNGESEGEFQYGNYKKEAADLHSVVLYLRQEKYDVAAIVGHSKGGDVVVLYASIYKDVPMVVNLSGRFHLEKAFESALGKSLWIE

SEQ ID NO: 75404 - DNA, 915 bp, Zea mays
  misc_feature: Ceres CLONE 1559851
  misc_feature: Encodes the peptide sequence at SEQ ID NO. 75405
  misc_feature (517)..(517): n is a, c, t, g, unknown, or other
tggagctccccgcggtggcggccgctctagaactagtggatcccccgggctgcaggaattcgtctcacccctagaaaaactctgagtctcgcgcgatcaggctgcaggccatctgggctccggcttccggcatccaccaggcgtcaatacggtgcagcgagcagcgagcagcgagtcaccgagcagccgagcgaccgccgagcacagggcaccaccgagcagccgagccaccgccgagcaccgagtcttctctgttcttctgcggcgaacaaggtcaatccagggccgtggtgcgggtgctggtttttttttcaacaagtttatgttggtcgctcgaccgctgcagcaatgaagatacagaaagcaaatgcaggtgtccttacaaacttcgaagtccttgacttcttgcggtcaagaggtgccaaaattgaccccatgggatgtttgggggctgttgctgtatcagagtgtaaggtgtatgagtatatcttaaaaaaccccctgcttgcaccagacnagggaatccatttatgaatttgtaagagaaagtgagggtttcaggcttgcagaggctggataagttaaatgtcattcactggaagactatccctagctgccgatgtcttatgcaatgaataaaaaaattggggaaaacaatttttcccgggagaaccaaggaaaaccttttgtattaaaaataaccaattcccggaatttcttgaaatggggaaaaaggggtttttcccacccccccccaaaacccagggtggaaacccccaaagccaaggccaaagccaaggcaaggcccccgaggggttgaaggcaaaccccaatataaccccccccaaaaagaggggggggggaaaaaaaacaattttgggggggccaatttttttaaaaacccgttgtggtggt

SEQ ID NO: 75405 - protein, 61 aa, Zea mays
  misc_feature: Ceres CLONE 1559851
  misc_feature (57)..(57): Xaa is any aa, unknown, or other
MKIQKANAGVLTNFEVLDFLRSRGAKIDPMGCLGAVAVSECKVYEYILKNPLLAPDXGIHL

SEQ ID NO: 75406 - DNA, 871 bp, Zea mays
  misc_feature: Ceres CLONE 1559854
  misc_feature: Encodes the peptide sequence at SEQ ID NO. 75407
  misc_feature (735)..(735): n is a, c, t, g, unknown, or other
  misc_feature (736)..(736): n is a, c, t, g, unknown, or other
  misc_feature (742)..(742): n is a, c, t, g, unknown, or other
  misc_feature (752)..(752): n is a, c, t, g, unknown, or other
  misc_feature (849)..(849): n is a, c, t, g, unknown, or other
ctggagctccccgcggtggcggccgctctagaactagtggatcccccgggctgcaggaattcgtctcacccctagaaaatagctagctcagcatccgacgacgggacttgcacgatggatgctgctctgctcgtcgtctccctcgtcctctgcctgctggcggctgcccctgcggcgtccgcggcgcgggccttcttcgtcttcggcgactccctcgtcgacaacggcaacaacaactacctgctgaccacggcgcgcgccgacgcgcccccctacggcatcgacttccccacgcaccaagccacgggccgcttctccaacgggcttaacatccccgacatcatcagcgagcacctcggggccgaacctgcgctgccgtacctgagccccgagctccgaggggagaagctgctcgtcggcgccaacttcgcgtcggccggcgtcgggatcctcaacgacacaggaatacagtttgtgaacatcatcaggatcggcgaccagctgcagtacttccgggagtaccagcggaagctgcgagccctcgtcggcgagccgcaggcgacgcagctcgtgaaccaggccctcgtgctcatcacgctcggcggcaacgacttcgtgaacaactactacctggtgcccatgtccgtgcggtcgcgccagtacgcactcccggactacgtccgcttcatcgtctccgagtacaggaagatcctctcgaggctgtacaagctggcnncgcggncccgtgatcntgacggggaacgggcccccctggggtgcgtcccggccggagctggcgctgcaagcccaaaacggcaagtgcgcggcggaccttaacccgcgccgtgnaacctcttcaacccgcagatgg

SEQ ID NO: 75407 - protein, 240 aa, Zea mays
  misc_feature: Ceres CLONE 1559854
  misc_feature (27)..(236): Pfam Name: Lipase_GDSL Pfam Description: GDSL-like Lipase/Acylhydrolase
  misc_feature: SWISSPROT Homolog: EC 3.2.1.51 Alpha-L-fucosidase
  misc_feature (208)..(208): Xaa is any aa, unknown, or other
  misc_feature (210)..(210): Xaa is any aa, unknown, or other
  misc_feature (213)..(213): Xaa is any aa, unknown, or other
MDAALLVVSLVLCLLAAAPAASAARAFFVFGDSLVDNGNNNYLLTTARADAPPYGIDFPTHQATGRFSNGLNIPDIISEHLGAEPALPYLSPELRGEKLLVGANFASAGVGILNDTGIQFVNIIRIGDQLQYFREYQRKLRALVGEPQATQLVNQALVLITLGGNDFVNNYYLVPMSVRSRQYALPDYVRFIVSEYRKILSRLYKLAXRXRDXDGERAPLGCVPAGAGAASPKRQVRGGP

SEQ ID NO: 75408 - DNA, 851 bp, Zea mays
  misc_feature: Ceres CLONE 1559855
  misc_feature: Translation starting site: 191
  misc_feature (512)..(512): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
ggagctccccgcggtggcggccgctctagaactagtggatcccccgggctgcaggaattcgtctcacccctagaaaaaaatctctctcttctcctcgcctcgccttggtgttcacgccgtcgctagcgcctgccgcggcgaagcttctgtcctccccggcgccgggctcgggtcgtcgtcggccaggaagatggctggcggcttcagggtactgcatctggtcaggccttttctggctttcttgccagaggtgcagagcgcggataggaagataccgttcatagaaaaagttatatacactgttatttccctcttcattttcctggtctgcagccagctcccactctatggcattcattcaacaactggagctgatcctttctactggatgcgtgttatcctcgcatcaaaccgtggcactgtgatggagttgggtattactccaattgtgacatctgggatggtaatgcaacttcttgttggatcgaagatcattgaagttgacaacagtngtgagagaggatcgtgctctgctgaatggtgcacaaaagttgcttggtatcctgattgctattggggaagctgtggcatatgtcctgtctggaatgtatggcagtgtaagccaactgacagatgctatctctactcacttctgcgcctgacgcgtattcaagttgtgatcgtctttgtcatgcaccggtccatacgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 75409 - DNA, 848 bp, Zea mays
  misc_feature: Ceres CLONE 1559856
  misc_feature: Translation starting site: 189
  misc_feature (493)..(493): n is a, c, t, g, unknown, or other
  misc_feature (690)..(690): n is a, c, t, g, unknown, or other
  misc_feature (691)..(691): n is a, c, t, g, unknown, or other
  misc_feature (744)..(744): n is a, c, t, g, unknown, or other
  misc_feature (777)..(777): n is a, c, t, g, unknown, or other
  misc_feature (815)..(815): n is a, c, t, g, unknown, or other
aaaagctggaagtcaccgcggtggcggccgccccaaaaaaagtggaacccccgggctgcaggaaatcgtctcacccctagaaaaatcaaactgcggatagagcagcagaggcagcgaaacgatcgcgagcgcacgcacgtaagcacgttgtcggaagctcaagttagaagaagcaccatgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccantgctgggcgcggtgggcgccatcgccccggagatcttcggcaagatgggcatcatcccgccggagaccgcgctgccgtggttcaagacgggcgtcatcccgccccgcggcacctacaactactgggccgactcctacacgctcttcgtcttcaacatgcgctcatgggcttcgccgagcaccgccgccctccagacnntgtacaccccggctccattggcaagcagtacttcctcggcctcgagaagtccntcgccgctccgggcgacccgtcctacccccgcnggccccttcttcaacccgctcgcttcggcaagaccagnaagaaaatgatggactcagccctcagagtttca

SEQ ID NO: 75410 - DNA, 705 bp, Zea mays
  misc_feature: Ceres CLONE 1559858
  misc_feature (312)..(312): n is a, c, t, g, unknown, or other
  misc_feature (332)..(332): n is a, c, t, g, unknown, or other
ctggagctccccgcggtggcggccgctctagaatagtggatcccccgggctgcaggaattcgtctcacccctagaaaaaaaaaagcatttcggcaaacggcaggctgcacctgcaacacaagaaaagaaaaggcgcgccttttctcctctcgttccaccgacgggcgacggcgacgcaggcctcacccgcaccaaccttcgttctccttccccttctcctcccgcgcgtcaatttgccatcccaggaaggcagaaccccacacctctgatctgctctgcccatcatccagcgcatcccccggccctgacttnaacttgctgctcaccctcgnccaagtgggggaatcttccaccttctttcgacgagtacaagcccttcgcgggggcgtctttttgccgagaacaagcccttcctaattggcggttgcccaccgggcacctttttggggacccgagggttcttctgggatggggaaccttccccgggggtttccccctaaaaaaaagggggcgcccgagaatttttccaccccaaaaagggggaaaaaattttttttttacctcccaacccccaaatttttttcccccaaaaatgtggtttgtttatttctttttcggaggaagaggcgcccgcgcccccccccccaaaaggttttgggtgggaaaaaaaaaaaaaaaaaaaaaaatttttgtgtccaaaacaac

SEQ ID NO: 75411 - DNA, 887 bp, Zea mays
  misc_feature: Ceres CLONE 1559859
  misc_feature: Translation starting site: 165
  misc_feature: SWISSPROT Homolog: EC 3.4.22.16 Cathepsin H
  misc_feature: SWISSPROT Homolog: EC 3.4.22.15 Cathepsin L
  misc_feature (752)..(752): n is a, c, t, g, unknown, or other
  misc_feature (772)..(772): n is a, c, t, g, unknown, or other
  misc_feature (773)..(773): n is a, c, t, g, unknown, or other
  misc_feature (800)..(800): n is a, c, t, g, unknown, or other
  misc_feature (810)..(810): n is a, c, t, g, unknown, or other
  misc_feature (812)..(812): n is a, c, t, g, unknown, or other
  misc_feature (825)..(825): n is a, c, t, g, unknown, or other
  misc_feature (826)..(826): n is a, c, t, g, unknown, or other
  misc_feature (850)..(850): n is a, c, t, g, unknown, or other
  misc_feature (862)..(862): n is a, c, t, g, unknown, or other
  misc_feature (887)..(887): n is a, c, t, g, unknown, or other
ctggagctccccgcggtggcggccgctctagaactagtggatcccccgggctgcaggaattcgtctcacccctagaaaaagctcgtgccagcgcccagcaggccattctgctcgccttactccctcacagaacccagtaaaatattgccagtcccgccgtcgagatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttcgccgtcaggtacggcaagagctacgagagcgcggcggaggtccataagcggttcaggatcttctccgagagcctccagctggtccgctccaccaaccgcaaaggcctctcctaccgcctcggcatcaaccgcttcgcggacatgagctgggaggagttccgtgcgacccggctcggcgcagcccagaactgctccgccacgcttaccggcaaccaccggatgcgcgccgccgccgttgcgctgccggagacgaaagactggagggaggatggggattgtgagcccagtgaaaaaccagggccactgtggatcatgctggaccttcagcactactggtgcacttgaggctgcatatacccaggcaactggcaagcccatctctctctctgagcaacagcttgnttgactgtggttttgcattnncacatttcggatgcaacgggaggcttnccatcccagncnttgaatacatcannatacatggtggccttgacactgangaaatctacccnttaccagggtgtcatggaatctgcn

SEQ ID NO: 75412 - DNA, 857 bp, Zea mays
  misc_feature: Ceres CLONE 1559861
  misc_feature: Encodes the peptide sequence at SEQ ID NO. 75413
  misc_feature (827)..(827): n is a, c, t, g, unknown, or other
gctggagctcaccgcggtggcggccgctctagaactagtggatcccccgggctgcaggaattcgtctcacccctagaaaaaactctccctccatccattgaccaccccagccccgccgccgccctcgtcttgtctcccctgagcctgactggaaccttcccgagagaggatacaaaggcacccggatccaggaaaccaatccattccattccacacaaggctaggcacaagcgaaccagacccatggcatccgacggcagcggcgtggtgacggagtacggcagcaacggcccggagctgcaggagccgtccaagcagcccaagtcggcgactttctccgtcgaggtggggctggcgcagatgctcccgggcggggtcatcatggacgtggtgaccccggagcaggcgcgcctcgcggaggaggccggcgcgtgcgccgagatggcgctggagcgggtccccgccgacatccgcgcgcagggaggcgtggcgcgcatgtcggacccgggcctcatccgcgacatcaagcgcgccgtcaccatcccggtcatggacaaagcccgcatcgggcaattcgtggaggcccagatcctggaggccctgagcgtctactacctggacgagagcgaggtgctgacccccgcctacgacgcgcaccacatcaacaagcacaacttccgcgtccccaatctctgctgctgccgcgacctctgcgaggcgctgctcagggtgcgcgagggctcctccatgatcctcgaccaagaggagggcagcacgtgcaacatcatccaggccgtgcgccacgtgcgctcccgtcatgagcgacntgcgcgcgctccgtagaatgttacgaggac

SEQ ID NO: 75413 - protein, 199 aa, Zea mays
  misc_feature: Ceres CLONE 1559861
  misc_feature (29)..(200): Pfam Name: SOR_SNZ Pfam Description: SOR/SNZ family
  misc_feature (195)..(195): Xaa is any aa, unknown, or other
MASDGSGVVTEYGSNGPELQEPSKQPKSATFSVEVGLAQMLPGGVIMDVVTPEQARLAEEAGACAEMALERVPADIRAQGGVARMSDPGLIRDIKRAVTIPVMDKARIGQFVEAQILEALSVYYLDESEVLTPAYDAHHINKHNFRVPNLCCCRDLCEALLRVREGSSMILDQEEGSTCNIIQAVRHVRSRHERXARAP

SEQ ID NO: 75414 - DNA, 854 bp, Zea mays
  misc_feature: Ceres CLONE 1559862
  misc_feature: Encodes the peptide sequence at SEQ ID NO. 75415
  misc_feature (648)..(648): n is a, c, t, g, unknown, or other
  misc_feature (687)..(687): n is a, c, t, g, unknown, or other
  misc_feature (730)..(730): n is a, c, t, g, unknown, or other
  misc_feature (757)..(757): n is a, c, t, g, unknown, or other
  misc_feature (804)..(804): n is a, c, t, g, unknown, or other
gctggagctcaccgcggtggcggccgctctagaactagtggatcccccgggctgcaggaattcgtctcacccctagaaaaaagcccttgttcatcaacaaaccacatggccgcgctcggtcctgcttctgttacctccacgggcttggcgctgcacacccctgcgattcttcatcgtcggcgtcgccacgggaatgcagtggcctgtgcgtcgtcgtcgccgtcgtcgtctcaacaccagcgaagccttaatggcttggcgatgagttcttcaggcacgaacaatgccttgcccatcaaaggaactaccactacacgggttcctgcagtcggtcgttcggcccctgcgaatccgtcgccgtcaggagggaacaacctcccagtgcccaagattcctctgtgggtcaagtgggtggctggcgccgtcatatttgcagtgcccatgtacaggaggttcagagctttagaagacaagatagagaagacggcggaggtggcgatcgaggtgatcgacaaggtggcggaggcgacggagaaggtcgccggcgaggtcgccgacgagttccccggcaacgagagcatcaaggaagcagcctccaggatcaagaaggtcatgcacgtggtcgaggaagacgccgactaggctgangccctgatcgagaaggtcgacgagataaagaaagaagtngatttccattgtcgatcctataaatgggcaaggttgcccaagnataaatcgcggaagatgacctaaaaangatgacagccgtcgggtgaattgaaaagagcaaacattgctcggacngaaaaaggaaccaacatgcccgccgtctcgttccgttttaatctcgtggc

SEQ ID NO: 75415 - protein, 178 aa, Zea mays
  misc_feature: Ceres CLONE 1559862
MAALGPASVTSTGLALHTPAILHRRRRHGNAVACASSSPSSSQHQRSLNGLAMSSSGTNNALPIKGTTTTRVPAVGRSAPANPSPSGGNNLPVPKIPLWVKWVAGAVIFAVPMYRRFRALEDKIEKTAEVAIEVIDKVAEATEKVAGEVADEFPGNESIKEAASRIKKVMHVVEEDAD

SEQ ID NO: 75416 - DNA, 896 bp, Zea mays
  misc_feature: Ceres CLONE 1559865
  misc_feature: Encodes the peptide sequence at SEQ ID NO. 75417
  misc_feature (672)..(672): n is a, c, t, g, unknown, or other
  misc_feature (729)..(729): n is a, c, t, g, unknown, or other
  misc_feature (738)..(738): n is a, c, t, g, unknown, or other
  misc_feature (739)..(739): n is a, c, t, g, unknown, or other
  misc_feature (753)..(753): n is a, c, t, g, unknown, or other
  misc_feature (756)..(756): n is a, c, t, g, unknown, or other
  misc_feature (792)..(792): n is a, c, t, g, unknown, or other
  misc_feature (828)..(828): n is a, c, t, g, unknown, or other
ctggagctcaccgcggtggcggccgctctagaactagtggatcccccgggctgcaggaattcgtctcacccctagaaaaagataaccaagaacaaaccattgttggacgcgttcccctcctgcacgcaacctcatctcgtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggtggtcgagcatcgcatgttctgcttctggatccagatctggagaaatagcgaagtcgtcgtcgttcggttcggagcggatctgaggcgacgatagatggaggcggcgggatctctcggtctgcagtcctgctccacctcgatggatgatgtctctgcgctgataattattggatcaatttcgataattattagtagatctatgagatatgccgcctggaagaggcgaggtaagctgcagcatgtaaaaaagagaaaaaagatgtgacatcctagaggaggaggcctttgccatgatgggtgcgctcgcatggcaggccaggcaataataaanagatgattattgcgtgcctgggggaggagatcgcacggggggtttgatgtttttggncccccgggnntctctccctcatcntgntcccgtgttcctgtatgcgtttgctcccgctcctgnttggtccgctacgcaacgccgggatttttgcatcgnagcacgggagattctacacaaaaaacatgggagctacgacggcgattccccaggtacaaaatcgtatt

SEQ ID NO: 75417 - protein, 56 aa, Zea mays; identical to SEQ ID NO: 73010
  misc_feature: Ceres CLONE 1559865

SEQ ID NO: 75418 - DNA, 758 bp, Zea mays
  misc_feature: Ceres CLONE 1559868
  misc_feature: Translation starting site: 245
ctggagctcaccgcggtggcggccgctccagaacaagtggaaccctcgggctgcaggaaatcgtctcacccctagaaaaaacagcatctcaagccaccatcgaccttcaagtctcgctacgtagcagtgcaataaaaaaagcagccgcaatggcgagcagcaccatggccctctcctccacggccttcccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaacccgggagctggaggtgatccactcccgctgggccatgctgggcgcgctcggctgcgtcttcccgagctgctcgccgcacggcgtcagtcggcgagccgtgtgttcaagccggctccagatctcagcgagggcggctgactacctcggaacccgagctcatcacgcgcaagcatcttgctatctgggcttgcccagtctgcttcatgggccccgtccagggctaaccgaatcgccgggggccccctttggggaaagttttttaaaccctttttaccccgggggggaattttttaaaccccccttggggccttccccaaaaaaaacc

SEQ ID NO: 75419 - DNA, 837 bp, Zea mays
  misc_feature: Ceres CLONE 1559869
  misc_feature: Encodes the peptide sequence at SEQ ID NO. 75420
agctccccgcggtggcggccgctctagaactagtggatcccccgggctgcaggaattcgtctcacccctagaaaaaattccgtcgtcgtcgtcagcagcttctgcttgctttgtgggggaaggagagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctcgtggggcgcttcctggccgcctccgagccggccgtgtccgtgcagctcggcgaccacggccacctcgcttactcccacaccaaccaggcgctcctccgccccaggtcgttcgcggccaaggacgaggtgttctgcctgttcgaaggggtgctggacaacctgggtcggctgagccagcagcacgggctgtcaagcaagggcgccaacgaggtgctcctcgtcatcgaggcctacaagacgctgcgcgaccgcgcgccctacccggccagcttcatgctcgcccagctcaccggctcctacgccttcgtcctctttcgacagtccaccaactccctgctcgtcgcatccgaccctaagggcagggtgccgctctttctgggggattcacgccgaacggctggcgtcccctttctcggacgaacttgacatggctcaagggttatgggggaagtccctcccgccctttcccccaggggtggttttacttcaaacccccttgaaggggtccagggcttccaaaaacccccaagccaaagggccccccttttccccc

SEQ ID NO: 75420 - protein, 174 aa, Zea mays
  misc_feature: Ceres CLONE 1559869
MLAVFSGQVVEVPAELVAAGSRTPSPKTKASQLVGRFLAASEPAVSVQLGDHGHLAYSHTNQALLRPRSFAAKDEVFCLFEGVLDNLGRLSQQHGLSSKGANEVLLVIEAYKTLRDRAPYPASFMLAQLTGSYAFVLFRQSTNSLLVASDPKGRVPLFLGDSRRTAGVPFLGRT

SEQ ID NO: 75421 - DNA, 821 bp, Zea mays
  misc_feature: Ceres CLONE 1559870
  misc_feature: Encodes the peptide sequence at SEQ ID NO. 75422
  misc_feature (610)..(610): n is a, c, t, g, unknown, or other
  misc_feature (803)..(803): n is a, c, t, g, unknown, or other
  misc_feature (804)..(804): n is a, c, t, g, unknown, or other
ctggagctccccgcggtggcggccgctctagaactagtggatcccccgggctgcaggaattcgtctcacccctagaaaaaactccacccacgcctccactacaccacacagagccgcagcagactcgcaagggaaaggagatggatcgtctgcccgagtcgacccggagcatgaggaagtacgcgtcggaggccggcgggcttcgcgcggcgcggcagggcccccacgggcggtcgctgacggcgcgcacggcgcacagcatgtccacgacggcgctgcgcaccaagtccaagtcggccgcgtcgctgctgcgcagggtgcccttcgcgccgctccgccccgtcctcgccaacctgcaggaggtgttcctcggcaccaagctcgccgtgctattccccgccgtgccgctcgccatcgccgcccagtgcgcgcacttcggccaggtgtgggtgtttacgctcagcctactcggcctcatccccctcgccgagcgtgtcagcttcctcaccgagcagatcgcgatatacaccggccccaccgtgggcggcctcctcaacgcgacgtgcggcaacgccacggagctcatcatcgcgctcttcgcgctcatggngggccagatcgaggtcgtcaagtgctccctcctcggctccgtcctcttcaacctgctgctcgtggtcggcacgttccttcttcggcgggggggtcgtaaacctcggtttcaaccagccgtacgaaaggaaccaagcgggacgttagccggggcctctcattcccggggggttttggcaaatctgcccctgggnnaaaaaaaaaaggggggg

SEQ ID NO: 75422 - protein, 217 aa, Zea mays
  misc_feature: Ceres CLONE 1559870
  misc_feature (100)..(208): Pfam Name: Na_Ca_ex Pfam Description: Sodium/calcium exchanger protein
  misc_feature (147)..(147): Xaa is any aa, unknown, or other
  misc_feature (212)..(212): Xaa is any aa, unknown, or other
MRKYASEAGGLRAARQGPHGRSLTARTAHSMSTTALRTKSKSAASLLRRVPFAPLRPVLANLQEVFLGTKLAVLFPAVPLAIAAQCAHFGQVWVFTLSLLGLIPLAERVSFLTEQIAIYTGPTVGGLLNATCGNATELIIALFALMXGQIEVVKCSLLGSVLFNLLLVVGTFLLRRGGRKPRFQPAVRKEPSGTLAGASHSRGVLANLPLGXKKKGG

SEQ ID NO: 75423 - DNA, 895 bp, Zea mays
  misc_feature: Ceres CLONE 1559871
  misc_feature: Translation starting site: 240
  misc_feature: Pfam Name: Mob1_phocein Pfam Description: Mob1/phocein family
  misc_feature (882)..(882): n is a, c, t, g, unknown, or other
ctggagctccccgcggtggcggccgctctagaactagtggatcccccgggctgcaggaattcgtctcacccctagaaaaagtccgcttcgtcctctcgtctactcgcactcgctagctgacgctgcgtgcgccaaaagcagcactgcagcagcaggtccagccgtcgccgttcccacttcccaccactgccacgcgcgccccggatcgagggagggcacgcagacgcggaggagggaggatgagtctcttcgggcttggacggaaccagaagacattccgccccaagaagagcgctccatcaggcagcaagggagcacagctccgtaagcacatagatgccactctcggcagtggaaaccttagggaagctgtgaggttgcctcctggagaggatatcaatgaatggcttgctgtcaataccgtggatttctttaaccaagttaatatgctgtatggcacgctcacagaattctgcacacctgagagctgcccgacaatgacagctggcccaaagtatgagtacagatgggctgatggtgtgcagataaagaaacccatagaggtatcagcaccaaaatatatggagtatctgatggattggattgaaggccagcttgacgatgaatccatatttcctcaaaaacttggcacaccattcccaccaaacttcaaggaagtagtgaagacaatattcaagcgcttttgttcgtgtttatgcccacatctaccactctcatttccagaaagatgttagccttaaagaggaggcccatctcaatactggtttcaagcacttcattctgttacaaaagaaaattttggcctgaatgaacaagaaggagcttggctccactccaggaagctcatgaatccatcatcgntccttaactgaga

SEQ ID NO: 75424 - DNA, 829 bp, Zea mays
  misc_feature: Ceres CLONE 1559872
  misc_feature: Encodes the peptide sequence at SEQ ID NO. 75425
  misc_feature (611)..(611): n is a, c, t, g, unknown, or other
  misc_feature (622)..(622): n is a, c, t, g, unknown, or other
ctggagctcaccgcggtggcggccgctctagaactagtggatcccccgggctgcaggaattcgtctcacccctagaaaaaaaaacccttgcggcggctaccttttccccagctccctctcgtctcgcggccgccgcaggcgaaaccccctcatcgcttcgcgctgtccaccgacgaatcttccccagctgagttaatcggggactggtcgtgtgcggagatgttggtgctcttcgagacccccgcggggttcgccctattcaaggtgctcgacgaggggaagctcgacaaggtcgaggatctatggaaggagttcacgacgtcggactcagcgagaaaggtggtcgagctgaaggctttcaacaagtttgagaacacatctgatgccctatccgcggcaaccctgattattgatagcaagcctagcaagggtctgcgcaagttcttgcagaaacattgtgagggtgaaacattagcagtagctgattctaagcttggaaatgctataaaagaaaagctgaaaattgactgccttcacaatagtgctgtgatggagctgatgagaggactgagaaatcagcttaccgagcttataactggggttgggtgcancagaccttggntcaatgagcttggggattgtccccacagcttgtctaggtataagctgaaagtcagcccctgagaagggttgatacaatgatcattcaggcccattgaattattggaatgatcttggacaaggagcttaacccttttgccctggagaatttcctggaggtgtaatgggcggggacctttcccaaagcctcccccaaatagtttccgaa

SEQ ID NO: 75425 - protein, 154 aa, Zea mays
  misc_feature: Ceres CLONE 1559872
  misc_feature (1)..(66): Pfam Name: NOP5NT Pfam Description: NOP5NT (NUC127) domain
  misc_feature (131)..(131): Xaa is any aa, unknown, or other
  misc_feature (135)..(135): Xaa is any aa, unknown, or other
MLVLFETPAGFALFKVLDEGKLDKVEDLWKEFTTSDSARKVVELKAFNKFENTSDALSAATLIIDSKPSKGLRKFLQKHCEGETLAVADSKLGNAIKEKLKIDCLHNSAVMELMRGLRNQLTELITGVGCXRPWXNELGDCPHSLSRYKLKVSP

SEQ ID NO: 75426 - DNA, 846 bp, Zea mays
  misc_feature: Ceres CLONE 1559874
  misc_feature: Encodes the peptide sequence at SEQ ID NO. 75427
  misc_feature (658)..(658): n is a, c, t, g, unknown, or other
  misc_feature (729)..(729): n is a, c, t, g, unknown, or other
gctggagctcaccgcggtggcggccgcctctagaactagtggatcccccgggctgcaggaattcgtctcacccctagaaaaactcgctctcaaatatctctcaccacctctcccctcagcttctccccacctttggtcaggcaggctcaggcaaagggggcggccaacaaggacgagcgatggcgaccaaggtcatctgcttccttgtgctcgcatccctgctcctcgccgtcgcctttcccgtgtctgctctgcggcagcaggtgaagaagggcggcggcggcggtggtggcggaggcagtgttagcggaagcggaggcggcaacctgaatccctgggagtgctcgcccaagtgcgggtcgcggtgctccaagacgcagtacaggaaggcctgcctcaccttatgcaacaagtgctgcgccaagtgcctctgcgtgccaccggggttctacggcaacaagggcgcctgcccctgctacaacaactggaaaaccaaggaaggagggcccaagtgcccctagaataagatccaccgcagctcccgtccgccattgtccccccttctccgaatctagaacgtgttgttcatcttcgaccaccccctaggcttggcattttattactagtataatgctagtgtccgcccgttgcttaatcntgcatgctaccagccagatctccatgctctcctgtgagccactcggcagagtgaggattactaggtagggntggcatgtcatgtcctccaccctccactggtacgagtcaatcaactaaagctaccccccggatgatgaaggacatccgccgcgaatagtggggcatgtcattaacttcatcagcttt

SEQ ID NO: 75427 - protein, 113 aa, Zea mays
  misc_feature: Ceres CLONE 1559874
  misc_feature (2)..(113): Pfam Name: GASA Pfam Description: Gibberellin regulated protein
MATKVICFLVLASLLLAVAFPVSALRQQVKKGGGGGGGGGSVSGSGGGNLNPWECSPKCGSRCSKTQYRKACLTLCNKCCAKCLCVPPGFYGNKGACPCYNNWKTKEGGPKCP

SEQ ID NO: 75428 - DNA, 887 bp, Zea mays
  misc_feature: Ceres CLONE 1559877
  misc_feature: Encodes the peptide sequence at SEQ ID NO. 75429
  misc_feature (826)..(826): n is a, c, t, g, unknown, or other
ggagctccccgcggtggcggccgctctagaactagtggatcccccgggctgcaggaattcgtctcacccctagaaaaaggatagcactagctagacatcacacagcgagcgagcgagagcggtgagcccggccaccagcgccggaggccgtcgtcgtcttactagccgacgctcgacttgggcatgaattgctagccgggtgagagattgctaggtagccagctaggtacggtgtgggggagttgaatcggaggtctgccgctcgaggcggcggcggcaaaaggccggtaggatgaagaagctccactggctggtgcggttcctgttcgggccggtgccggtctacttctcggcgctggccatcctcatcgtgctcaccaacgcgcagtacttcgggctggtgggcgtcggcgtggcgccgcgcaccgcgaagctggcctcctcggcgcccgtggtcagcgtcatgaagtactgcgacatcttccgcggcgagtgggtgccggacgcggaggcgccctactacaaccacaagacgtgccacatgatccaggagcaccagaactgcctcaagtacggccgccccgacctgagcttcctcaagtggcggtggcggccctccggatgcgagctgccgcgcttccacccgctgcagttcctgcagttcgcccgcgtgaagtcgctagccttcatcggggactcgctggcgcggaaacacatgcagtcgctgctactgctactgtcccaggtggcgtatcccaggacctgtcggcaaaaccgtctgaccagtactaggtgtaccactagcgtgcgtacagcttcacatcancatgttctggtcggcgttcctgctgcgcccccggaagtccgaccatacggtccttgtccac

SEQ ID NO: 75429 - protein, 198 aa, Zea mays
  misc_feature: Ceres CLONE 1559877
  misc_feature (178)..(178): Xaa is any aa, unknown, or other
MKKLHWLVRFLFGPVPVYFSALAILIVLTNAQYFGLVGVGVAPRTAKLASSAPVVSVMKYCDIFRGEWVPDAEAPYYNHKTCHMIQEHQNCLKYGRPDLSFLKWRWRPSGCELPRFHPLQFLQFARVKSLAFIGDSLARKHMQSLLLLLSQVAYPRTCRQNRLTSTRCTTSVRTASHXHVLVGVPAAPPEVRPYGPCP

SEQ ID NO: 75430 - DNA, 754 bp, Zea mays
  misc_feature: Ceres CLONE 1559882
  misc_feature (159)..(159): n is a, c, t, g, unknown, or other
  misc_feature (478)..(478): n is a, c, t, g, unknown, or other
  misc_feature (491)..(491): n is a, c, t, g, unknown, or other
  misc_feature (505)..(505): n is a, c, t, g, unknown, or other
  misc_feature (530)..(530): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (568)..(568): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (582)..(582): n is a, c, t, g, unknown, or other
  misc_feature (583)..(583): n is a, c, t, g, unknown, or other
  misc_feature (617)..(617): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (659)..(659): n is a, c, t, g, unknown, or other
  misc_feature (660)..(660): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (698)..(698): n is a, c, t, g, unknown, or other
  misc_feature (699)..(699): n is a, c, t, g, unknown, or other
  misc_feature (723)..(723): n is a, c, t, g, unknown, or other
  misc_feature (727)..(727): n is a, c, t, g, unknown, or other
  misc_feature (737)..(737): n is a, c, t, g, unknown, or other
ggagctccccgcggtggcggccgctctagaactagtggatcccccgggctgcaggaattcgtctcacccctagaaaaatcgtcatgatcccatcgctctcgccttcgcctttgtagcactacctcctcgtccatccgcccccctatttcgtcccactcngggttgggctagatcgggactgggatctcttctggcccgttttctttggaacaaaaataggcgaaatgacctgactgtccggcccgcaaaaggaaccttcgggagtggcccccccgggggccccccccccgggggttggggggttttttggggggggggggacccttttttccccccggggggggcccccccccccccccccctctccgaaaaaaaatttttttttttctccccccccccccccccggggggggggggggggtttttttccagagggggagggggtttttttttttttcttcttctccccccccccccncccgggggggggnggagaaaaaaaggnggggggggggggggggggggggggnccaccgaaccccaacacccccccctccccnnnnnnntntttnnnatnnnntnntttttctccccctccccccccccccccccccccncnnnnnggggggggggggggggggtgatattttttattatannaagaaaaagaaaaaaaaaaaannnnaaaaaaaaaaaannggaaaaagcgggaaagcccccccncccncccccgccgntgcgcgggtgggggggg

SEQ ID NO: 75431 - DNA, 879 bp, Zea mays
  misc_feature: Ceres CLONE 1559885
  misc_feature: Encodes the peptide sequence at SEQ ID NO. 75432
  misc_feature (799)..(799): n is a, c, t, g, unknown, or other
ctggagctccaccgcggtgggcggccgctctagaactagtggatcccccgggctgcaggaattcgtctcacccctagaaaaaacacttgaacacttccaaagttgtagcccctctcgtgagtcctgtccaaataatggccacgcgcagcagtgtcctcctgcttctgacggcgctcgccgcagccacggctgtgccgtcagcggcgaccaggaagctcatgttccctcgtcagccacagccgaacctcctcacgtaccacaacggcgccgtgctgagcggcgacatcccggtctccatcctctggtacgggcgcttcacggcggcgcagaaagccgtggtttccgaatttcttcttggcttttcgggttcggggcggccccaagggttccccttccttttccccaccggggaaaagggtttaaccggtttttccttttccaaaggggggggccgcggggcccccccttaaaaaaaaaaaagggcgcccccaggggggggggggggggccccaaaaaaaaaccccccgggggggggggtttttttcgggggggaaaaaccctcccccaaaagggagggtggttccctcccctgggggggaaaaaaccccaaaaatttttttccaaatttctggggggggattaagggccaaagaaaagcccccctccccgggcgaaagagggggggggggcttcccttctgttggttctccgcccgcgcgggagggaaggcccctttaagaggggttttttttcataaaaaccggggggggggggcccacaccaagggtttttttttacnccgtggggcgcgccgggggcgccccccccctttaaaaaatttctgggggggggggggaagcccccccctcaccacaaggg

SEQ ID NO: 75432 - protein, 111 aa, Zea mays
  misc_feature: Ceres CLONE 1559885
MATRSSVLLLLTALAAATAVPSAATRKLMFPRQPQPNLLTYHNGAVLSGDIPVSILWYGRFTAAQKAVVSEFLLGFSGSGRPQGFPFLFPTGEKGLTGFSFSKGGGRGAPP

SEQ ID NO: 75433 - DNA, 872 bp, Zea mays
  misc_feature: Ceres CLONE 1559887
  misc_feature: Encodes the peptide sequence at SEQ ID NO. 75434
  misc_feature (647)..(647): n is a, c, t, g, unknown, or other
  misc_feature (648)..(648): n is a, c, t, g, unknown, or other
  misc_feature (713)..(713): n is a, c, t, g, unknown, or other
  misc_feature (714)..(714): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (806)..(806): n is a, c, t, g, unknown, or other
  misc_feature (818)..(818): n is a, c, t, g, unknown, or other
  misc_feature (834)..(834): n is a, c, t, g, unknown, or other
  misc_feature (835)..(835): n is a, c, t, g, unknown, or other
  misc_feature (861)..(861): n is a, c, t, g, unknown, or other
  misc_feature (862)..(862): n is a, c, t, g, unknown, or other
ctccccgcggtggcggccgctctagaactagtggatcccccgggctgcaggaattcgtctcacccctagaaaaagtctggaactgcggggcaacgccatcacccatacgccaagcaggcctcttcgactatcgctggcggttatctcgcgatttcaagaacatccccgcctccgtctgatcccactggttcgcagatgcctgggcgacttagcatgccgcgccctctccctcgcgcgtggatggtgctgccgctggcttcgccgcctccacgtccacggaggcccggcgtgcggactggatgggcaactgctgtctccgcttacccagcggtgccgcggccgggtccgtccgggaggtccatgacgcctcgaggaacgtgttccccaggagaaagagcccccctcaagatcaaatccttgctggtggccgagggctgggaactttccaaagtgggctgccctgaggtgtccatgttgtgtaggctgaggaagctcaaagcattgcccgtcgaatgttaggtccgattctggtaaccaaccagctgttcacgaggaaagattgtgaccagggctattgagggacaagtgtccgtcgggggagatgttattcctacgcccttagcgcaaaccgctgtcgctctcattanngctcgcccttgggagactccgttctgtaatctctgtggagaggatcctgattgagtattataggnnctcgtgcctggttttggaatgattttcgacggagtatgacccaaagggggtaacaagtgttaattttnnnncgtcgtgtgatcgggagggcnatcaatagaagnccgatatcagtgagtnntgtaacggttggcgaggacgcgttgnnatttagtctg

SEQ ID NO: 75434 - protein, 54 aa, Zea mays
  misc_feature: Ceres CLONE 1559887
  misc_feature: SWISSPROT Homolog: EC 6.2.1.4 Succinate--CoA ligase (GDP-forming)
MGNCCLRLPSGAAAGSVREVHDASRNVFPRRKSPPQDQILAGGRGLGTFQSGLP

SEQ ID NO: 75435 - DNA, 903 bp, Zea mays
  misc_feature: Ceres CLONE 1559889
  misc_feature: Encodes the peptide sequence at SEQ ID NO. 75436
  misc_feature (161)..(161): n is a, c, t, g, unknown, or other
  misc_feature (388)..(388): n is a, c, t, g, unknown, or other
ctggagctccaccgcggtggcggccgctctagaactagtggatcccccgggctgcaggaattcgtctcacccctagaaaaacaccagcggcatctatagcaaccggtccaacactttcacgctcaggcgctcagctctagcaatggctgcctccaccatgngcgatctcctccacggcgatggccggtacccccatcaaggtgggctccttcggcgagggccgcatcaccatgcgcaagaccgtgagcaagcccaaggtggcggcgtccggcagcccctggtacggccccgaccgcgtcaagtacctcggcccccttctccggcgagcccccgagctacctcaccggcgagttccccggcgactacggctggggacaccgccgggctngtcggccgaacccggagaactttcgccaagaaccccgccagcctggaaggtgatccacctccccgcctggggccatggctttgggcgcccttccggatggcgttctttcccccaaaattggcttttccccgcaaacggggggttaaaaattttcggcaaaaggccctccttgggtttcaaagggccggggttcccccaaaattttttaggcggaagggggggggggttgggaaataaccccttgtggaaaacccccccccccgtaataaccccccccgcaaagaaaaatcccccctccccacctttgggggcccccccccagagttgtgggccccttttggggggccccccctccaaagggggcttccctttatttttttcccgggggggggccccctctcggaaaaaagaggtccccacaacacccttgttataaccctggggggggagggattttaataaaccccccctcggggtgggggggggaaaaaaaccccccgagggtggtttttttc

SEQ ID NO: 75436 - protein, 214 aa, Zea mays
  misc_feature: Ceres CLONE 1559889
  misc_feature (70)..(70): Xaa is any aa, unknown, or other
MAGTPIKVGSFGEGRITMRKTVSKPKVAASGSPWYGPDRVKYLGPLLRRAPELPHRRVPRRLRLGTPPGXSAEPGELSPRTPPAWKVIHLPAWGHGFGRPSGWRSFPQNWLFPANGGLKIFGKRPSLGFKGPGFPQNFLGGRGGGLGNNPLWKTPPPVITPPAKKNPPSPPLGAPPQSCGPLLGGPPSKGGFPLFFSRGGAPSRKKEVPTTPLL

SEQ ID NO: 75437 - DNA, 907 bp, Zea mays
  misc_feature: Ceres CLONE 1559892
  misc_feature: Encodes the peptide sequence at SEQ ID NO. 75438
  misc_feature (645)..(645): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (667)..(667): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (688)..(688): n is a, c, t, g, unknown, or other
  misc_feature (689)..(689): n is a, c, t, g, unknown, or other
  misc_feature (703)..(703): n is a, c, t, g, unknown, or other
tggagctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccacctagagatggatccgcaccagagcaccaggtggntnnnnnnnnnnggggggggggntnnnnnnnnngnnnttttttnngtttttggggaaanagggtttatggtggggggaacctttggatggggggggttgaacaaacctcgactccggggagaaacctatttcatttgaagcaaagagaacagggtgcttgggattgcctaaggggccaattctacccaaccggggaataagcgggcaagggtcaaaggggggggtttgtgggttttccctcccccccttagggggttcttggc

SEQ ID NO: 75438 - protein, 233 aa, Zea mays
  misc_feature: Ceres CLONE 1559892
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (168)..(168): Xaa is any aa, unknown, or other
  misc_feature (169)..(169): Xaa is any aa, unknown, or other
  misc_feature (170)..(170): Xaa is any aa, unknown, or other
  misc_feature (171)..(171): Xaa is any aa, unknown, or other
  misc_feature (172)..(172): Xaa is any aa, unknown, or other
  misc_feature (176)..(176): Xaa is any aa, unknown, or other
  misc_feature (177)..(177): Xaa is any aa, unknown, or other
  misc_feature (178)..(178): Xaa is any aa, unknown, or other
  misc_feature (179)..(179): Xaa is any aa, unknown, or other
  misc_feature (180)..(180): Xaa is any aa, unknown, or other
  misc_feature (182)..(182): Xaa is any aa, unknown, or other
  misc_feature (183)..(183): Xaa is any aa, unknown, or other
  misc_feature (187)..(187): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEEAGAAVEQFNGYTFQGRPLRVNCGPPPPRDGSAPEHQVXXXXXGGGXXXXXFXXFWGXRVYGGGNLWMGGVEQTSTPGRNLFHLKQREQGAWDCLRGQFYPTGE

SEQ ID NO: 75439 - DNA, 873 bp, Zea mays
  misc_feature: Ceres CLONE 1559893
  misc_feature: Encodes the peptide sequence at SEQ ID NO. 75440
  misc_feature (604)..(604): n is a, c, t, g, unknown, or other
  misc_feature (614)..(614): n is a, c, t, g, unknown, or other
  misc_feature (747)..(747): n is a, c, t, g, unknown, or other
  misc_feature (852)..(852): n is a, c, t, g, unknown, or other
ctggagctccccgcggtggcggccgctctagaactagtggatcccccgggctgcaggaattcgtctcacccctagaaaaactaaggtataggagaaagcgggagaagctggtggagctgattgctgtgtctcgcttgccgacgaaatggggcctcttccgagcctactgctaccagtccaggctcgatggaaccgagcacatcgctgttgtgaagggcgatatcggcgacggcgaagaggtcctggtgagggtgcactcggagtgcctgacgggggacatcctcggctcagcccgctgcgactgcggcaaccagctggagctggcgatgcagctgatcgagaaggccggccgtggcgtgctcgtgtacctccgcggccacgagggccgcggcattggcctgggccagaagctccgcgcctacaacctccaggacgagggccacgacaccgtcgaggccaacgtcgagctcggcctcgccgtggacgcccgcgagtacggcatcggcgcccagatactccgtgacatcggcgtgcgcacgatgcggctgatgaccaacaaccccgccaagttcatcgggctcaagggctacgggctcgccgtggntggggagggntgccggtgatctctcccatcaccaaggagaaccagagtaccctccgagaacaagcgcaccaagatgggccacgtctacggctccgatctcccgggaagcctgccggagttcgccaacccacaagaggcccccncagaaacagacgacgacgtataccaaactgataaaaaaactatacggtgtcgtttttttaggaaagataccatataacccacaattcttgtatccactgagaacnagtattgcagagtatttattt

SEQ ID NO: 75440 - protein, 206 aa, Zea mays
  misc_feature: Ceres CLONE 1559893
  misc_feature (37)..(206): Pfam Name: GTP_cyclohydro2 Pfam Description: GTP cyclohydrolase II
  misc_feature: SWISSPROT Homolog: EC 3.5.4.25 GTP cyclohydrolase II
  misc_feature (201)..(201): Xaa is any aa, unknown, or other
GAPRGGGRSRTSGSPGLQEFVSPLEKLRYRRKREKLVELIAVSRLPTKWGLFRAYCYQSRLDGTEHIAVVKGDIGDGEEVLVRVHSECLTGDILGSARCDCGNQLELAMQLIEKAGRGVLVYLRGHEGRGIGLGQKLRAYNLQDEGHDTVEANVELGLAVDAREYGIGAQILRDIGVRTMRLMTNNPAKFIGLKGYGLAVXGEGCR

SEQ ID NO: 75441 - DNA, 873 bp, Zea mays
  misc_feature: Ceres CLONE 1559896
  misc_feature: Encodes the peptide sequence at SEQ ID NO. 75442
  misc_feature (751)..(751): n is a, c, t, g, unknown, or other
ctggagctccccgcggtggcggccgctctagaactagtggatcccccgggctgcaggaattcgtctcacccctagaaaaaccgcctcgcacccgtcgttcccctccttccggcacaaccagcacgcgagcggcacgagaagactagggttacggcgaggcgacggcgggagccatggcagggattcggtggccgccagaggacccggagatcttcccttccaggatggtcagcggcggggcttgggtccccgtcgcgcccccaggagagatggcgtcggacgacgacaggtcggtggccgcggactcgtggtcgatcaagagcgactacggcagcaccctcgacgacgatcagcgttactccgacaccgccgaggtcctcctagcctcctcctccgcctcctctgttgccgcgccctccacgacggttgccgtccacccctcctccgacttcagcttcgacaaggatgtccatgactccagctacgttgaacctcccttgctgggcttgcagaattttcaggatggtgcttacgctgaggatcttgcaaatttccatgaacgcagccacgctgatgattggtttggcactgatatcatggatatccgcgtaggttggaccaaaaatttgtgctcaagtagagatttacccagctgcagcgtacttgacattgggactgggagtggcagactcttgcagcagcttgcgaagcaggggttttctgatctgactgggattgactatagtgaaangtgcattgagcttgctcgtagccttgcactcggtgatgggtttgagcacattaaattctttgggtgatggatgtttttggagtcgaagtttggagagaagatttgaacttgtcatgggatga

SEQ ID NO: 75442 - protein, 214 aa, Zea mays
  misc_feature: Ceres CLONE 1559896
  misc_feature: SWISSPROT Homolog: EC 2.1.1.64 3-demethylubiquinone-9 3-O-methyltransferase
  misc_feature (193)..(193): Xaa is any aa, unknown, or other
MAGIRWPPEDPEIFPSRMVSGGAWVPVAPPGEMASDDDRSVAADSWSIKSDYGSTLDDDQRYSDTAEVLLASSSASSVAAPSTTVAVHPSSDFSFDKDVHDSSYVEPPLLGLQNFQDGAYAEDLANFHERSHADDWFGTDIMDIRVGWTKNLCSSRDLPSCSVLDIGTGSGRLLQQLAKQGFSDLTGIDYSEXCIELARSLALGDGFEHIKFFG

SEQ ID NO: 75443 - DNA, 994 bp, Zea mays
  misc_feature: Ceres CLONE 1559897
  misc_feature: Encodes the peptide sequence at SEQ ID NO. 75444
  misc_feature (389)..(389): n is a, c, t, g, unknown, or other
  misc_feature (392)..(392): n is a, c, t, g, unknown, or other
  misc_feature (394)..(394): n is a, c, t, g, unknown, or other
  misc_feature (398)..(398): n is a, c, t, g, unknown, or other
  misc_feature (780)..(780): n is a, c, t, g, unknown, or other
  misc_feature (966)..(966): n is a, c, t, g, unknown, or other
ggagctccccgcggtggcggccgctctagaactagtggatcccccgggctgcaggaattcgtctcacccctagaaaaacccatccgctccgctcgcagcccctcccccttgcccccccgcgatgtcgtcgtcgtcaccgccgccgcggcccgacgacgacgacggtgcgcaggaggtgggcgccggcgatgggaggtcgctgggctacggcgaggcggagtactgggacgcgcggtacgtggaggagggcggcgcgccttacgactggtatcaacgctacgacgcgctccgccccttcgtccgctgcttcgcgccgccggcgtcccggatcctcatggttggctgcggctccgcactcatgtcggaggaggtggtcgctgacggctatntgnanatantgaacactgacatttcttcggttgtgattgggatgatggaaaaaaaatatttcgatgtttcgccagctgccatactttgcgcctggggtgtttagagatatggagtatggtttccggacgaaatcgtccgatttggccaatcccataaaggggacttttgggattcctttggaggggggggggggggaagtttcccccctccggggcgatctctaaatgaaatttttgggggatggggcgcgggttttttagtgggggtttgggcggccccttctggggagctttttttgaacagcgggggagggacccctttttgttttcgtcgaggatagggggggagcccccccccgccccgaaaggtgttttcttttttgtagtaggncggcacggtggggtgtgggatagtggttctttttttttgtttccccggctgggaggtgggtgctgtgtgttggaggagaaagaaggcggggtcttgttttaggattgattattcgcccgatgcgcgccggggtgggagatccccttcgtgttgggatgtttgtggccccagcgcgctttctaaggncctctcgctgtgtttctgtgtggttgtg

SEQ ID NO: 75444 - protein, 123 aa, Zea mays
  misc_feature: Ceres CLONE 1559897
  misc_feature: SWISSPROT Homolog: EC 3.4.24.71 Endothelin-converting enzyme 1
  misc_feature (90)..(90): Xaa is any aa, unknown, or other
  misc_feature (91)..(91): Xaa is any aa, unknown, or other
  misc_feature (93)..(93): Xaa is any aa, unknown, or other
MSSSSPPPRPDDDDGAQEVGAGDGRSLGYGEAEYWDARYVEEGGAPYDWYQRYDALRPFVRCFAPPASRILMVGCGSALMSEEVVADGYXXIXNTDISSVVIGMMEKKYFDVSPAAILCAWGV

SEQ ID NO: 75445 - DNA, 835 bp, Zea mays
  misc_feature: Ceres CLONE 1559901
  misc_feature: Translation starting site: 183
  misc_feature (653)..(653): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
aaagctggagctccccgcggtggcggccgctctagaactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcgggaacatcaccctggtcccggggctcctgtactggggtgcgcaactgcttggggtcccccgggggggggtttctgctccctttttcaacgggggggcaggcaccgggcccttcgggctgacggggtgtttttttttggggagggccctgttcctgggaaatcttaattacctctcggggctgggntggaaccggggaaccccccnnnnggggggacgcgcaaaaggggaacctgggcacccttcccccctttgcattgggtttcattttggggcaaaatctctggggggtgggggggggccctttaaagggggggtcattaaaacccccccccggggtcctttgggcccccccccttctaaaaaagg

SEQ ID NO: 75446 - DNA, 876 bp, Zea mays
  misc_feature: Ceres CLONE 1559903
  misc_feature: Encodes the peptide sequence at SEQ ID NO. 75447
  misc_feature (742)..(742): n is a, c, t, g, unknown, or other
  misc_feature (750)..(750): n is a, c, t, g, unknown, or other
  misc_feature (754)..(754): n is a, c, t, g, unknown, or other
  misc_feature (791)..(791): n is a, c, t, g, unknown, or other
agagctggagctccccgcggtggcggccgctcttcaactagtggatcccccgggctgcaggaattcgtctcacccctagaaaaaattctcctcctcctcctcacctcctcccaggctcccactccctcctctgcagtctgcaccacaccaccgttccagcgagcggagtcctggtcgacttctccggccagctcgaggcgccctcgccgcttcactcgaccgcccccccctcccccaccgcttctgctatgccgccggcgccagccgccgtcgcgccggagccgcagaagctttcgctgacgccgacgccgacgcagcagtgccgccggccgcgctcgccgctcgccaacggctcggccgccggcgacttcgagctgcggcactggcgcacgcccaagaagcgcgcgacgccatcgccggcgccgcggtgggcgccgccgccggtgatcgagatacccaacggcggcgctggcagcgacggcgacgacagcaacagcagctgcggcggcggggggcacgggtacaccagcctccgggacatcctgtcgtcgccggaatacgccgcggcggggcgctcgcccggggccctgctgcggcggcgcgggttgcgcaacttccgggaactacacctggatccgggcccccgctccggaaacccccgggggttaaccgctacctggcaaataacccccgtcccccgggggaaggaccccgggccctcctccggccgcccaattggggncctttcgncacngggcccaaaggggggcccggggggcgcccaaagaaanaaacgcggggggcccccctccccggggcctttgaaggaacaccgccctgtctgcgggaaacccctctccctccccgggggggggg

SEQ ID NO: 75447 - protein, 209 aa, Zea mays
  misc_feature: Ceres CLONE 1559903
  misc_feature (165)..(165): Xaa is any aa, unknown, or other
  misc_feature (168)..(168): Xaa is any aa, unknown, or other
  misc_feature (169)..(169): Xaa is any aa, unknown, or other
  misc_feature (181)..(181): Xaa is any aa, unknown, or other
MPPAPAAVAPEPQKLSLTPTPTQQCRRPRSPLANGSAAGDFELRHWRTPKKRATPSPAPRWAPPPVIEIPNGGAGSDGDDSNSSCGGGGHGYTSLRDILSSPEYAAAGRSPGALLRRRGLRNFRELHLDPGPRSGNPRGLTATWQITPVPRGKDPGPSSGRPIGXLSXXGPKGGPGGAQRXKRGGPPSPGPLKEHRPVCGKPLSLPGGG

SEQ ID NO: 75448 - DNA, 847 bp, Zea mays
  misc_feature: Ceres CLONE 1559905
  misc_feature: Encodes the peptide sequence at SEQ ID NO. 75449
aaagctggagctccccgcggtggcggccgctctagaactagtggatcccccgggctgcaggaattcgtctcacccctagaaaaaaaatccccaaatcgaggccagccaggggcaccgccaccatcacttcaccgccgccgtcgacttcactctctctctcactcccaaaccaagctaccttccgcccatgggcccaccgccgcgccgccgccaactcctgctgtctctcgcgctgctcgccaccgcggccgcctgctgcgcggcgggggcggcgcccaggctgtcgcccaactactaccgccgcagctgcccgcgcgtggagcggatcgtgtcggacgccgtcgccgccaagcagcgcgccaacccgtccacggctgcgggcacgctgcggctcttcttccacgactgcttcgtcaacggctgcgacgcctcggtgctggtctcgccgctctcctcctccggcgccgcgccggagcgcgccgcggagatcaacctgtccctgcccggggacgccttcgacgccgtggcccgcgccaaggcggcgctggaggccgcgtgcccgggcgtcgtctcctgcgccgacgcgctggcgctagcggcgcgcgacctcgtggccgccctaggcgggccccggttccccgtcgcgctggaccgccgcgaactccgccgctccgacacgcgcgacgtcgagggcacctgccccgcacctacatgtcggcgcgagccatggtgcgcctcttcgcccgcagggcctcgcgccccgggagatgtggccgctgccggccccacaccgtcggcttctccactgcgcccaagtcgcgcccgcatctacggctacgggagcgcc

SEQ ID NO: 75449 - protein, 220 aa, Zea mays
  misc_feature: Ceres CLONE 1559905
  misc_feature (48)..(220): Pfam Name: peroxidase Pfam Description: Peroxidase
  misc_feature: SWISSPROT Homolog: EC 1.11.1.7 Peroxidase
MGPPPRRRQLLLSLALLATAAACCAAGAAPRLSPNYYRRSCPRVERIVSDAVAAKQRANPSTAAGTLRLFFHDCFVNGCDASVLVSPLSSSGAAPERAAEINLSLPGDAFDAVARAKAALEAACPGVVSCADALALAARDLVAALGGPRFPVALDRRELRRSDTRDVEGTCPAPTCRREPWCASSPAGPRAPGDVAAAGPTPSASPLRPSRARIYGYGSA

SEQ ID NO: 75450 - DNA, 794 bp, Zea mays
  misc_feature: Ceres CLONE 1559906
  misc_feature (648)..(648): n is a, c, t, g, unknown, or other
ggagctccccgcggtggcggccgctctagaactagtggatcccccgggctgcaggaattcgtctcacccctagaaaaaaagcctccagctgacaaaagctaagcaatcgagctgacaagagctaagcaatcgagctgacaagagctaagcaatcgggggagttcactgatgtcttgcttcagcgccatgaccacgacgacgggcggcagaggcacctactactactcgtcctcgccggggcggccccgcggcggcggcggcggcaagaggccgtggcggcggtggcgcgccaagtgcgccggcatcgccgcagccgtcgggtccaggctccggagatctgtcgtcagggccgtcgacggtggccgccggcgcacgccgccgccttcgtcctcatccgttcaccgcgggtggtgccaccaccaccaccacggccgccagagcttcgcgccggtctacgtcgacgacctctacagccacagcctacagcctgcagccaaggcccaccgcggcgtcgtcatgctgcaggagcaggtgcatgagtcgccgagcaccagcgtctgcgaacagctgccggcaacgatgcgggtgcgcccccgcacggcgccagtgccagcagcaacaagcaacatgcgcgcgacatggctggcnggcgtcgccgcaataagaacgtgctgctggcgacccccggcaaagcggccgcggctttcctcggtgtagaataaaaggggggggggggttaaccggggccccaaaccttttctcccaaattccaagaaagaatagtgttttcaaac

SEQ ID NO: 75451 - DNA, 794 bp, Zea mays
  misc_feature: Ceres CLONE 1559907
  misc_feature: Encodes the peptide sequence at SEQ ID NO. 75452
  misc_feature (484)..(484): n is a, c, t, g, unknown, or other
  misc_feature (491)..(491): n is a, c, t, g, unknown, or other
  misc_feature (492)..(492): n is a, c, t, g, unknown, or other
  misc_feature (547)..(547): n is a, c, t, g, unknown, or other
  misc_feature (669)..(669): n is a, c, t, g, unknown, or other
tggagctccccgcggtggcggccgctctagaactagtggatcccccgggctgcaggaattcgtctcacccctagaaaaaagctagctggctagcatggccgggaaagagcttacgctgctggggttatgggcgagcccgttcgtgctccgggcgcgcatcgcgctcagcctcaaaggcctcacctacgcttactccgaggagaacctcgacgacaagagcgagcttctcctcagctccaaccccgtgctcaagaaggtgcccgtgctcatccaccacggcaagcccgtctgcgagtcccagatcatcgtgcattacgtcgacgaggctttcccggccgccacacctaatttccttccatccgacccctacgaccgcgccattgctcgcttctgggcctcctacctcgacgacaagttctacagcgcgtggatacccgtgttcaggggcaggacggcggaagagatggctgaagcggcaaggcangccgtcnncgcgctggagacgcttgaacaagcgttcagggagtgctccagggggaaggcttcnttccaaggggacagggtggggctcgtcaacgtcatgctcgggggcctttgttggggggggtttccccccccccaaggccctttttgggggggggaaaacccctctaaaccccccgagaaagnaacccccctttttttccttggggggaaaaactctttcccccctggggggaaagggggtgtcccccccgggaaaagggttcttttagaaaaaaaaggggggggggggcgtttttttcccccccccc

SEQ ID NO: 75452 - protein, 233 aa, Zea mays
  misc_feature: Ceres CLONE 1559907
  misc_feature (4)..(77): Pfam Name: GST_N Pfam Description: Glutathione S-transferase, N-terminal domain
  misc_feature: SWISSPROT Homolog: EC 4.4.1.5 Lactoylglutathione lyase
  misc_feature (130)..(130): Xaa is any aa, unknown, or other
  misc_feature (133)..(133): Xaa is any aa, unknown, or other
  misc_feature (192)..(192): Xaa is any aa, unknown, or other
MAGKELTLLGLWASPFVLRARIALSLKGLTYAYSEENLDDKSELLLSSNPVLKKVPVLIHHGKPVCESQIIVHYVDEAFPAATPNFLPSDPYDRAIARFWASYLDDKFYSAWIPVFRGRTAEEMAEAARXAVXALETLEQAFRECSRGKASFQGDRVGLVNVMLGGLCWGGFPPPQGPFWGGENPSKPPEKXTPLFFLGGKNSFPPGGKGGVPPGKRVLLEKKGGGGRFFPPP

SEQ ID NO: 75453 - DNA, 826 bp, Zea mays
  misc_feature: Ceres CLONE 1559910
  misc_feature: Translation starting site: 165
  misc_feature: SWISSPROT Homolog: EC 3.1.2.4 3-hydroxyisobutyryl-CoA hydrolase
  misc_feature (614)..(614): n is a, c, t, g, unknown, or other
  misc_feature (644)..(644): n is a, c, t, g, unknown, or other
ctccccgcggtggcggccgctctagaactagtggatcccccgggctgcaggaattcgtctcacccctagaaaaaacggcacttccactggagggccacacttctcttttgaggaccagtccaccgtccactcccagagtccaaaaccctacgatccgcgccaccatgccgcgcctcgccgccgccgccgccgtctcacgccgcgccggcgaggccctgcgccgcggcgcgtttgggggactgcggcctctctcctccctgcaaccgttaaacgccgcctccagcgacgaggtgctcgttgaaggaaagacaagtgcgcgcgctgccgtgctcaaccgccctggctacctcaacgccctcaccaccaccatgggagctaggctcaataaattttatcaatcatgggaggacaacccagacattggctttgtcatgatgaagggcagcggccgagcattctgtgctggtggggatgttgttagattacatgaacttatcagtgaaggcaagctggaggaatgtaaggattttttcaagactttgtacatgttcatttattttctgggcacgtacttgaaaccacatgttgccattcttgatgcattacatggtggnggggggggaagtggtttccatccctggaancatccggtgtgcaactgataggacagtctttgcaactccagaagttcaaattggattccatcctgaagctgcagccctccttttattggcgcatcaaactggccatgttgggggaaatgtgggccttgaccggggaaaaagttaatggaaacaaaaagaatggccttggcctttgcaaacaa

SEQ ID NO: 75454 - DNA, 809 bp, Zea mays
  misc_feature: Ceres CLONE 1559913
  misc_feature: Encodes the peptide sequence at SEQ ID NO. 75455
  misc_feature (575)..(575): n is a, c, t, g, unknown, or other
  misc_feature (633)..(633): n is a, c, t, g, unknown, or other
  misc_feature (690)..(690): n is a, c, t, g, unknown, or other
ggagctccccgcggtggcggccgctctagaactagtggatcccccgggctgcaggaattcgtctcacccctagaaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctacagggtggtgccaagaacgttgttatctctgcccaagcaaagatgcacccatgtttgttgttggtgtcaatgaggacnagtacacctcggatgataacattgttttcaatgctagctgcaccacagactgccttgnctcccccttgctaggtcattcatgacaacttcggcatttgttgagggtttgatgacnactggtcatgccatcactgcccacccgaaaactgtttgacggatctttcaacaaggaactggaaaggttggcaggcccttcccacttttaaaattatttccctaggacccccggggctg

SEQ ID NO: 75455 - protein, 163 aa, Zea mays
  misc_feature: Ceres CLONE 1559913
  misc_feature (4)..(145): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (160)..(160): Xaa is any aa, unknown, or other
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLQGGAKNVVISAQAKMHPCLLLVSMRTSTPRMITLFSMLAAPQTALXPPC

SEQ ID NO: 75456 - DNA, 768 bp, Zea mays
  misc_feature: Ceres CLONE 1559918
  misc_feature: Encodes the peptide sequence at SEQ ID NO. 75457
  misc_feature (523)..(523): n is a, c, t, g, unknown, or other
  misc_feature (558)..(558): n is a, c, t, g, unknown, or other
ctggagctccccgcggtggcggccgctctagaactagtggatcccccgggctgcaggaattcgtctcacccctagaaaaaaacccaaccggggcattcaaccaccccgtgtgctccaaccgctcctcgatttgatcaccgattgcgggaggccgactagggtttaccggtgagcgcgcgcgcgcgagagagagagagtgagggcggaggaaaggggagatggcgcaggcggtggaggagtggtaccggcagatgcccatcatcacgcgctcctacctcaccgccgccgtcgtcaccaccgtcggctgcaccctcgagatcatttcgccgtatcacctgtacctgaacccgaagctcgtggtgcagcactacgagatctggcgcctcgtcaccaactttctctacttccgcaagatggatttggattttctgttccacatgttttttctcgcacgatactgcaagcttctggaggagaactcatttagaggaagaactgccgactttttttacatgctcttggnttggtgctactgtcctaactagcattgttctgatncgagggatgataccttaccttttccgagacattttgcccgaaattctgtttccggagcaatttctttggaccgtttaggaaggggtttaatgttcgggggagaaagcccaaaaatccttttttttccccaaaaaaagggctttttggggggggccgtgttccacctttttagggggggggggtttattttaacgggggggggggcccctt

SEQ ID NO: 75457 - protein, 108 aa, Zea mays
  misc_feature: Ceres CLONE 1559918
  misc_feature (12)..(108): Pfam Name: DER1 Pfam Description: Der1-like family
  misc_feature (102)..(102): Xaa is any aa, unknown, or other
MAQAVEEWYRQMPIITRSYLTAAVVTTVGCTLEIISPYHLYLNPKLVVQHYEIWRLVTNFLYFRKMDLDFLFHMFFLARYCKLLEENSFRGRTADFFYMLLXWCYCPN

SEQ ID NO: 75458 - DNA, 809 bp, Zea mays
  misc_feature: Ceres CLONE 1559919
  misc_feature: Encodes the peptide sequence at SEQ ID NO. 75459
ctggagctccccgcggtggcggccgctctagaactagtggatcccccgggctgcaggaattcgtctcacccctagaaaaaaggctctcagctcagctgcgtcctcctgccacccatggcaaacgcttctctgcagtccttccttctcccgcacgaccattctttcgccggctccggcggcagccgtgacggctccgcgtccgccgtgcacaagctctccaccaacaccagcggcagcatttccttcaggctctacaccaaaacctccccctcggtgacagcagcctcagccaccaattcgtcagctccgactccagttgccccggcatctgcaccagcggcaggggacgaagaagaagaagaaggcccctctctcgacctcctccgccgccagctcgccgcgggcgactaccggcaggcggacgagaccacgcgggcgctgatcatcgacctcgccggcgagcccgcgaggcgccgagggtacgtcttcttctcccgagtccagttcatccgggccgaggacctcgccgccatcgacgggctctgggaggagcacaccggcggcaggttccgggtacaccgtgcagcggcggctctggggaaaaagtccgggcccaacttcaccccggttttttaaatccggggtcggcctgggattaaagaaaactgggcaccccggagggggggaacccttatacaactcccggggggcccttccccccacaaaaagatttttttttgtgggggggtgttttttgaggggaaaaaaaacccccccccccagagagggaaaaccaccccccccccccc

SEQ ID NO: 75459 - protein, 173 aa, Zea mays
  misc_feature: Ceres CLONE 1559919
  misc_feature (90)..(174): Pfam Name: GUN4 Pfam Description: GUN4-like
MANASLQSFLLPHDHSFAGSGGSRDGSASAVHKLSTNTSGSISFRLYTKTSPSVTAASATNSSAPTPVAPASAPAAGDEEEEEGPSLDLLRRQLAAGDYRQADETTRALIIDLAGEPARRRGYVFFSRVQFIRAEDLAAIDGLWEEHTGGRFRVHRAAAALGKKSGPNFTPVF

SEQ ID NO: 75460 - DNA, 841 bp, Zea mays
  misc_feature: Ceres CLONE 1559920
  misc_feature: Encodes the peptide sequence at SEQ ID NO. 75461
ctccccgcggtggcggccgctctagaactagtggatcccccgggctgcaggaattcgtctcacccctagaaaaagttctcatggccgagcacaagtcttcctcaagcgtcgcctgctgtaccagtgtcgagctccccacgctcgccgctactcctagcccctctcctccctggatttggcccagtctccatctctctttccagccatggacggcgacctctcctgcctacagcagggcgccgggatgctgcttcctatacatcgtgcgcctccctggtgcttgctctcgccctagtccatggagcagcagcagccacgacactccttcgtgtcgcgccctcgacgtgttcgatgaaatactgcagcgagctccaactcgatctgcacagcccctgcgcgacgtcacaaactccgctcgttgtcgatgtcgtgcttcgggcatcgagtgttcgacgaaaatcccaagtccatggacagcacatacacaactcaaatccgatcggccaggtacgttaattgctcacgtgctgtagaggacgagagttggattaatctcagagtaatgctgatggatgaacctaaggatgggtgatctgatcgagtgccaggatattgaagctcacccaccggacgtctctaacaacactaacgtagtgttatcccaggtacgttaattgctcacgtgctgtagaggacgagagttggattaatctcagagtaatgctgatggatgaacctaaggatgggtgatctgatcgagtgccaggatattgaagctcacccaccggacgtctctaacaacactaacgtagtgttatcccaggtcaagaacaggtaccac

SEQ ID NO: 75461 - protein, 150 aa, Zea mays
  misc_feature: Ceres CLONE 1559920
MAEHKSSSSVACCTSVELPTLAATPSPSPPWIWPSLHLSFQPWTATSPAYSRAPGCCFLYIVRLPGACSRPSPWSSSSHDTPSCRALDVFDEILQRAPTRSAQPLRDVTNSARCRCRASGIECSTKIPSPWTAHTQLKSDRPGTLIAHVL

SEQ ID NO: 75462 - DNA, 915 bp, Zea mays
  misc_feature: Ceres CLONE 1559921
aaagctggagctccccgcggtggcggccgctctagaactagtggatcccccgggctgcaggaattcgtctcacccctagaaaaaatcgatgtgcacaaatccatctggattctggatagaggagactcctacatcgcaccgcgcgtacacccttgtaccaattcgtctactctttcaccaccgcccgcgcgcatggcgcgttacgatggcccctctcgtgctgattttccatccatgtctggagaaatacctatccgaggcaggacacggatgttgctcgctgtaatgaggtgattctggtgttcaagatcatcctccaaaccgccgacatgacacacttgctggacgacgagcacgcctgggacggcaaagaccatcacagtgctactagtcagctaccagcctctacggtccatatgctgatcagtcaccggctgtcggagcatcatgctagtgctgactcctggtattcatgtcttccaggactgagcatcatcatcttttgctgctgattgattgttggtactgccttggaaaagctgggttatttccctgcctcgccttaagaagaattggttaaccctttgccccaggcccaatttccttggagcgtggacgcccccattaagccttttttttggccgtgcctttccagagctttttttcccaaagtttggcccggaatttaatttttgtttttttggcgccttttgttttccccccccgcccaaagagagaaaaccccctttttgtttttttaaaaaattgtggcccaaaaattttttagggttttttcgggggttttttttcttttttttaaaaaaaaaatttcccccccgcggagggggcgcccccttttctcccgtgtgtttgggggagacaaaaaaaaaagagggtcttttttttttctctctt

SEQ ID NO: 75463 - DNA, 855 bp, Zea mays
  misc_feature: Ceres CLONE 1559922
  misc_feature: Encodes the peptide sequence at SEQ ID NO. 75464
  misc_feature (849)..(849): n is a, c, t, g, unknown, or other
tggagctccccgcggtggcggccgctctagaactagtggatcccccgggctgcaggaattcgtctcacccctagaaaaaatctcatcttcgtctgtgttcttgggcgtacgcggacacagccccgatccgaatcgtcctcctcgcgagcctcgtcgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggccgcgcacttgctgactacaacatccagaaggagtcaacccttcatttggtgctgcgccttaggggaggcatgcagatctttgtcaagaccttgactggcaagacaatcacccttgaggtggagtcttcagacaccattgataatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcaccctttgaggtggagtcctcagacaccattgacaatgtcaaggcaaagatccaggacaaggagggcatcccacctgaccagcaacgtctcatctttgcccgcaagcagttggaggatggggagacccttgctgactacacatccagaaggagagccccctcccacttntgctgc

SEQ ID NO: 75464 - protein, 167 aa, Zea mays
  misc_feature: Ceres CLONE 1559922
  misc_feature (82)..(150): Pfam Name: ubiquitin Pfam Description: Ubiquitin family
  misc_feature (6)..(74): Pfam Name: ubiquitin Pfam Description: Ubiquitin family
MQIFVKTLTGKTITLEVESSDTIDNVKAKIQDKEGIPPDQQRLIFAGKQLEDGRALADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITL

SEQ ID NO: 75465 - DNA, 857 bp, Zea mays
  misc_feature: Ceres CLONE 1559923
  misc_feature: Translation starting site: 250
  misc_feature (585)..(585): n is a, c, t, g, unknown, or other
  misc_feature (630)..(630): n is a, c, t, g, unknown, or other
caaagctggagctccccgcggtggcggccgctctagaactagtggatcccccgggctgcaggaattcgtctcacccctagaaaaaaaaacaccggcacgagcgccaaaacatttattgcctttcaagtcgagaggcttcgcggcgcgaacgtcgaggagcttagcctccaggggagactcctgttgatcggccaagcagacgtacagagagagagggtcgcggcgcggttgagggttcgtcgtcgacccatggccgtgaccgcgacgacggtcgcggcggcgatcacgatgctggcggccgtggcggcggttttcctcaccgtgctgctctgcttctacatcgtcctgtgcgccaagcaataccggggcggggcgccccgcgcggggggcggcggcggcggcagggcgtggctgctgcgcgtcgtgttcggcggcgggggtgcggacggcggcggcggcggcgccaccgagtggtgccacgagggcgggctcgacgacaaggccatggcgaggctgccccggcgggaggtgggcgcgggcgaggcgctggactgcgccgtgtgcatcgcggaggtggcggccggngaaggcagcacgagtgctgccgcggtgcggccacgccattcacgntcgactgcgtcgacgcgtggctccgactccactccacctgcccgctctgcgggtgctcgccgtcaacgacccgcccgcgtgaccacacccgtggccgaacgggagtcccccacgtccctacaacgtcctcttcttcggctccaggacgacgtcagcaccgtcgctcgcggccggacggcctcaataatttttttgggggggggggggcggggtttccccccccgtac

SEQ ID NO: 75466 - DNA, 769 bp, Zea mays
  misc_feature: Ceres CLONE 1559925
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (88)..(88): n is a, c, t, g, unknown, or other
  misc_feature (92)..(92): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (138)..(138): n is a, c, t, g, unknown, or other
  misc_feature (156)..(156): n is a, c, t, g, unknown, or other
  misc_feature (371)..(371): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (507)..(507): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (656)..(656): n is a, c, t, g, unknown, or other
nnnnnnnnnnnnnnnnnnnnnnnnnnnnnnnnnnnnnnnnnnnnnnnnnnnnnnnnngggggggtcccgggggggnnncnnnnnnggntccncnnnnnnnnnnnnnnntttnnnnnnntccaaagctgggactccccncggtggcggccgctctanaactagtggatcccccgggctgcaggaattcgtctcacccctagaaaaactctctctcattttctcatcatacaagttgttgagttcctgtccctgttcttggacggacacatatccaatccaccccgagaatttgctcaatttactccagacacactggcaaacaacgggaccgtcaaacctcgatttctctgggcaaaacatggttccaaccngccggtgggccgaaaggccccggccccccccctttacgggggtttcccccggggattccccgggaaaaaagggggggggacaaaccgggcccggggcggggggccttttggggaaaaaagggaaannnnnnngccnccaaaaaaaaaatttttttgggccccgcgccgggggttttccccagttaaaaaaagggggggggggggggggggggccccccccgggggtgttttttttttttttacccccgattggannnnaaaagggagttttgcctcccccacccnggggaaaaaaaaaaagggggaggtgggggccgccccttttttaaaacaaaaccaaccgccgggggggggaaaaaaaaaaaaaaaaaaaaaagagatctcttctttaaaaaaaa

SEQ ID NO: 75467 - DNA, 816 bp, Zea mays
  misc_feature: Ceres CLONE 1559927
  misc_feature: Encodes the peptide sequence at SEQ ID NO. 75468
  misc_feature (764)..(764): n is a, c, t, g, unknown, or other
  misc_feature (765)..(765): n is a, c, t, g, unknown, or other
  misc_feature (788)..(788): n is a, c, t, g, unknown, or other
aaagctggagctccccgcggtggcggccgctctagaactagtggatcccccgggctgcaggaattcgtctcacccctagaaaaagcctaaagccgcaagcaccacagccggagaaatcctctcgtgtcgtctcttcagctatcagacggcaagacgatgctgccgctgaggtccgccgccgccgcgccgtgctcggttgcaggacttctgcttcaccgattctcatcctactcgtcctcttctgtctattctgtccgccaccacgcctcgtctgctctctcctcccagccctccacctgccccaccaccacctggtcctcttcccccaattccagcagccgcaggatcaggggggtttgctggcctgagacttcggcgccgggggccgggcggggatctgcggaattccccttcgctacaaaagggcgctaggaggcttaaagaatccaaggggagccaaacttgggaggggggggaaaacacggctcccacaggttgtggggggaaaccccccccttgggggaaaaggggggccccccccccttttttttttttctttaaaaacccggggtttttttttttccccggggggggtttttttttttggggggagaaaaaaaacttttcctttttttttttaaaaaaaggggggggggaaaaaaaaaaaaaagattttttttttttattaccaaggagagaggttttttttttttttgggggggggggggggggaaaaagaaaaattttattttttttcttaaccnncccccacgccgccgcgcgccggntttgtggttttggtggggggggggggag

SEQ ID NO: 75468 - protein, 91 aa, Zea mays
  misc_feature: Ceres CLONE 1559927
MLPLRSAAAAPCSVAGLLLHRFSSYSSSSVYSVRHHASSALSSQPSTCPTTTWSSSPNSSSRRIRGVCWPETSAPGAGRGSAEFPFATKGR

SEQ ID NO: 75469 - DNA, 877 bp, Zea mays
  misc_feature: Ceres CLONE 1559929
  misc_feature: Encodes the peptide sequence at SEQ ID NO. 75470
  misc_feature (674)..(674): n is a, c, t, g, unknown, or other
  misc_feature (725)..(725): n is a, c, t, g, unknown, or other
  misc_feature (787)..(787): n is a, c, t, g, unknown, or other
  misc_feature (824)..(824): n is a, c, t, g, unknown, or other
ggagctccccgcggtggcggccgctctagaactagtggatcccccgggctgcaggaattcgtctcacccctagaaaaaactcggcccattccaagtcccaccttgcgtacgtgagccaaacgctcctggtcctggcagtctccatctccacctagggttccggcgatggtgcacggcggctacccgcgccgcgacgccgccgtccgccggcccaagtcctcgtcctccgccgtagttgccgaccgcaagcggaagtggaccgccgccgccaagaacacctcacttaaaaaccagatccgttccactgagcgctttctccacaaggtacttaccgacacctgggggctggggtcttctcgactgagctcggaacctctagtttagcgttgttcctacccagtggatgggctttggctgttgcttgtggagcgctgggtgtttctctaggaacctctccattttctagttgattgggaagcttccccgaacgtagctaggaattttagcacgaaagtctttctacaatgatgaattgttcaaccacaaatatttatttacttgttgcttctgtagggggctaggggcaaattgatgcttcaactgaggcctctgtttgttgcattccgctcagtagcctaattcatggtgtagctggattactgcagcttgcatangtgattaggtgctattaagtatcaagtattgattgaaaactatcagactgnaatgttaactatgtttgctcaacggttagtcagaaatgctgtgaaagggcatttgtttctgntcagaggagaatgacgaagcctaaatgaccctggggntggtgaagatattcactcaacatcaaatccctataaccagttttgattgataa

SEQ ID NO: 75470 - protein, 72 aa, Zea mays
  misc_feature: Ceres CLONE 1559929
MVHGGYPRRDAAVRRPKSSSSAVVADRKRKWTAAAKNTSLKNQIRSTERFLHKVLTDTWGLGSSRLSSEPLV

SEQ ID NO: 75471 - DNA, 958 bp, Zea mays
  misc_feature: Ceres CLONE 1559934
  misc_feature: Encodes the peptide sequence at SEQ ID NO. 75472
  misc_feature (847)..(847): n is a, c, t, g, unknown, or other
  misc_feature (874)..(874): n is a, c, t, g, unknown, or other
  misc_feature (889)..(889): n is a, c, t, g, unknown, or other
  misc_feature (912)..(912): n is a, c, t, g, unknown, or other
  misc_feature (943)..(943): n is a, c, t, g, unknown, or other
  misc_feature (944)..(944): n is a, c, t, g, unknown, or other
ctccccgcggtggcggccgctctagaactagtggatcccccgggctgcaggaattcgtctcacccctagaaaaaaccacacaccaccaccaccgcacacccggcggcgccaagcccttcgaccaggtagctgaccagcatcagctgagccgagcggcagatggtttcgcggccgctagaggcttagcgtcgaggaagaggaggaagcggcgtgccacatgttgagtgagcagacggcggctagcactagcactagcggcggcggcgtcgagcgtcaggacaggtggctgcagccggtggcggagaacgaggaggaggaggaggaacaggaggagttcagggacatccacgcgctgagcccgccgccgagccagccgtcgtcgtaccgccgggcgcgcggcggcgagccgtgggggtccgccccgggcgggagcaggcacacgtccgtccgctccgtcgggagcgacaccgcgccccgcgagcccttcccgactatgaccagggagttctcggcctgggtcgccgcagccgcccggcgccccagccagcccgcccgtgacgcgggaacaccaacgtcctgggggcggggccccaggagggaggagggaggaggagcctggaggaagaccaactccccgggggcgctccggggccgaaagagcaacccccattccggtcccgcgccgtgggggggctgtgctcccggccggacgtgggggggctgagagggggggggcgcttgggggggccccctctggggccgccggggagccgtggaaagcgggggaggtgttgccccccctgggcgcgcgtgtctgatggcggtggtgggggtgcttgctggtagncgcctgcgcgcctggcagagtctactncggtgggtggtcggngagggtatagcgatatctctgcnccggcccgcgtctgaggtgggccgcgcgccnnctcagagcgggtgg

SEQ ID NO: 75472 - protein, 168 aa, Zea mays
  misc_feature: Ceres CLONE 1559934
MLSEQTAASTSTSGGGVERQDRWLQPVAENEEEEEEQEEFRDIHALSPPPSQPSSYRRARGGEPWGSAPGGSRHTSVRSVGSDTAPREPFPTMTREFSAWVAAAARRPSQPARDAGTPTSWGRGPRREEGGGAWRKTNSPGALRGRKSNPHSGPAPWGGCAPGRTWGG

SEQ ID NO: 75473 - DNA, 872 bp, Zea mays
  misc_feature: Ceres CLONE 1559936
  misc_feature: Encodes the peptide sequence at SEQ ID NO. 75474
  misc_feature (349)..(349): n is a, c, t, g, unknown, or other
  misc_feature (351)..(351): n is a, c, t, g, unknown, or other
  misc_feature (356)..(356): n is a, c, t, g, unknown, or other
  misc_feature (358)..(358): n is a, c, t, g, unknown, or other
  misc_feature (360)..(360): n is a, c, t, g, unknown, or other
  misc_feature (362)..(362): n is a, c, t, g, unknown, or other
gcggtggcggccgctctagaactagtggatcccccgggctgcaggaattcgtctcacccctagaaaaagcctcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcggtgagggggaatcggggaagaggagagtgtaaggnantattnanancnacatgaggaagctggaggagctgctttctaagctgaacccctcggcggaggagttcgtgccgcagtcccgccgccgcgtggacggcggcgctccccgcctttcggccgacgcgcccgtgttcgtgtcgccggcgatcgactactacgcgcgccaccaccagttcccgccgccgccgcttctgcagcagcagcagccgatgcacgtgctgcagtttgtgggtggcgtccgccgggtttggcatgggtggccgccggggggaaggactcccaccaggacggatccggcaatggtccgccgaatcgacggaaaagggaccggtttcttccctgggaggaaaaggattaaggggtgccccggctccttcaactgaaaggggaggaagtggggcggggaacctcttattttcttgacctttgtatcgcaggtaaccgaacgaaaactggcttgagatttttttcacccggggggaaaggggtaaaattccccctcatcggggggaacccccccca

SEQ ID NO: 75474 - protein, 45 aa, Zea mays
  misc_feature: Ceres CLONE 1559936
MVAVAVDGLIRGADAVPAAEREAVRAAAAEAAAKGGEGESGKRRV

SEQ ID NO: 75475 - DNA, 809 bp, Zea mays
  misc_feature: Ceres CLONE 1559939
  misc_feature: Encodes the peptide sequence at SEQ ID NO. 75476
  misc_feature (376)..(376): n is a, c, t, g, unknown, or other
  misc_feature (440)..(440): n is a, c, t, g, unknown, or other
ctggagctccccgcggtggcggccgctctagaactagtggatcccccgggctgcaggaattcgtctcacccctagaaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctncaggagaggaaggggtcgagctcggtggcccatcagcagtacgtcgaggggaagcatggcggcnagctccccaccaactttccgcagcagctcactgtgcagctgaagaagctcgcttgcgccggcaagctgacaagggttgaaaaactccttcagctggcggccaccgaccccaagccaaaggccgcaagcccagggaaccaagggcgggccccaacccaaacccctccccaaaggaaagggccaaaccctttcaaaacccaagggggggttcccccaaccaagggcaaggccagggcaacctttttttttctggcccccctttcccaaaacccccggggggccccccccaagggtccaaaaaacccctcccccaggggcccccccccccaagggacaaaaaaaggggggtggttctcccccccaaaaaaga

SEQ ID NO: 75476 - protein, 213 aa, Zea mays
  misc_feature: Ceres CLONE 1559939
  misc_feature (54)..(118): Pfam Name: Linker_histone Pfam Description: linker histone H1 and H5 family
  misc_feature (91)..(91): Xaa is any aa, unknown, or other
MSTEEAVVAEVPVTEVPAEVPAAQVAEAPKAKKAPKEKKAPKEKKLSAAKKPAAHPPYAEMIVEAIAALQERKGSSSVAHQQYVEGKHGGXLPTNFPQQLTVQLKKLACAGKLTRVEKLLQLAATDPKPKAASPGNQGRAPTQTPPQRKGPNPFKTQGGVPPTKGKARATFFFLAPLSQNPRGAPPKGPKNPSPRGPPPQGTKKGGWFSPPKK

SEQ ID NO: 75477 - DNA, 804 bp, Zea mays
  misc_feature: Ceres CLONE 1559940
  misc_feature: Encodes the peptide sequence at SEQ ID NO. 75478
agctccccgcggtggcggccgctctagaactagtggatcccccgggctgcaggaattcgtctcacccctagaaaaaattcaccgtccaccttccatatggcgtcgagcaagatggcactcctccttgggttgatgcagcaactaaaacctgcaccggcgatatctatatgaccactccagcaactaatctcacctgaatgcttatgattccagcagcagagcggcagcagaccaacgctggatgctccaaccccaccagcgacttctacccggaccgcgacttcaacataagcgactgcagcggccataacctcaccaccgaccctctactgacgctatgcatcaacaaagccccttactaccgttacctgattaccggcatctaacgcctgaatcactactagagcaacatcaagcgcctcaccagcgactggcacagcacctggaacacctcctgtaagaaggcccgcgcctgctccggcctcagcaaggactactacttccagactgacctcagctttcgagacccagatcatgccactcgattctctcagacccaaagagagccaggccgaacttccagctcctagagctgaatggacatcaccgaggtcttcaaaagcgtgctcaatgctgacggcaagtcatccaaggcagtcatgtgccccgtacgacaacaccatgccggtacaacctctaccttctgcccaggggggcaaaggccatttctcaaagaactgccccgaaggcgggagaaaaaaccctggtttgagagaaaatcctaattcgcccctttccaagggg

SEQ ID NO: 75478 - protein, 62 aa, Zea mays
  misc_feature: Ceres CLONE 1559940
MLMIPAAERQQTNAGCSNPTSDFYPDRDFNISDCSGHNLTTDPLLTLCINKAPYYRYLITGI

SEQ ID NO: 75479 - DNA, 873 bp, Zea mays
  misc_feature: Ceres CLONE 1559942
  misc_feature: Translation starting site: 270
  misc_feature: SWISSPROT Homolog: EC 4.2.1.1 Carbonate dehydratase
  misc_feature (614)..(614): n is a, c, t, g, unknown, or other
  misc_feature (736)..(736): n is a, c, t, g, unknown, or other
ctggagctccccgcggtggcggccgctctagaactagtggatcccccgggctgcaggaattcgtctcacccctagaaaaagaaggcatccatccatccatagatccctcacctccctcactcgtgaagaaccagagaacccacccactgacccaccctcctccacctccaaggtccgttctctctcctgttcctcgtcttcgtccccgctcgcctcagcactaatctccgcacagcaacctcgctcctccgtcttggttttcctctgccatgggcgacgccgtggagcacctcaagagcgggttccagaagttcaagaccgaggtgtatgacaagaagccggagctgttcgagcctctcaaggccggccaggcccccaagtacatggtgttcgcctgctccgactcccgcgtgtgcccgtcggtgaccctgggcctgcagcccggcgaggccttcaccgtgcgcaacatcgccgccatggtcccagcctacgacaagaccaagtacaccggcatcgggtcccgcatcgagtacgccgtgtgcgcccctcaggtggaggtcctcgtcgtcatcggccacagctgctgcggtggcatccgggcgctgctctccctncaggacggtgcacccgacaacttccacttcgtcgagactggggtcagatcggcttccctgcccaggtcaaggtgagaaggagcacgcctccgtgcccttcaatgaccaatgctccattctgnaaaagaggccctttaacctgttccttgagaatcttcaagacctaccctttctttcagaaggggtggcccaagggaaccctaaaatgggtggggcccaatacaaatttgggttcggggaagttccttctatggaaaaa

SEQ ID NO: 75480 - DNA, 686 bp, Zea mays
  misc_feature: Ceres CLONE 1559944
  misc_feature: Encodes the peptide sequence at SEQ ID NO. 75481
  misc_feature (441)..(441): n is a, c, t, g, unknown, or other
ctggagctccccgcggtggcggccgctctagaactagtggatcccccgggctgcaggaattcgtctcacccctagaaaaagaaaaggagccgacgaatccacctacccgcattcgggctccagcgccaccccgtgccatcgggctgcgtccgctaacgaccgcccgttcgcgcagggcccagggtgtgggagggagcaatggtcgctgggatggaggcggaggaaggggtgatggcgacggacttcttctggtcgtacacggacgagccgcacgcgtcgcgccgccgggagatcctggccaagtacccgcagatcaaggagctcttcggcccggatccgtgggccttccctcagattggtttggtcgtgtcgcttcagctatggactgctacatttcctccgtgacgccagctgggctgaagctactgacgggtgtcctancttcttcggggtcgttttctaaaaccacaaacctgttccctgccccattcaccgaagctgaaacccacaaccctttgccttttcgcgaacccccattcccttgaaaaccgcttggggtttgggccaatttttttcccgaaaaaacccccccccattccgggggggggccccccttttgtccccattacccggttttccccccaaaaaatttccccccccccctgggggaaggcccccccaccccc

SEQ ID NO: 75481 - protein, 68 aa, Zea mays
  misc_feature: Ceres CLONE 1559944
  misc_feature (11)..(49): Pfam Name: Lipid_DES Pfam Description: Sphingolipid Delta4-desaturase (DES)
MVAGMEAEEGVMATDFFWSYTDEPHASRRREILAKYPQIKELFGPDPWAFPQIGLVVSLQLWTATFPP

SEQ ID NO: 75482 - DNA, 875 bp, Zea mays
  misc_feature: Ceres CLONE 1559946
  misc_feature: Encodes the peptide sequence at SEQ ID NO. 75483
  misc_feature (762)..(762): n is a, c, t, g, unknown, or other
  misc_feature (771)..(771): n is a, c, t, g, unknown, or other
ctggagctccccgcggtggcggccgctctagaactagtggatcccccgggctgcaggaattcgtctcacccctagaaaaaaaccgccgagcggaagcggcgccgagcaaccaacccctctcctcgtccgccgccgtctccccggaccatggccatggccgccgcctcctcccggctgctctgggcgtcccgcgccgccgcctacctcaggatctccaccttccccagggccttctccaccgtgctgaaggatctgaagtatgctgacactcatgaatgggtgaaagttgagggtgattcagcaaccgtggggattactgaccatgcccaggaccatttgggtgatgttgtttttgtggagctaccagaagttggcatcagtgtatcccagggaaagaactttggtgctgttgagagtgtgaaggcaaccagcgatatcaattcaccagtgtctggagaggtggttgaagtgaacgagaaactaagtgaggagcctggattggtgaatgcaagtccatatgagaagggatggattatcaaggtcaagctcagcaattcatgtgacctcaattcgctcatggatgatgataagtactcgaaattctgcgaagaagaagacaaccattgaagaaatcagagtgtcttctgaacaccaggacctgttttttcagctttatcagtgcttatggtctggagcttatggtctggagaccagctgtggcaaattggcaaggttcatcgcaaagaataaaatgtaggattngccaatccntacagggtatgggaaatcccagtttgtgttgtcaatgacgtggacaatttgatgtttctttgtaggtgcgatctcgagaatccttttgtttctttaaaaagact

SEQ ID NO: 75483 - protein, 159 aa, Zea mays
  misc_feature: Ceres CLONE 1559946
  misc_feature (36)..(156): Pfam Name: GCV_H Pfam Description: Glycine cleavage H-protein
MAMAAASSRLLWASRAAAYLRISTFPRAFSTVLKDLKYADTHEWVKVEGDSATVGITDHAQDHLGDVVFVELPEVGISVSQGKNFGAVESVKATSDINSPVSGEVVEVNEKLSEEPGLVNASPYEKGWIIKVKLSNSCDLNSLMDDDKYSKFCEEEDNH

SEQ ID NO: 75484 - DNA, 873 bp, Zea mays
  misc_feature: Ceres CLONE 1559947
  misc_feature: Translation starting site: 121
  misc_feature (741)..(741): n is a, c, t, g, unknown, or other
  misc_feature (751)..(751): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
aaagctggagctccccgcggtggcggccgctctagaactagtggatcccccgggctgcaggaattcgtctcacccctagaaaaagggcaaaagccaaaaggcatcaccgccgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggcgaaccagtgcccgaccatcgacggcggcgtggagtcgttcccgttcaaggccggcaagtaccagatgaagaagctgtgcctggagccgacgtccttcaccgtcaaggcggagggcatcgccaagaacgccccgcccgagttccagaagaccaagctcatgacccgcctcacgtacacgctggacgagatcgagggcccgctcgaggtcggctccgacggcacgctcagttcgaagagaaggacggcatcgactaccccgccgtcaccgtgcagctcccggggggcgagcgcgtgccgntccctctcanccgtcagcagctcgtcgccacggaaagcctgagagctttcgcgggcccttctcgtgccaattaccggggctcctccttctcgactcaaagggcnnngcggctccacggttaccacacgccct

SEQ ID NO: 75485 - DNA, 857 bp, Zea mays
  misc_feature: Ceres CLONE 1559948
  misc_feature: Encodes the peptide sequence at SEQ ID NO. 75486
  misc_feature (215)..(215): n is a, c, t, g, unknown, or other
  misc_feature (227)..(227): n is a, c, t, g, unknown, or other
  misc_feature (806)..(806): n is a, c, t, g, unknown, or other
ctggagctcaccgcggtggcggccgctctagaactagtggatcccccgggctgcaggaattcgtctcacccctagaaaaaatcacccctcgttgtcatctcatatcctgagccagagatcaaagaaaccagagggagcgaggcatggcagcaggcttgcaggtgtttggccagccggcgtctactgatgtctccagggttctgacatgcctgttngagaagaactgnagttcgatcttgtccgcatcgatacgttcagacgcatcacaagctttccgattcatcaagcttctggatcctatgggccagtgaactttaaacacgggaacaaaatctccgtttaattcaagggaattttgccgggacctcttgccccccgtttcccaaacaatggaaaaaaaagccctttttggggacccccggcctttttaaaaggggggctcaaataaaaaacatggtttttttggggggaggggtcaaaaatttttgggggcccccaaaaatctccggctttgttttttaaaaaaggggggggggttcccccccccccacaaataaaaaaaggggggggtttttttcaaggaaacccccccccctggtttttttctcccaaaaaaaaaaaagaaaaattttttaacccgggggccccttttttttttttttcttcacaaaaagatatattttttcttgaaaaaaaaaaaaaaatcttccttggtgtgggagaaaaaaaaaaatacttcttggggggaaaaaatttctccccctctccccccccaaaaagataggaggttttttatattttttttnaccccccccccccccggggagggagaaggggaaaagccccccttcttcccc

SEQ ID NO: 75486 - protein, 55 aa, Zea mays
  misc_feature: Ceres CLONE 1559948
  misc_feature: SWISSPROT Homolog: EC 2.5.1.18 Glutathione transferase
  misc_feature (24)..(24): Xaa is any aa, unknown, or other
  misc_feature (28)..(28): Xaa is any aa, unknown, or other
MAAGLQVFGQPASTDVSRVLTCLXEKNXSSILSASIRSDASQAFRFIKLLDPMGQ

SEQ ID NO: 75487 - DNA, 893 bp, Zea mays
  misc_feature: Ceres CLONE 1559950
  misc_feature: Encodes the peptide sequence at SEQ ID NO. 75488
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (368)..(368): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (374)..(374): n is a, c, t, g, unknown, or other
  misc_feature (375)..(375): n is a, c, t, g, unknown, or other
  misc_feature (378)..(378): n is a, c, t, g, unknown, or other
  misc_feature (381)..(381): n is a, c, t, g, unknown, or other
caaagctggagctccccgcggtggcggccgctctagaactagtggatcccccgggctgcaggaattcgtctcacccctagaaaaagtttggagaaatccaattttctactcacggacgccgcccctgtgcctcgccatcgcctcaggtacgcaaggcggccgaacacgagcgcccgccttcgttcttgcctgcgctgcccctctcctcgccgtttattcgggctcctacctcttgttacaacttgcgcggtgggggcagtgaggcagcaagacgtgaggtccaggatgatgaacaacaacagtggcggcggtgccggaggccctggagggggcatgggtacgggagtgggttggaaaggggnnnnacngnnngnnacnacnaacaagggctgcgctcaccgaggttcctctcatccctcatggactacacccccacgattccccgacgagctgggtggagcactaccctcgggcccgcagcgggtttccactgcccccgaccctgcgccctaaacaagaactggttggcttgtaaccaccccccaaaagttcctaaatcaaaaatttggcttagcgaatttttttttaaaacacctgcaaggggcccaggggtaacccaccccccttttcaaaagaacaaattaggagccaaacccccccccaaaggaaaaaaaacctcttggtgattataccccatgggaagaattttttttctaaaagcctttttgccccaaagacccgggcgtgggacattttaaaaaacccccgggggaattcttttttcaaaaaaaagccccctttatgggggggaaagggggccctctttcccaaccaaaaaaggggaaaaaaaactgggtataatagcccccccctttttttaaggggaaaaaata

SEQ ID NO: 75488 - protein, 88 aa, Zea mays
  misc_feature: Ceres CLONE 1559950
MDYTPTIPRRAGWSTTLGPAAGFHCPRPCALNKNWLACNHPPKVPKSKIWLSEFFFKTPARGPGVTHPPFQKNKLGAKPPPKGKKTSW

SEQ ID NO: 75489 - DNA, 894 bp, Zea mays
  misc_feature: Ceres CLONE 1559952
  misc_feature: Encodes the peptide sequence at SEQ ID NO. 75490
  misc_feature (746)..(746): n is a, c, t, g, unknown, or other
  misc_feature (762)..(762): n is a, c, t, g, unknown, or other
  misc_feature (847)..(847): n is a, c, t, g, unknown, or other
  misc_feature (866)..(866): n is a, c, t, g, unknown, or other
  misc_feature (879)..(879): n is a, c, t, g, unknown, or other
aagctggagctccccgcggtggcggccgctctagaactagtggatcccccgggctgcaggaattcgtctcacccctagaaaaaactcggcccattaaaagtaccaacttgagaacataagaacccgccaccacacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcattgtactcctcctcctcctcttcctccttcctcgacggcaagacgctgctgaggcaggccgaggcagcccggccgtccttcgccgtgcgcgccgcggcggattccgacaggccgatctggttccccggcagcacccctccgccgtggctagacggcagccttcccggcgacttcggctttgatccctggggcctcagatctgacccggagagcctgcggggaaacttgcacgcggaactggtgcactgccggtggacgatgctcggcccggcgggaatcttcatccgcgagttcctgaccaaaatcggcctcctcaaaggccccttttggaaaccgccggaaaaaaaaaatattttaccgaaacccccccccttttaatataaaactaaccctaattggattggccaaagccccccccttgggttaaaaccccctaaacccggaaaccttcaacccgaaaccctttcttccgcagaaacaaggctanccgggccccaacgggngggtacacaaagggggccctgggggtttaacccccccccgccctggggctcccggcgtttcggggaaaagaatacggtgggtttnccccccagaggaataaccngaaacgcgccgcnctccctcattgcttt

SEQ ID NO: 75490 - protein, 153 aa, Zea mays
  misc_feature: Ceres CLONE 1559952
  misc_feature (73)..(154): Pfam Name: Chloroa_b-bind Pfam Description: Chlorophyll A-B binding protein
MALVSASSSSTTAVAALPRNGQQRASSSLYSSSSSSSFLDGKTLLRQAEAARPSFAVRAAADSDRPIWFPGSTPPPWLDGSLPGDFGFDPWGLRSDPESLRGNLHAELVHCRWTMLGPAGIFIREFLTKIGLLKGPFWKPPEKKNILPKPPPF

SEQ ID NO: 75491 - DNA, 769 bp, Zea mays
  misc_feature: Ceres CLONE 1559953
  misc_feature: Encodes the peptide sequence at SEQ ID NO. 75492
  misc_feature (94)..(94): n is a, c, t, g, unknown, or other
tggagctccccgcggtggcggccgctctagaatagtggatcccccgggctgcaggaattcgtctcacccctagaaaaaaccagcggcatctatnagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgaagtccccggcgactacggctgggacaccgccgggctgtccgccgacccccgagactttcgcccagaaccgcgagctggaaggtgatccactccccgctgggccatggctcggggcgctcggctgcgttctcccccgagctgctctccggcaacggcgtccagttccgggagggccgtctgggtcaaaggcgggtttcccaaatcttaaaggagggccggggttgaaatacctttgggaaaccccccccctgaacccccccccaaaaaaaacccccgccaatttggggcccttcccaggccctgtccctaggggcccccctccaagggcctcccccattttccccggggggccccctcccgggaagggctccccaaacccctttttacccccgggggggagaatttataaacccccccccgggtg

SEQ ID NO: 75492 - protein, 91 aa, Zea mays
  misc_feature: Ceres CLONE 1559953
MAISSTAMAGTPIKVGSFGEGRITMRKTVGKPKVAASGSPWYGPDRVKYLGPFSGEPPSYLTGEVPGDYGWDTAGLSADPRDFRPEPRAGR

SEQ ID NO: 75493 - DNA, 840 bp, Zea mays
  misc_feature: Ceres CLONE 1559957
  misc_feature: Encodes the peptide sequence at SEQ ID NO. 75494
  misc_feature (620)..(620): n is a, c, t, g, unknown, or other
  misc_feature (686)..(686): n is a, c, t, g, unknown, or other
  misc_feature (706)..(706): n is a, c, t, g, unknown, or other
  misc_feature (799)..(799): n is a, c, t, g, unknown, or other
ggagctcaccgcggtggcggccgctctagaactagtggatcccccgggctgcaggaattcgtctcacccctagaaaaaattctcatccccgcgcacaacggcgccggcaacagcattagcaacctaacccgcccaaccgacacacttcaacagtcaacacactgtacacccgaccggaccctcccaccacccatgggcctgtgcgtgtcgctcggcgggacggccggcgccgaggccgcgcgggcggcggcgcccagctgcaactgcggcacggcgctggtgctcatgcccagcggcgacatgcgggagtaccctttcccggcgacgacggccgcgcgcgtgctggaggacgcctccgccgccgccgacggcggcgatggctggctcctgtgcgacgcggacgggatgggcttcgagggcccggcccccgccggcggtgccccacgcggagccgctccgcgcggggcagctctacttcgtgctcccggccgccgcgcgccgccgcggcctgcggcgcgaggaggtcgccgcgctcgccgtccgggcctcggccgcgctctcctcccgggcctccgcatccgcctccgccgcgccgggaaggcggaggcgcggcgccgtcntcgcgcccctcgtcttcgcgccaccgccggaggacgaagaggaggagcgcgagcagcagaatcacnggccttggcggcgccaccgntgcggcggcccgcgcgccccggcaggcgcctcgtgcggttcgcgtcggacctcacggcgattcccgagtgagtaagcgggtcgggctcagacngacgggaacggattcgctgccattgaattggctctgggacg

SEQ ID NO: 75494 - protein, 194 aa, Zea mays
  misc_feature: Ceres CLONE 1559957
  misc_feature (143)..(143): Xaa is any aa, unknown, or other
  misc_feature (165)..(165): Xaa is any aa, unknown, or other
  misc_feature (172)..(172): Xaa is any aa, unknown, or other
MGLCVSLGGTAGAEAARAAAPSCNCGTALVLMPSGDMREYPFPATTAARVLEDASAAADGGDGWLLCDADGMGFEGPAPAGGAPRGAAPRGAALLRAPGRRAPPRPAARGGRRARRPGLGRALLPGLRIRLRRAGKAEARRRXRAPRLRATAGGRRGGARAAESXALAAPPXRRPARPGRRLVRFASDLTAIPE

SEQ ID NO: 75495 - DNA, 873 bp, Zea mays
  misc_feature: Ceres CLONE 1559958
  misc_feature: Encodes the peptide sequence at SEQ ID NO. 75496
  misc_feature (666)..(666): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (673)..(673): n is a, c, t, g, unknown, or other
  misc_feature (678)..(678): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (696)..(696): n is a, c, t, g, unknown, or other
  misc_feature (740)..(740): n is a, c, t, g, unknown, or other
  misc_feature (837)..(837): n is a, c, t, g, unknown, or other
  misc_feature (860)..(860): n is a, c, t, g, unknown, or other
ctggagctccccgcggtggcggccgctctagaactagtggatcccccgggctgcaggaattcgtctcacccctagaaaaaagacatgtgcatctcagcagcactagcagtgacaaactcgaagcttgccttcttgtttacaccctaaaactaaaactagagtcgtcggcggcaacaagcggtacgtacgtagaggatgaagagcaggagcagcactctgttggtgatcctagttctccaggcccttctgctctctgcggctgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtgtccacgggcaagggcgccaccaagtacaggtgccgcgacttcctccccgaaaactgcgggtgcaagatccactaaactcatccaattccaccatggccacagcagccgatggatccttcttccatatgcatgttctcctccgtccgtccgcctagctttgctacaagcaggcgctaataagcaagctgctgttgttgttttgcatgtttgattaggtgaccctttccactcgagatggaataaaataaacgtcaggcgcactgtactgacgtgttnttnnnanagaanactgatcttgannngatnaagctgacaacggcatacgtgcggttcggcaacagagcaagaangagaaccagtgtgctagtgctacagctacggcctagctacctactacggcgcagctaagcacggcggccatgaccgacgggcgcgaggaagcaccancagcaggtgggcccaactggccnccctgcgcgcctg

SEQ ID NO: 75496 - protein, 89 aa, Zea mays; identical to SEQ ID NO: 73295
  misc_feature: Ceres CLONE 1559958

SEQ ID NO: 75497 - DNA, 884 bp, Zea mays
  misc_feature: Ceres CLONE 1559964
  misc_feature: Encodes the peptide sequence at SEQ ID NO. 75498
  misc_feature (664)..(664): n is a, c, t, g, unknown, or other
  misc_feature (767)..(767): n is a, c, t, g, unknown, or other
  misc_feature (786)..(786): n is a, c, t, g, unknown, or other
ctggagctccccgcggtggcggccgctctagaactagtggatcccccgggctgcaggaattcgtctcacccctagaaaaatcgccccccactcagactcagccactgctgcagtccgccggctagtacacgtacgacaggctgtaccgaggttcagttcggtagtgtagttgtaggttgcgatggcgaggcggctgctggcggcggtcgccatagtagtcgtggccgccgcgctcgcgtgcggcgcgggcgcgcagctctcggcggggttctactcgtcgagctgccccgccgtgcacagcatcgtgcgccaggccatgtcgcaggccgtcacgaacaacacgcgcagcgccgccgccgtgctccgcgtcttcttccacgactgcttcgtcaatggctgcgacgcctcgctgctgctggacgacacgcccacgacgcccggcgagaagggcgccggccccaacgccggcggctccaccgtcggcttcgacctcatcgacaccatcaaggcgcaggtcgaggccgcctgccccgccaccgtctcctgcgccgacatcctggcgctcaccgcgcgcgacggcgtcaacctgctcggcggcccgagctgggccgtgccgctgggccggcgcgacgcgacgttccccaacagcacgggcgcggcgacngacctcccgggcccggactccgacctggccggcctggtggccgggttcgccgccaagggcctgagcccgcgcgacctcgcggcgctgttgcgcaaaaaaaaangggggggaagaggtggggncttttgccaattttttcccaccccggttttacggggacgaaacacctggagcccggggggttcgccgggcaagcacgccccgggcctgccccgtcggg

SEQ ID NO: 75498 - protein, 234 aa, Zea mays
  misc_feature: Ceres CLONE 1559964
  misc_feature (42)..(210): Pfam Name: peroxidase Pfam Description: Peroxidase
  misc_feature: SWISSPROT Homolog: EC 1.11.1.7 Peroxidase
  misc_feature (196)..(196): Xaa is any aa, unknown, or other
  misc_feature (202)..(202): Xaa is any aa, unknown, or other
MARRLLAAVAIVVVAAALACGAGAQLSAGFYSSSCPAVHSIVRQAMSQAVTNNTRSAAAVLRVFFHDCFVNGCDASLLLDDTPTTPGEKGAGPNAGGSTVGFDLIDTIKAQVEAACPATVSCADILALTARDGVNLLGGPSWAVPLGRRDATFPNSTGAATDLPGPDSDLAGLVAGFAAKGLSPRDLAALLRKKKXGGRGGXFCQFFPTPVLRGRNTWSPGGSPGKHAPGLPRR

SEQ ID NO: 75499 - DNA, 875 bp, Zea mays
  misc_feature: Ceres CLONE 1559965
  misc_feature: Encodes the peptide sequence at SEQ ID NO. 75500
  misc_feature (647)..(647): n is a, c, t, g, unknown, or other
  misc_feature (651)..(651): n is a, c, t, g, unknown, or other
  misc_feature (668)..(668): n is a, c, t, g, unknown, or other
  misc_feature (669)..(669): n is a, c, t, g, unknown, or other
  misc_feature (686)..(686): n is a, c, t, g, unknown, or other
  misc_feature (695)..(695): n is a, c, t, g, unknown, or other
  misc_feature (704)..(704): n is a, c, t, g, unknown, or other
  misc_feature (705)..(705): n is a, c, t, g, unknown, or other
  misc_feature (730)..(730): n is a, c, t, g, unknown, or other
ctggagctccccgcggtggcggccgctctagaactagtggatcccccgggctgcaggaattcgtctcacccctagaaaaaaaaaaaaaaaaaaaaagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtggggaaagctgctggcgacaggtggaaatccctgagcgagtcggacaaggctccctatgtagccaaggctaaatcagctcagctcgagtacaacaaggccatcgctgcctactacaagggcgagagcactgcagctaagaaggctcctgccagggaggaagaagaggaagatnaagnagagtctgacaagtccnnagtcgagggtcatgacnaggatgatnaaaagggtnntgggggggaataaaaattattaccnagtgttgggacctcctcgaggaaatgggacgtgcttcatcaacaagggggggggttatcccagggccccggggggaattccaaaaagggacccttattcccggtcccaagaatttttcgttcccctcccaatcgggaggtttttt

SEQ ID NO: 75500 - protein, 152 aa, Zea mays
  misc_feature: Ceres CLONE 1559965
  misc_feature (41)..(110): Pfam Name: HMG_box Pfam Description: HMG (high mobility group) box
  misc_feature (130)..(130): Xaa is any aa, unknown, or other
  misc_feature (131)..(131): Xaa is any aa, unknown, or other
  misc_feature (137)..(137): Xaa is any aa, unknown, or other
  misc_feature (143)..(143): Xaa is any aa, unknown, or other
  misc_feature (146)..(146): Xaa is any aa, unknown, or other
  misc_feature (149)..(149): Xaa is any aa, unknown, or other
MKGAKSKGAAKADAKLAVKSKGAEKPAKGRKGKAGKDPNKPKRAPSAFFVFMEEFRKEFKEKNPKNKSVAAVGKAAGDRWKSLSESDKAPYVAKAKSAQLEYNKAIAAYYKGESTAAKKAPAREEEEEDXXESDKSXVEGHDXDDXKGXGGE

SEQ ID NO: 75501 - DNA, 1187 bp, Zea mays
  misc_feature: Ceres CLONE 1559971
  misc_feature: Encodes the peptide sequence at SEQ ID NO. 75502
atccatccatccatccacacacacaaacagacagacagacaagcatacaacaccgttgccatttagttgtgttcttgctaggcagttgcgcacttacattgagccgcagctagctgtctacggcacaactatctcctgcgcgcgtgctcgatctgaagctaggccagacctgagcctgtccaattttgccttgttctacccaccggtagtcgagaaggttccataagcgcaagcagacagcaaaagagctaaggggtctgagacaaggttcgaacagatggaggatgtggtgaagttcgcctttggagtttctggaaatgtcatcgctctcttcctcttcctgtccccagtgcctacgttctggaggatcatcaggaggaagtcgacggaggatttctcaggggtgccgtacagcatgacactcctcaactgcctcttgtcagcttggtacgggctgccgttcgtgtccccgaacaacatgctggtgtcgacgatcaacggcgcgggcgcggcgatcgaggccgtgtacgtggtgatcttcctgggcgttcgcgtccagccagcggacgcggctgcggatgctggggcctggcgtcggcggttctcggcggcgttcgccgccgtggcgctggcgtcgatgctggcgctgcacggacagggccggaagctcatgtgcggcctcgccgccaccgtctgctccatctgcatgtacgcctcgccgctctccatcatgaggctggtggtgaagaccaagagcgtggagtacatgccgttcctgctgtcgctggccgtgttcctgtgcggcacgtcctggttcgtctacggcctgctcggccgggaccccttcgtcgcgattcccaacgggtgcgggagctttctgggcgcagtgcagctggtcttgtacgccatctaccgcgacagcaacagcggcggcaagcagcaggccggcgacgacgtggagatggcctccgacgccaagagcagcaagaaggtcgccgacgacgtcggcggcaaggaggaccgcctggtctagcatggagctagccactttctctttcggtgcgcgagcgtatgtttcctccccccgtgattgtgtgtgtgtgcatgtatacgagagtgcgtgctgtactgtactacctctgcgtgtgtgcaataatgtaactgggtgtttcatctcgcaatcgggt

SEQ ID NO: 75502 - protein, 251 aa, Zea mays
  misc_feature: Ceres CLONE 1559971
  misc_feature (131)..(217): Pfam Name: MtN3_slv Pfam Description: MtN3/saliva family
  misc_feature (7)..(96): Pfam Name: MtN3_slv Pfam Description: MtN3/saliva family
MEDVVKFAFGVSGNVIALFLFLSPVPTFWRIIRRKSTEDFSGVPYSMTLLNCLLSAWYGLPFVSPNNMLVSTINGAGAAIEAVYVVIFLGVRVQPADAAADAGAWRRRFSAAFAAVALASMLALHGQGRKLMCGLAATVCSICMYASPLSIMRLVVKTKSVEYMPFLLSLAVFLCGTSWFVYGLLGRDPFVAIPNGCGSFLGAVQLVLYAIYRDSNSGGKQQAGDDVEMASDAKSSKKVADDVGGKEDRLV

SEQ ID NO: 75503 - DNA, 840 bp, Zea mays
  misc_feature: Ceres CLONE 1559982
  misc_feature: Encodes the peptide sequence at SEQ ID NO. 75504
  misc_feature (491)..(491): n is a, c, t, g, unknown, or other
ctccccgcggtggcggccgctctagaactagtggatcccccgggctgcaggaattcgtctcacccctagaaaaatagcaactctctcgagtcgattcctaagcagctagccagtgactcgatcttagcgtgctacaatggcggcagctgctagtgccctgctcctcctgctctgctcagccttctgctcccttgcccaccgggcggccggcgtcgactacggctcgtggcagagcgcccacgccacgttctacggcggcggcgacgcgtctggcacgatgggcggcgcgtgcggctacgggaacatgtacagcacggggtacggcaccaacacggcggcgctgagcacggcgctgttcaacgacggcgccgcgtgcgggtcctgctacgagctgcgctgcgacaacaacgggcagtcgtgcctgccgggcaccatcaccgtcacggccaccaacttctgcccgcccaactacggcctccccagcgacgacngcggctggtgcaacccgccgcgcccgcacttcgacatggcccagccggccttcctccagatcgcgcagtaccgcgccggcatcgtgcccgtcgcctacaggaggtgaggtttacttattatatttctcgtcggtttcgagctctcgtcatctcacgcactgaacggccggtcccagagacgagagaatagagacctgtgtggtgtggccgtgccgggtgtcggtttcttaaattcagaagtcggaccacgaccaaatatgtaaccaacggctggggttcaggccatgttacgtgggccagcaggcagaatatctttcctttttctttttggtcgggcttgttccgtcgg

SEQ ID NO: 75504 - protein, 153 aa, Zea mays
  misc_feature: Ceres CLONE 1559982
  misc_feature (66)..(151): Pfam Name: DPBB_1 Pfam Description: Rare lipoprotein A (RlpA)-like double-psi beta-barrel
  misc_feature (119)..(119): Xaa is any aa, unknown, or other
MAAAASALLLLLCSAFCSLAHRAAGVDYGSWQSAHATFYGGGDASGTMGGACGYGNMYSTGYGTNTAALSTALFNDGAACGSCYELRCDNNGQSCLPGTITVTATNFCPPNYGLPSDDXGWCNPPRPHFDMAQPAFLQIAQYRAGIVPVAYRR

SEQ ID NO: 75505 - DNA, 865 bp, Zea mays
  misc_feature: Ceres CLONE 1559983
  misc_feature: Encodes the peptide sequence at SEQ ID NO. 75506
  misc_feature (479)..(479): n is a, c, t, g, unknown, or other
  misc_feature (557)..(557): n is a, c, t, g, unknown, or other
ctccccgcggtggcggccgctctagaactagtggatcccccgggctgcaggaattcgtctcacccctagaaaaaatcctgtccccctcccacctttcccttccccgccgctctcgcttcgcttgcccgcacaccgagatttcctgcccgctcgttccgctgctctcatggactcctcctgcgtgcctgccgaccggtccgaggcacgccgcggcggaggctctgccggccgggtcgtcggattcggccttaggttggttggttgggttgggtcgcatgtccacggcggtggcgcggccggcgcactgcggattccggcggtcggggagcgggaagccggatccagacgaggcggacaggatgacgcggagcgccaacgggtacttggtccaataagatgaggaggaagagcatggccaagaggcggcggcgaggacagaggatgaggaccaggaatatgaacaggaggatgcggacgcngtgtcggaggcctcgtctatctgggacgcgtcctccgacagcttctacatcatcgaggagaacttcgcgtcccatcangaggaagaggacgaggatgttgcacattagggcccagggggcttggcatgactggggctggcccccctcgaatccttggatgaggccttgccctccaagggggggctgtcccccttttacgcgggaaaatccaattctttccgagccccgggaaagcccccgtttccgggtccccaggggaaaccccaccccgaaaacccttccacagggggtcgccgttttaagggggggccccgggggaagggttttcccttcctttggggcccgggatttcccccggggtgcgcccgaaaccccccggggggaga

SEQ ID NO: 75506 - protein, 39 aa, Zea mays
  misc_feature: Ceres CLONE 1559983
MSTAVARPAHCGFRRSGSGKPDPDEADRMTRSANGYLVQ

SEQ ID NO: 75507 - DNA, 841 bp, Zea mays
  misc_feature: Ceres CLONE 1559984
  misc_feature: Encodes the peptide sequence at SEQ ID NO. 75508
  misc_feature (718)..(718): n is a, c, t, g, unknown, or other
  misc_feature (732)..(732): n is a, c, t, g, unknown, or other
  misc_feature (783)..(783): n is a, c, t, g, unknown, or other
ctccccgcggtggcggccgctctagaactagtggatcccccgggctgcaggaattcgtctcacccctagaaaaactcagcaacggcatcagcgtcttcccctccctcgtctcgtcaatcccctcgcgccctctcctccggtcctccgcacacggcacaccgtccggtgaccctgcgtgcgtgcctccctctctccttccgcctccggtaccggccccagcggctgcgctgcgcgccgcgcgcgggctgctggcagcgggagcgagcagctgctgctccacaaggcggtcgcgccgctttgggagcgcctgtgctccaaagcgaagctttacccgtctgcttagcgctgatgcgtgcgcttagtgccacttttttggaaccctgggttgagcatggagcatttacctgattttgttaccaatttctgctagtaatagttattttggacacagaatggaagggcgccgctcaaatgaagtatcatctgccgaagctgtcttgggtgggagcattgtcgtctggtgtcaatgctcccacgtgttttgtgctcaagattacgtttttgctccttgcattgtgttttacggctatgcttgctctagcattttcgtcgaagaactttgtaatcgttgcacatgttcttctgctggtgactattggaaccgtgctatttgtgctgcttaacaggtttctggctgaagttgggctcgtgcctgttngacagcagatgaangagatgggcatccacaaacagaagctctgatgaggaccagagaaattaatnggtgacacttttttttttgatatggaaagcgtttaacatttcatggacagagtgactt

SEQ ID NO: 75508 - protein, 96 aa, Zea mays
  misc_feature: Ceres CLONE 1559984
  misc_feature (83)..(83): Xaa is any aa, unknown, or other
  misc_feature (87)..(87): Xaa is any aa, unknown, or other
MKYHLPKLSWVGALSSGVNAPTCFVLKITFLLLALCFTAMLALAFSSKNFVIVAHVLLLVTIGTVLFVLLNRFLAEVGLVPVXQQMXEMGIHKQKL

SEQ ID NO: 75509 - DNA, 874 bp, Zea mays
  misc_feature: Ceres CLONE 1559987
  misc_feature: Encodes the peptide sequence at SEQ ID NO. 75510
  misc_feature (798)..(798): n is a, c, t, g, unknown, or other
agctccccgcggtggcggccgctctagaactagtggatcccccgggctgcaggaattcgtctcacccctagaaaaaatgtgatgatgtgaatgaaggtctgaaaaaaatcacagaactcactcgaacgacggtgccgccgcttgcctcgcctgaccatggccgctgtgccgtcgaggttcctcctcgtcactggcccgccgggcgtggggaagacgacgctggtcatgcgggtgtttgaaaccctcagaggctcccacccgaacctcaacattcgcggattctatacccgagaggtgagagagggcggagaaaggataggattcgaggttgtcacgctagacggtagaactggaccactttcctcatgcaaggtttccagcccggagtctgttagatggcctaccgtcgggaaatacaaagtagacgtagcatccttggaatcattagcagtacctgagctgcaggttaaggaagaaacagatctcttcatcattgacgaagtgggtaaaatggagctgttcagttcagcatttttccctgcggtaatgagagttattgaatccaatataccagtgttggccaccataccgattcctaggcagggccgggacattccaggagttgcgaggttgcggaatcatcctggagcagctgttttcaccttagacactggtaacagagatacgatgagagatactatctgcagtcagttaaggagtgtgttgcagaagaggtgatctgctagcctcccttcgtctctgcggccgctgctttgtctgacatgaacacatacgatnaaagagtagaagttttctctcagcatgatctcatattctgcaacagacatgcggtcgagtctttctgtgcagtacc

SEQ ID NO: 75510 - protein, 193 aa, Zea mays
  misc_feature: Ceres CLONE 1559987
  misc_feature (47)..(188): Pfam Name: DUF265 Pfam Description: Protein of unknown function, DUF265
MAAVPSRFLLVTGPPGVGKTTLVMRVFETLRGSHPNLNIRGFYTREVREGGERIGFEVVTLDGRTGPLSSCKVSSPESVRWPTVGKYKVDVASLESLAVPELQVKEETDLFIIDEVGKMELFSSAFFPAVMRVIESNIPVLATIPIPRQGRDIPGVARLRNHPGAAVFTLDTGNRDTMRDTICSQLRSVLQKR

SEQ ID NO: 75511 - DNA, 854 bp, Zea mays
  misc_feature: Ceres CLONE 1559988
  misc_feature: Encodes the peptide sequence at SEQ ID NO. 75512
  misc_feature (615)..(615): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (693)..(693): n is a, c, t, g, unknown, or other
  misc_feature (750)..(750): n is a, c, t, g, unknown, or other
  misc_feature (791)..(791): n is a, c, t, g, unknown, or other
  misc_feature (806)..(806): n is a, c, t, g, unknown, or other
agctccccgcggtggcggccgctctagaactagtggatcccccgggctgcaggaattcgtctcacccctagaaaaaatccactgcggcacgcgtcccgcctctggtttgcttgcctcccagatcttgccaactaattggaggcagccgagctgatctcccatcccgcaacgcgccgtctcgacggcggatcgttttcttctgcttctactgcgtgatctttgggcaagaagataagacacgtccaagcgtcgccacagtcaagggcggcttggttgcagtcaagatggggaaggacagagaatctgccaagctgaaggaggagaaggggtccaaggatgagatccatatgaaggtcaagagcaagggcgagccgtccggcgaggaagacggcaaggaggaggtcgaggtagagattgaggccaagtttgttgagaaggaagaggtcacaggctcgggtgacggtgcgggggggaaagggtaccaagaagaaggatacaaaggagaaagacaagaaaaagaaggaaggtggtgacgattcagggaaggcagaggaagacaataagggtaaagcgaaggattcggagggcaagggccaagtgaagaaggaaaagaangatggtgctggggacgacggaggcgaggagaaggcaannnaaagaaagataagaaggacaagggtgagaagaatgacnaggagaagaaaagagagaagaaagaccagggcgccaaggagaagacgaccgatcccngtgagctcagagcaagctgggagaggtggacaccaaactgncagacctacatgccnaagagagagatatccctgagcagcttaaagagctggatctggaaggag

SEQ ID NO: 75512 - protein, 82 aa, Zea mays
  misc_feature: Ceres CLONE 1559988
MGKDRESAKLKEEKGSKDEIHMKVKSKGEPSGEEDGKEEVEVEIEAKFVEKEEVTGSGDGAGGKGYQEEGYKGERQEKEGRW

SEQ ID NO: 75513 - DNA, 871 bp, Zea mays
  misc_feature: Ceres CLONE 1559989
  misc_feature: Encodes the peptide sequence at SEQ ID NO. 75514
  misc_feature (575)..(575): n is a, c, t, g, unknown, or other
  misc_feature (590)..(590): n is a, c, t, g, unknown, or other
  misc_feature (602)..(602): n is a, c, t, g, unknown, or other
  misc_feature (710)..(710): n is a, c, t, g, unknown, or other
ggagctccccgcggtggcggccgctctagaactagtggatcccccgggctgcaggaattcgtctcacccctagaaaagcgccatcaccacgcacctcggcatcgggtcgtactgcgagtggcccgaggacaagaggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccctcggacgtgctcgccgtggagctcctgcagcgcgagtgcggcgtgcgccagccgctgcccgtggtgccgctgttcgagaggctggccgacctgcagtcggcgcccgcgtccgtggagcgcctcttctcggtggactggtacatggaccggatcaagggcaagcagcaggtcatggtcggctactccgactccggcaaggacgccggccgcctgtccgcggcgtggcagctgtacagggcgcaggaggagatggcgcaggtggccaagcgctacggcngtcagctcaccttgntcccacggcgcngaggcaccgtgggcaggggtggcgggcccacgcaccttggcatcctgtcccagcccgccgacccatcaacgggtccatccgtgtgaccgtgcagggcaaggtcatccnagtctgcttccggggaagaacacctgtgcttccagattttgcaggctttcgggcccccaccctggaaaccgggaaggcccccgccggtttttcccaagcccgagtggcccaaccccagggacaaaaaaggcgggctgggcccacggaggaattcccgttcc

SEQ ID NO: 75514 - protein, 134 aa, Zea mays
  misc_feature: Ceres CLONE 1559989
  misc_feature: SWISSPROT Homolog: EC 4.1.1.31 Phosphoenolpyruvate carboxylase
  misc_feature (98)..(98): Xaa is any aa, unknown, or other
  misc_feature (103)..(103): Xaa is any aa, unknown, or other
  misc_feature (107)..(107): Xaa is any aa, unknown, or other
MATAPSDVLAVELLQRECGVRQPLPVVPLFERLADLQSAPASVERLFSVDWYMDRIKGKQQVMVGYSDSGKDAGRLSAAWQLYRAQEEMAQVAKRYGXQLTLXPRRXGTVGRGGGPTHLGILSQPADPSTGPSV

SEQ ID NO: 75515 - DNA, 859 bp, Zea mays
  misc_feature: Ceres CLONE 1559990
  misc_feature: Encodes the peptide sequence at SEQ ID NO. 75516
ggagctccccgcggtggcggccgctctagaactagtggatcccccgggctgcaggaattcgtctcacccctagaaaaaaaaagaagttgaaccatggggaagagaaagtcagctgctaagccacctcctaagaagcggatggacaagcttgacactgtcttttcctgcccattctgcaaccacgggagtagtgttgagtgccaaattgacatgaagaatctgattggcgaagcatcttgtagaatctgtcaggaaaacttcagcacaactgttaatgatatagtgaatggattgacgagtgtgagcgtgtcaacactgttgaaggcgacgatgatgcgtgagcttgccccatgcgatgaaactgttacctacaatcgtaatgtaatgtgctggtattctcgaatgccatagcccatagtcagccatggcttggaataacgtagtggctgactgatatgccagtaggcaccttatctagtacttacagaactaaaaaaagtttgtactatacatatatggacaaccttataagtggctatgtgtatacctatcctaacgcttatcccagatggtgtatcagcgtttttctgtgagattgtttttcagcaagggggtgttcattcattgggtcttctcaggaaaaaagaattatgctgcagttaaacagatggccgctgttgcgtcaaccatatagggaaaacaaatgcaacccctgcagcgaaagaaattcatagaaaaaatttgttttcagttcattcaacgcttaaaagcagtttccgcctggaggctgaacttttggaatcattggagggcagccttttaacccctgggagaaccgccccattagttttttcccccc

SEQ ID NO: 75516 - protein, 105 aa, Zea mays
  misc_feature: Ceres CLONE 1559990
  misc_feature (8)..(68): Pfam Name: Elf1 Pfam Description: Transcription elongation factor Elf1 like
MGKRKSAAKPPPKKRMDKLDTVFSCPFCNHGSSVECQIDMKNLIGEASCRICQENFSTTVNDIVNGLTSVSVSTLLKATMMRELAPCDETVTYNRNVMCWYSRMP

SEQ ID NO: 75517 - DNA, 783 bp, Zea mays
  misc_feature: Ceres CLONE 1559992
  misc_feature (537)..(537): n is a, c, t, g, unknown, or other
  misc_feature (540)..(540): n is a, c, t, g, unknown, or other
ctggagctccccgcggtggcggccgctctagaactagtggatcccccgggctgcaggaattcgtctcacccctagaaaaaatcgccgcctgctctctacctctgcactccaatcagatcatcagatagatcactggccccgtgctgattaccgcgcttcccatctgagcagccagcctcccagggtacagggagagacgcagaagagacagctgctgcctcgctgagacgatggccggaggcggagaccactcccagacgaacggaggccacgtcgaccagagggccttggaggagggcaggaaggaggagttcgctgaccagggctgcgccgccatgggtcgtctcccgtcccatttatccagaagatcatcgcggagatcttcggcacctaacttcctgatgtttccccggggggtgccgcccccgggttaccaatttaaaccgcagagaaaaaaaaggggggaaaaattacctttttctcccgggggggggggggggaaaatatttttgggggggggcgggccccccccccccnagntggggtgggggggtggtggttccccccgggggggaaaaaattttttgggggggggggtttttaaaaataaggggggggaaggatattttttttttttttcccccacaaaaaagggggggtcttcccgggggggggggggcccccccccccctatttttttttggggaaaaaaaaaaggggggcgggggcccctcccccccccccggggggggggagggggtccttttttttttggtggggggg

SEQ ID NO: 75518 - DNA, 884 bp, Zea mays
  misc_feature: Ceres CLONE 1559993
  misc_feature: Encodes the peptide sequence at SEQ ID NO. 75519
  misc_feature (769)..(769): n is a, c, t, g, unknown, or other
  misc_feature (777)..(777): n is a, c, t, g, unknown, or other
  misc_feature (781)..(781): n is a, c, t, g, unknown, or other
  misc_feature (884)..(884): n is a, c, t, g, unknown, or other
ctggagctccccgcggtggcggccgctctagaactagtggatcccccgggctgcaggaattcgtctcacccctagaaaaaacttcccgtgtttctaactccggtggctccaccactagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccagagaattgctataccaacaccagcataacaaaaggatgagctaccctgccatggcacagctcctctccaataccctgtactacaagcgcttcttcccatattacgccttcaatgtgctcggtgggcttgacagcgaggggaaagggtgtgttttcacctatgatgcagtaggttcctatgagagaactggttatagtgctcagggaacgggatctactttgattatgccagtcctggacaatcaactaaaatcaccaagtcctctattgctccctgccagggatgctgtcacaccattgtcggagtcagaagccatcgatctagttaaggatgtgtttgcatctgcaactgagagagacatctacactggagacaagtttggaaattgtagtcnatcacaangtcnggactaagcgtcgagtacatcgactcctgaggaagacctaggccaacgcttcagttgtagctgcagctgtcatttggcttccgacatgtttcctagtctaggn

SEQ ID NO: 75519 - protein, 211 aa, Zea mays
  misc_feature: Ceres CLONE 1559993
  misc_feature (10)..(206): Pfam Name: Proteasome Pfam Description: Proteasome A-type and B-type
  misc_feature: SWISSPROT Homolog: EC 3.4.25.1 Proteasome endopeptidase complex
  misc_feature (206)..(206): Xaa is any aa, unknown, or other
  misc_feature (209)..(209): Xaa is any aa, unknown, or other
  misc_feature (210)..(210): Xaa is any aa, unknown, or other
MSRRGDWVYENNGGTCVAIAGADYCVVAADTRLSVGYSILTRDHSKICDLADKCVLASSGFQGDIKALHKNLAARELLYQHQHNKRMSYPAMAQLLSNTLYYKRFFPYYAFNVLGGLDSEGKGCVFTYDAVGSYERTGYSAQGTGSTLIMPVLDNQLKSPSPLLLPARDAVTPLSESEAIDLVKDVFASATERDIYTGDKFGNCSXSQXXD

SEQ ID NO: 75520 - DNA, 854 bp, Zea mays
  misc_feature: Ceres CLONE 1559994
  misc_feature: Translation starting site: 142
  misc_feature: SWISSPROT Homolog: EC 6.1.1.22 Asparagine--tRNA ligase
  misc_feature (781)..(781): n is a, c, t, g, unknown, or other
ctggagctccccgcggtggcggccgctctagaactagtggatcccccgggctgcaggaattcgtctcacccctagaaaaaaggaaattaagcttacagccccacaccgacaccgccggccaccgccatcgcctcgctgccgatggcggccgccgccgccgcccggatcctccgcttggccccgcgccggatccaggttcccaagacctccccgctcgccgcactctcgttcccactccctcgaacggcgccgatcgccgctgccttggggaggcggcagcgcttctgcgccgtggcgcaggcccccgcccccgcccccgcagccgcggcgacaggggcggcgggagaggccgtgggggagttcaggaagcggctgcgggtggcggacgtgaagggcggggaggacgagggcgccgcgtgggtgggcaaggagctcgccgtgcgcgggtgggtgcgcacctgccgcgcccagaggaccataaccttcgtcgaggtcaatgatggctcttgcttatccaatatgcaatgtgtattgactcctgaaacagaaggctatgaccagatagactctgtcactactggagcatctgtactagttgaagggagtttgttgcagcagccaaggcggtaagcaaaaagtggagttgaaggtttcaaagatcaccgtgatttggtaagagtgaccccacatctttttctatacagaggaaacggggcatcagagaattccttaagaccgtagcccatctccgtcctcggacaaacacttttggtgcagttgncagagtgagaaatactctggcatacgcaactcataaattctttttcagacatggggattgttgggggttcgaa

SEQ ID NO: 75521 - DNA, 843 bp, Zea mays
  misc_feature: Ceres CLONE 1559996
  misc_feature: Encodes the peptide sequence at SEQ ID NO. 75522
  misc_feature (637)..(637): n is a, c, t, g, unknown, or other
  misc_feature (655)..(655): n is a, c, t, g, unknown, or other
  misc_feature (687)..(687): n is a, c, t, g, unknown, or other
ctggagctccccgcggtggcggccgctctagaactagtggatcccccgggctgcaggaattcgtctcacccctagaaaaattcccttcgtgcttgtttgctctagggtttttgccacgccgccgccgctctgccccttccaccccaccgatataccaagatgacggcgcaggctgcggaggagctcgccgcccagatcgagcagcagaagctcgaggagcagaagaccgaggcagaagaggttgtggtggaggaggatgacgaggatgatgaggatgacgatgatgatgacaaggatgatgatgaactggatggacaagaaggggatgggagtggcaagtcgaagcaaagcaggagtgagaagaagagccgcaaggccatgctgaagcttggcatgaagcccatcactggtgtcagccgggtcactgtgaagaaaagcaagaatatgctttttgtcatctcgaagccagatgtgttcaagagcccaaactcggacacctatgtcatattcggcgaggcgaagatcgaggacctcagctcccagctgcagacccaagctgcagagcagttcaaggctcctgacctgagccaaatgattctgaagcctgagacatctgggctggggctggagggacacnaggagggaggaggtgacnaaactggtgtccaagcccagggatgtcaagcntggggatgactcaagcatctgtttcgagggccagggcggtccaggccctcaaagcttctaaaggaaacttcccccccgcccttagggaagcgaacaccttgggggtaatttttggcaacccccctttctttttaagcttgtttccgaggccctgcc

SEQ ID NO: 75522 - protein, 178 aa, Zea mays
  misc_feature: Ceres CLONE 1559996
  misc_feature (65)..(124): Pfam Name: NAC Pfam Description: NAC domain
  misc_feature (160)..(160): Xaa is any aa, unknown, or other
  misc_feature (166)..(166): Xaa is any aa, unknown, or other
MTAQAAEELAAQIEQQKLEEQKTEAEEVVVEEDDEDDEDDDDDDKDDDELDGQEGDGSGKSKQSRSEKKSRKAMLKLGMKPITGVSRVTVKKSKNMLFVISKPDVFKSPNSDTYVIFGEAKIEDLSSQLQTQAAEQFKAPDLSQMILKPETSGLGLEGHXEGGGDXTGVQAQGCQAWG

SEQ ID NO: 75523 - DNA, 855 bp, Zea mays
  misc_feature: Ceres CLONE 1559997
ctggagctcaccgcggtggcggccgctctagaactagtggatcccccgggctgcaggaattcgtctcacccctagaaaaagtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagaccttcggagtttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggtttagaccgtcgtgagacaggttagttttaccctactgatgaccgcgccgcgatagtaattcaacctagtacgagaggaaccgttgattcacacaattggtcatcgcgcttggttgaaaagccagtggcgcgaagctaccgtgtgccggattatgactgaacgcctctaagtcagaatccaagctagcaaccggcgcctctgctcgccgcccgccccgacccacgttagggcgttcgcgcccccaagggcccgtgccattggctcagcccgcccggccgacgcgcccgcggcgggccgcctcgaagctcccttccccaacgggcggcgtgctgaatccttttgagacgactttaaacgcgacggggcattgtaagtggcagaagtggcctttgctgcaccaatccagtgagaatcagccc

SEQ ID NO: 75524 - DNA, 852 bp, Zea mays
  misc_feature: Ceres CLONE 1559999
  misc_feature: Encodes the peptide sequence at SEQ ID NO. 75525
ggccgcactccaatagtggatcccccgggctgagtaattcgtctccccctagaaaaaaccaactccggcggccggtgcagcagctattagtggacgtacttatacgtcttcccccagcttacctctaccttaggtagcatagtggtgcggccgcttggtttaaactagacacatggcgcctcaaagcttggatcttgggctgagtctcggcctgggcgtggcggcgttccagcccagcagcttctgccaccccggcaatgccgtcgtcgtccccgcggcggcggagcgggaggccagcccggccgcggcggaggagagggagctttatttttcgcccgccggcagcccggtgtcgagcggcagcggcagcgggaataagcgcgccgcggcggagaggtcggccggcgccggcgccggtagcggcgacgaggacgacgacggtgccgcacgcaagaagctgcggctgtccaaagaccaggccgccgtgctcgaggagtgcttcaagacgcaccacacgctcactccgaagcagaaaggggcgctggccagcagcctgggcctccggccgcggcaggtggaaggtgtggttccagaaccggggcggccggaccaagctgaagccgacggaggtggactgcaagatccttaagggctggggccagcaactcccctaaaaaaaccccccctgggaaaggagggcgccaagctaaggggcttaagtgccgggccggggggcccacataacaaccttcaaaaggggcctttaccggccggggggtcccctccagggcaacaaatgatcctcttcatgtccccggcccaagaaacccgggggcgcccaactggcaatac

SEQ ID NO: 75525 - protein, 158 aa, Zea mays
  misc_feature: Ceres CLONE 1559999
  misc_feature (94)..(135): Pfam Name: Homeobox Pfam Description: Homeobox domain
MAPQSLDLGLSLGLGVAAFQPSSFCHPGNAVVVPAAAEREASPAAAEERELYFSPAGSPVSSGSGSGNKRAAAERSAGAGAGSGDEDDDGAARKKLRLSKDQAAVLEECFKTHHTLTPKQKGALASSLGLRPRQVEGVVPEPGRPDQAEADGGGLQDP

SEQ ID NO: 75526 - DNA, 883 bp, Zea mays
  misc_feature: Ceres CLONE 1560001
  misc_feature: Encodes the peptide sequence at SEQ ID NO. 75527
  misc_feature (640)..(640): n is a, c, t, g, unknown, or other
  misc_feature (671)..(671): n is a, c, t, g, unknown, or other
  misc_feature (759)..(759): n is a, c, t, g, unknown, or other
  misc_feature (802)..(802): n is a, c, t, g, unknown, or other
  misc_feature (828)..(828): n is a, c, t, g, unknown, or other
aaagctggagctccccgcggtggcggccgctctagaactagtggatcccccgggctgcaggaattcgtctcacccctagaaaaagccactccactcctaccccacacagaagcggcggcggcggagcaaacgcaggcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggtcggtgagtatgggctgaggtgcaagcgtgagctttggagggtccagtatgcactgagcaggatccgtaatgctgcaaggcacttgctcacccttgacgagaagaacccccgtcgtatctttgagggtgaggcgcttcttcgccgcatgaaccgctatgggctgcttgctgagggtcagaacaagcttgattatgttcttgccctcaccgctgagaacttcctcgcaaggcggcttcaaacacttgtcttcaaggctggcatggccaagtccattcaccatgctcgtgtcttgatcaagcagcgtcacatcagggttggcaggcaaattgtcaacgtcccatcattcatggtgaagggtggagtctgagaagncacattgacttttcactgtcaagcccattcnggtggaggccccgcaggaagggtgaagagaaagaatcagaagaaggcaagcggtggcggcgatgctggcgatgaggatgaggagtgangatggacaagtagcgttacccaatattaataaatattatctangttttctttgacttgtttcgatgatngagtgctttagctgtgtgaactgaacccagaagtcccctgtggctgactctgggt

SEQ ID NO: 75527 - protein, 154 aa, Zea mays
  misc_feature: Ceres CLONE 1560001
  misc_feature (7)..(108): Pfam Name: Ribosomal_S4 Pfam Description: Ribosomal protein S4/S9 N-terminal domain
  misc_feature (109)..(154): Pfam Name: S4 Pfam Description: S4 domain
MVHVNFYRNYGKTFKKPRRPYEKERLDAELKLVGEYGLRCKRELWRVQYALSRIRNAARHLLTLDEKNPRRIFEGEALLRRMNRYGLLAEGQNKLDYVLALTAENFLARRLQTLVFKAGMAKSIHHARVLIKQRHIRVGRQIVNVPSFMVKGGV

SEQ ID NO: 75528 - DNA, 781 bp, Zea mays
  misc_feature: Ceres CLONE 1560002
  misc_feature: Encodes the peptide sequence at SEQ ID NO. 75529
  misc_feature (371)..(371): n is a, c, t, g, unknown, or other
  misc_feature (401)..(401): n is a, c, t, g, unknown, or other
ggagctccccgcggtggcggccgctctagaactagtggatcccccgggctgcaggaattcgtctcacccctagaaaaagctccacatctcaattctcaccacacacacgcacacacactatcgtccagcaagctcgctgttgcttgccacccaccgcctcagctcgatcgcaacgcgcttggcatggcgtccgaggtgtggctatcgccggcgtctcgcctcccatccctctccaacgcaccacctcgcttacgctccaagcctgccaccacaaccgcctctttgctctctccctgtccccgccctgcccgcgccctgcctgtgctgcgtgaccgtcgccgcacgcgacttctcgccaacgagcagcaggnccagagtcatgagcaccatgactatggtgntgaacgaggaacatccctcccctactggcagcttcgacgggaagcaccatattaccctgggatacatggaaccaggaattcctgctagcccctcccggggctttctcttatgaccaaaaaggctttcatgttcaaccaagaagttccaacaccctcccaggaggaacttcattgccgaaggggagccaaccttttctttgcttaaaccaaaatttaaccaaaaagctttttggaaaggtctccttgggaaaaaaccctctcgggaacccaaaattttttttggaaggtggaatttcccccaaaacttaaaacttttaattttaaaagaacgaggggggggggtttttttttttttgaaaaaggggggccccccccctgtc

SEQ ID NO: 75529 - protein, 101 aa, Zea mays
  misc_feature: Ceres CLONE 1560002
  misc_feature (63)..(63): Xaa is any aa, unknown, or other
  misc_feature (73)..(73): Xaa is any aa, unknown, or other
MASEVWLSPASRLPSLSNAPPRLRSKPATTTASLLSPCPRPARALPVLRDRRRTRLLANEQQXQSHEHHDYGXERGTSLPYWQLRREAPYYPGIHGTRNSC

SEQ ID NO: 75530 - DNA, 855 bp, Zea mays
  misc_feature: Ceres CLONE 1560004
  misc_feature: Encodes the peptide sequence at SEQ ID NO. 75531
tggagctccccgcggtggcggccgctctagaactagtggatcccccgggctgcaggaattcgtctcacccctagaaaaaaaatgcactcgtttcaggcctgacgtccgtctccaactcgactactatactaccgccgcgctctgctcctgcaccagccgggtcagctgaactgagcatcatatcatggagggaagagccgttcccaagccatcggagaagagggtggccctcgtcacgggcgggaaccggggcatggggttcgagatatgccggcagctggcgtccagcggcctcaccgtcgtcctcaccgcgcggagcgagacgcggggcgccgaggcggcccgcgagcttcgcggcctcggcctgccggacgtcgtgtcccaccagctggacgtcacggagcccaccagcgctgctcgtctggctgatttcgtcaggaccaagttcggcaagctcgatgtgttggtcaacaacgcgggaataatgggggtgccgatggagattggcgacgacgaggcagccgtcaaagaaatgatggtgggcaaggaccagaacgagattgcagagtggctgaagcagcggaccacgcagagcgctgagcaagcggaggaatgcgtcaggatcaactacccacgcaccaaaccgtcacggagcgctcctccactcgtgcagtcgtcgtcgtcctctccggcggaagatcgtcaacgtcactcatccttcggctactcaggttttttcacggcatgactcccacggacctgaacaacgtcaaaccctgactaccaacggttggacaacttccggcctttttttggaggatacggaacggcccgttgaaaccccccaatggccca

SEQ ID NO: 75531 - protein, 187 aa, Zea mays
  misc_feature: Ceres CLONE 1560004
  misc_feature (13)..(138): Pfam Name: adh_short Pfam Description: short chain dehydrogenase
  misc_feature: SWISSPROT Homolog: EC 1.1.1.184 Carbonyl reductase (NADPH)
MEGRAVPKPSEKRVALVTGGNRGMGFEICRQLASSGLTVVLTARSETRGAEAARELRGLGLPDVVSHQLDVTEPTSAARLADFVRTKFGKLDVLVNNAGIMGVPMEIGDDEAAVKEMMVGKDQNEIAEWLKQRTTQSAEQAEECVRINYPRTKPSRSAPPLVQSSSSSPAEDRQRHSSFGYSGFFTA

SEQ ID NO: 75532 - DNA, 863 bp, Zea mays
  misc_feature: Ceres CLONE 1560005
  misc_feature: Encodes the peptide sequence at SEQ ID NO. 75533
  misc_feature (762)..(762): n is a, c, t, g, unknown, or other
  misc_feature (833)..(833): n is a, c, t, g, unknown, or other
ggagctccccgcggtggcggccgctctagaactagtggatcccccgggctgcaggaattcgtctcacccctagaaaaaccctcggaaggatggcggcggcggtttccagggccatctgcgtccagaaaccgggctccaaatgcagcagggacagggaagcgacctccttcgcccgccgaacggtcgcggcgccgaggcccccgcgcgccaaagccgccggcgtcatccgctccgactccggcgcgggacggggccagcagtgctcgccgctgagggccgtcgttgacgccgcgtcgatacagacgaccaaaaagagcaaatggcgcctcagtctcccgcgcgcaagctacaacggttcagggtccggtgctgcggcggctgagccgtctaccgtgggagacaccttggaacgggaggagggcggcggcacagaggcaggcgcttcggctgatgagtcatccaaccggaagcagccgccccctgttgaccccaagattgagaaggagctcaagaaggtagttcagaagactgcggcaacctttgcaccaagggcgtccacgaaaacaaagaaccctgctgtccctggaagtaccctgtacaccgtctttgaagtccagggctatgtttccatgctgttgggcggagcactttccttcaatctcatattctcatcgaatgagccagacatctggacgttaatggggaatgtggtccatttggatgttcagtaactataccttcgcttcggggctcgtgactgcntcaataaagagaaagagctctcaactacttatttctcctgattcgtctgatcgacggtatgattcctttcntcgtgaagtctttttgctgtgttaggtcac

SEQ ID NO: 75533 - protein, 213 aa, Zea mays
  misc_feature: Ceres CLONE 1560005
  misc_feature: SWISSPROT Homolog: EC 2.7.9.1 Pyruvate, phosphate dikinase
MAAAVSRAICVQKPGSKCSRDREATSFARRTVAAPRPPRAKAAGVIRSDSGAGRGQQCSPLRAVVDAASIQTTKKSKWRLSLPRASYNGSGSGAAAAEPSTVGDTLEREEGGGTEAGASADESSNRKQPPPVDPKIEKELKKVVQKTAATFAPRASTKTKNPAVPGSTLYTVFEVQGYVSMLLGGALSFNLIFSSNEPDIWTLMGNVVHLDVQ

SEQ ID NO: 75534 - DNA, 874 bp, Zea mays
  misc_feature: Ceres CLONE 1560006
  misc_feature: Encodes the peptide sequence at SEQ ID NO. 75535
  misc_feature (872)..(872): n is a, c, t, g, unknown, or other
ctccccgcggtggcggccgctctagaactagtggatcccccgggctgcaggaattcgtctcacccctagaaaaaacagccatcacacgcatactgcatacacaacgcagagcatcagaagcagctgcgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggcgagttccccggcgactacgggtgggacaccgcggggctgtcggcggacccggagaccttcgccaagaaccgcgagctggaggtgatccactgccgctgggccatgctcggcgcgctcgggtgcgtgttcccggagctgctcgcccgcaacggcgtcaagttcggcgaggcggtgtggttcaaggcgggctcccagatcttcagcgagggcgggctcgactacctcgggcaacacgagcctggtccacgcgcagagcatcctggccatctgggcgtgccaggtggtgctcatgggcgccgtcgagggggtaccgcgtcgccggcggccggctcgggggaggtggtcgacccgctgtaccctggcggcagcttcgacccgctcgggctcgcgaacgacccggaaggcgtcgccgaagctcaggtgaggagatcaagaaccggcccgccctcgccatggttctccatgtttcggcttcttcgtgcaggctatcgtcaccgggcaaggcccccttcaagaacctcgncc

SEQ ID NO: 75535 - protein, 244 aa, Zea mays
  misc_feature: Ceres CLONE 1560006
  misc_feature (63)..(212): Pfam Name: Chloroa_b-bind Pfam Description: Chlorophyll A-B binding protein
MAAATMAITSRALVGKPAAGTRDVFGEGRITMRKTAAKPKPAASGSPWYGADRVLYLGPLSGSPPSYLTGEFPGDYGWDTAGLSADPETFAKNRELEVIHCRWAMLGALGCVFPELLARNGVKFGEAVWFKAGSQIFSEGGLDYLGQHEPGPRAEHPGHLGVPGGAHGRRRGGTASPAAGSGEVVDPLYPGGSFDPLGLANDPEGVAEAQVRRSRTGPPSPWFSMFRLLRAGYRHRARPPSRTS

SEQ ID NO: 75536 - DNA, 866 bp, Zea mays
  misc_feature: Ceres CLONE 1560011
  misc_feature: Encodes the peptide sequence at SEQ ID NO. 75537
ctggagctccccgcggtggcggccgctctagaactagtggatcccccgggctgcaggaattcgtctcacccctagaaaaaactctctctcaactcattggcagcagcaaccgcagccgcgagggccaagcaggggggacaaggaaaagggccgacgaagaggaaaaaggaagaacgcgtcgcggagccatggggcttggccttggcgtgcgggcggcgcccttcacgtacgcggcgcacgcactggccgtcgcggcggcggccatggttctcgtctggtccatccagttccgcggcgggctcgccatcgagtccaccaacaagaacctcatcttcaacgttcaccctgttcttatgcttatcggttatgttattatcggcggtgaagctataatggtgtacagggtacttccaacatcgaatcatgacacaactaagctgatccatctaattctccacgggattgcacttgtccttggtgcggttggaatatactttgctttcaaaaatcacaatgagagtgggattgccaatctttacagcctgcactcttggattgggataggaacaattactttgtatggtattcagtggataattggattcgtcacgttcttcttccctggtgctgcgccaacgtgaagaagggtgttctcccttggcacgtactctttgggctctttgtctacatcttagcactggctaatgcagaactcggctttcttgagaagctcactttcctcgagagctcaggtctcgacaatatggcacagaggcatttctagtgaactcacagcatttggtgtccgtgtattggtgccccccggtggtggtgctggctaaagctcagttcgcttgaagaacccc

SEQ ID NO: 75537 - protein, 150 aa, Zea mays
  misc_feature: Ceres CLONE 1560011
  misc_feature (13)..(150): Pfam Name: Cytochrom_B561 Pfam Description: Cytochrome b561
MGLGLGVRAAPFTYAAHALAVAAAAMVLVWSIQFRGGLAIESTNKNLIFNVHPVLMLIGYVIIGGEAIMVYRVLPTSNHDTTKLIHLILHGIALVLGAVGIYFAFKNHNESGIANLYSLHSWIGIGTITLYGIQWIIGFVTFFFPGAAPT

SEQ ID NO: 75538 - DNA, 865 bp, Zea mays
  misc_feature: Ceres CLONE 1560012
  misc_feature: Encodes the peptide sequence at SEQ ID NO. 75539
tccccgcggtggcggccgctctagaactagtggatcccccgggctgcaggaattcgtctcacccctagaaaaacggcctggcttgtggtctaggaggagactggactcggaggaggacgggatagcagacaagaggagaggacgcgcacgccatgtcaggtccaccgccaaagccttgggagcgatactggaactgaaggaacttcatgtccaacacctttcaagcccccatctggtggaagcaccattgatgttgttgaagcctctggtaccgctaaacccagcgaaaatgttactgcgatggaggggaatgccgctcccaatgtaaatagcactatttcgaggcctatgccacagcggccttggcagcacacaggttatggaaacacctatggagggtatggtggatccaacatgtatagttcatatggaggatttggcaacacttatggtaccggtggactcggaaatagcatgtactccagttacggaggaggttatggtggtggcatgtacggtggtggcatgtatggaggccgcatgtatagtgggaggggggctttataggggggcctgcgtcaagctcacctttgttcacggccgcggaggcacgttgggcaggggtggcgggcccacgcaccttgccatcctgtcccagccgccggacaccatcaacgggtccatccgtgtgaccgtgcatggcgaggtcatcgagttctgcttcggggaggagcacctgtgcttccagactctgcagcgcttcacggccggcacgcctggagcaggcatgcacccgccggtctcttccaagccccaagggcgcaagcttctggaccaaatggccgtcgtggccacggaaggaata

SEQ ID NO: 75539 - protein, 158 aa, Zea mays
  misc_feature: Ceres CLONE 1560012
  misc_feature: SWISSPROT Homolog: EC 4.1.1.31 Phosphoenolpyruvate carboxylase
MEGMVDPTCIVHMEDLATLMVPVDSEIACTPVTEEVMVVACTVVACMEAACIVGGGLYRGACVKLTFVHGRGGTLGRGGGPTHLAILSQPPDTINGSIRVTVHGEVIEFCFGEEHLCFQTLQRFTAGTPGAGMHPPVSSKPQGRKLLDQMAVVATEGI

SEQ ID NO: 75540 - DNA, 842 bp, Zea mays
  misc_feature: Ceres CLONE 1560014
  misc_feature: Encodes the peptide sequence at SEQ ID NO. 75541
  misc_feature (408)..(408): n is a, c, t, g, unknown, or other
ctccccgcggtggcggccgctctagaactagtggatcccccgggctgcaggaattcgtctcacccctagaaaaaactcgctccacttccattcccagcgaccccgcccgcccggaggcgtcgcacctgcacgccgcggcagcagccaagcctctctcgtctcgtgcggcaagcgccacacagacacccgatggcgctcctgctgctgcgcggctgcgccgcgccgccagccgtccacgcggccccggcggggtcccggctgctccctccggcgctgccgcggcggcggctcgtggccgtcgcctcttcggcctcctccgctccgtccggcgaggtggcgtcgtcgtcccaggacggccgcggctacgggacccgtgggcgggcccaacggccacgccatcgctcctgncacagacaccaagtccaccgccgtcgagaccaccgtcgagagggtgatcttccgactccggttcctggcacttctcggcgtccgcggggtacttggccggctccgtcctgaggttcctcaaagggctgggttcttcataaaagaagcgtaccagggttactgggtcgaactgggtcaaagggggtttcatacggggccgaagggccctcaagggcctccaagcgcttccaatgttttcttgctgggaacattcatgcttaaattttgggaagggtttttaggggctttttaataagaaaagttcccccggggggttcccctcggaatccaaacgggcccttaggggggttgttttttttcgggaaagttcccttttaaaggaaacccccaagggggagaaaaaactcccttccctttggaagatctaaaaaaaa

SEQ ID NO: 75541 - protein, 109 aa, Zea mays
  misc_feature: Ceres CLONE 1560014
  misc_feature (73)..(73): Xaa is any aa, unknown, or other
MALLLLRGCAAPPAVHAAPAGSRLLPPALPRRRLVAVASSASSAPSGEVASSSQDGRGYGTRGRAQRPRHRSXHRHQVHRRRDHRREGDLPTPVPGTSRRPRGTWPAPS

SEQ ID NO: 75542 - DNA, 918 bp, Zea mays
  misc_feature: Ceres CLONE 1560016
  misc_feature: Translation starting site: 167
  misc_feature (484)..(484): n is a, c, t, g, unknown, or other
  misc_feature (488)..(488): n is a, c, t, g, unknown, or other
  misc_feature (489)..(489): n is a, c, t, g, unknown, or other
  misc_feature (504)..(504): n is a, c, t, g, unknown, or other
  misc_feature (514)..(514): n is a, c, t, g, unknown, or other
ctggagctccccgcggtggcggccgctctagaactagtggatcccccgggctgcaggaattcgtctcacccctagaaaaagacgtccccatttccaagctcctcctcgcgattccaatccacgcacgcctcctccgcttccgcctcgctcaggcttatagtcagtgatggaacacaaggaggcgggctgccagcagccggagggcccaatcctatgcatcaataactgcggcttcttcggcagtgctgcgacgatgaacatgtgctccaagtgccacaaggagatgataacgaagcaggagcaggcccagctggctgcctcctccatcgatagcattgtcaatggcggtgacggcgggaaaggacctgtaattgctgcatctgtaaatgcggcagttcctcaagttgagcagaagactattgttgtgcagcccatgcttgtagctgaaaccagcgaggctgctgctgtaatcccccaaggcaangaanngctcaaactggtgcnctgcctgcangaaagcttgtttggctgacgggatttaactgcccatgccggaacatgaactgttcggggcaccgctactcgaacaaactgactgtcagttcgacttatcgactgcaccaagggaacccaattgcaaagccaaatcctgggggaaaggcggaaaaactccaacaagatctaaggccggcattgggggaacaaaaaggtttccattcgccaaaatttaaaaagggtgtctttgcggggttaaaattgaaaactgccatttttggctcgggggcggccccccggggaggtaaaaatgtgtgatgaaacagaattccggggccccaaaaattttcccaaaaagggttccccgggggggaatttccgggaaaccctattttttttttccggggggtttccccgaaaatt

SEQ ID NO: 75543 - DNA, 878 bp, Zea mays
  misc_feature: Ceres CLONE 1560018
  misc_feature: Translation starting site: 157
  misc_feature: SWISSPROT Homolog: EC 1.10.99.1 Plastoquinol--plastocyanin reductase
  misc_feature (628)..(628): n is a, c, t, g, unknown, or other
  misc_feature (745)..(745): n is a, c, t, g, unknown, or other
  misc_feature (816)..(816): n is a, c, t, g, unknown, or other
ctggagctccccgcggtggcggccgctctagaactagtggatcccccgggctgcaggaattcgtctcacccctagaaaaacgcaagcctgtggacgcgagtgagtgaacaccagccgtattgtcccgaccccgaccgatcctcgcctgctgcagccatggcgacctccgcggcgctctctaccgccgccaatcccacccagctctgccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggtggaggcgtggctcaacacgcacggtcccaacgaccgcacgctcgcgcaggggctcaagggtgaccccacgtacctggtggtggagcaggacaagacgctggccacctacgggatcaacgccgtgtgcactcacctcnggctgcgtcgtgccgtggaacggcgccgagaacaagttcatctgcccatgccacggatcccagtacacaccccaggcaaggtggtccgtggaccggcgcctctgtcgctggccctgnttcacgccgacgtcgacaagggcaaggtccctcttcgtcccgtgggtggaacccgactttcagacccggcnaagaccccgtggtggagggcatgaggatgatcccggaccccgccggtgctcgtgcttccaca

SEQ ID NO: 75544 - DNA, 874 bp, Zea mays
  misc_feature: Ceres CLONE 1560020
  misc_feature: Encodes the peptide sequence at SEQ ID NO. 75545
  misc_feature (519)..(519): n is a, c, t, g, unknown, or other
ctggagctccccgcggtggcggccgctctagaactagtggatcccccgggctgcaggaattcgtctcacccctagaaaaaacaccaacctcagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacggggtcgactcgttcggtctcgggaaagccgtggagtacctgcagttcgagttcgactcgctgggacagaaacctggctaagaatgaggccggcggcatcatcggcactcggttcgagtcctccgaagtccagtccaccccgttgcagccctacagacgagatgtcnggccttcagcggtttccgcgagtgcgagctcttccacggccgctggggccatgctcgccaccctcgggacccttctccgacaagtggttaaccggaattcacttggccagacccgggcaaaggtgagctgggggaaccggtccctcctaccgggggcagccccctcccggtccccaatctgaaagcttatttgggatccggggggctctggaatcggttaacttccattttccagccaaacccccaaactccaaccggaaaaaaaggtttttcccccggggggtcccattttttaaacccttttggggggggggggccgccctttaaaaaaaaagagcccgtcaacccggggcag

SEQ ID NO: 75545 - protein, 102 aa, Zea mays
  misc_feature: Ceres CLONE 1560020
MASSVAAAASTFLGTRLADPAPQNGRIVARFGFGLGGKAKPAPKKVAKTSTSSDRPLWFPGAVAPDYLDGSLVGDYGVDSFGLGKAVEYLQFEFDSLGQKPG

SEQ ID NO: 75546 - DNA, 845 bp, Zea mays
  misc_feature: Ceres CLONE 1560021
  misc_feature: Encodes the peptide sequence at SEQ ID NO. 75547
  misc_feature (582)..(582): n is a, c, t, g, unknown, or other
  misc_feature (720)..(720): n is a, c, t, g, unknown, or other
ctggagctccccgcggtggcggccgctctagaactagtggatcccccgggctgcaggaattcgtctcacccctagaaaaaacagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcaaaggcaaagccggcagcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctncggcacccgagcctgagtcacgcgcagagcatcctcgccatcatggcctgccaggtcgtgctcatgagcgccatcgaggggtaccgcgtcgcctgcggcccgctcggagaggtcgtcgaaccgctctaccccggcggnagcttcgaacccgatcggcctcgccgaaccacccttgagccttcagcggagcttcagggtgagggagctcaggaaccggcgccctcgccatgttctccaatgatccgggtccattctgccaggcc

SEQ ID NO: 75547 - protein, 233 aa, Zea mays
  misc_feature: Ceres CLONE 1560021
  misc_feature (64)..(214): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLRHPSLSHAQSILAIMACQVVLMSAIEGYRVACGPLGEVVEPLYPGGSFEPDRPRRTTLEPSAELQGEGAQEPAPSPCSPMIRVHSAR

SEQ ID NO: 75548 - DNA, 841 bp, Zea mays
  misc_feature: Ceres CLONE 1560024
  misc_feature: Encodes the peptide sequence at SEQ ID NO. 75549
  misc_feature (602)..(602): n is a, c, t, g, unknown, or other
  misc_feature (643)..(643): n is a, c, t, g, unknown, or other
  misc_feature (684)..(684): n is a, c, t, g, unknown, or other
ctggagctccccgcggtggcggccgctctagaactagtggatcccccgggctgcaggaattcgtctcacccctagaaaaaacttcttcagcggcagcgtggcaacgagagcaacgaagtattcaaaccgaaaacaatggagccggtgcggaagagcgtgtgcgtgaccggcgctggcggcttcgtcgcgtcggagctggtgaagctcctcctctcccggggccaatacgcggtccgcggcaccgtgcgcgaccctggtgctagcaagaatgcccatctcaaggtgctggaaggagctgaggaaaggttgcagcttctcaaggctgatctgatggactacaacagcattgcatcagcagttgccggctgtgagggtgtcttccatgtagccagtcctgtcctttcccatcgaccctccaaccctgaggtggaggtcatagctcccgctgtaataggtacaaccaatgtgttaaaggcttgctatgaggcaaaagttaggcgagttgtggtggtgtcttcatgtggagctgtgtatgctaatcctatttatccgaagggtaaggtgtttgatgaagactgctggtcagatgaggattactgcangaagaaggaggattgggtatttagtttccaaaacactgtcngaacgagaagctcttgcttttgcagcaaaaacagggctggnacgtgtaactgtttgtccgtcattagtatttggacccctgatgcaccctacaggtaattttgaccgcgaaatgatccttaattatttcaaaatctcagactgttgaaaattactccagaaattggggggaaatccgggaagttgccgaagccctctt

SEQ ID NO: 75549 - protein, 201 aa, Zea mays
  misc_feature: Ceres CLONE 1560024
  misc_feature (8)..(198): Pfam Name: Epimerase Pfam Description: NAD dependent epimerase/dehydratase family
  misc_feature: SWISSPROT Homolog: EC 1.1.1.219 Dihydrokaempferol 4-reductase
  misc_feature (156)..(156): Xaa is any aa, unknown, or other
  misc_feature (170)..(170): Xaa is any aa, unknown, or other
MEPVRKSVCVTGAGGFVASELVKLLLSRGQYAVRGTVRDPGASKNAHLKVLEGAEERLQLLKADLMDYNSIASAVAGCEGVFHVASPVLSHRPSNPEVEVIAPAVIGTTNVLKACYEAKVRRVVVVSSCGAVYANPIYPKGKVFDEDCWSDEDYCXKKEDWVFSFQNTVXTRSSCFCSKNRAGTCNCLSVISIWTPDAPYR

SEQ ID NO: 75550 - DNA, 823 bp, Zea mays
  misc_feature: Ceres CLONE 1560025
  misc_feature: Encodes the peptide sequence at SEQ ID NO. 75551
gctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcaggaatctgagcctcatccacgcgcagagcatcctcgccatctgggcttgccaggtcgtgctcatgggcgccgtcgagggctaccgcatcgccggctgtccgctcggcgaagtcgtcgacccgctctatcccggcggcagcatcgaaacgttcggctttcacgacgaaccccgaggctttcgctgaactccaggtgaaggactcaagaagcggccgcctccccattgttctccatggtcc

SEQ ID NO: 75551 - protein, 208 aa, Zea mays
  misc_feature: Ceres CLONE 1560025
  misc_feature (65)..(203): Pfam Name: Chloroa_b-bind Pfam Description: Chlorophyll A-B binding protein
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLRNLSLIHAQSILAIWACQVVLMGAVEGYRIAGCPLGEVVDPLYPGGSIETFGFHDEPRGFR

SEQ ID NO: 75552 - DNA, 790 bp, Zea mays
  misc_feature: Ceres CLONE 1560026
  misc_feature: Encodes the peptide sequence at SEQ ID NO. 75553
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (671)..(671): n is a, c, t, g, unknown, or other
ctggagctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccacctagagatggatccgcaccagagcaccaggggtgtgtggttnnnnnnnnttgtttgccnccaacctttgtcgattccagggaccaggtataccgtggggaacttttgcatggggcgttgacaactcgacctctggaggaacctattccagtgaacaaaggacaggggctgggatgcaa

SEQ ID NO: 75553 - protein, 215 aa, Zea mays
  misc_feature: Ceres CLONE 1560026
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (171)..(171): Xaa is any aa, unknown, or other
  misc_feature (172)..(172): Xaa is any aa, unknown, or other
  misc_feature (173)..(173): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEEAGAAVEQFNGYTFQGRPLRVNCGPPPPRDGSAPEHQGCVVXXXCLPPTFVDSRDQVYRGELLHGALTTRPLEEPIPVNKGQGLGC

SEQ ID NO: 75554 - DNA, 872 bp, Zea mays
  misc_feature: Ceres CLONE 1560028
  misc_feature: Encodes the peptide sequence at SEQ ID NO. 75555
  misc_feature (734)..(734): n is a, c, t, g, unknown, or other
tacccgcggtggcggccgctctagaactagtggatcccccgggctgcaggaattcgtctcacccctagaaaaagttgaccccttccttccatgggaggctgggcagggctaccaaaccgagtagccccccgatgaatggataagccccttcctcagccgctcgttgcttctcagtccgacagaacagcacgtgaaagcccaggcctccctccctccctctccccacctgctggaatccgcggccgctgcctgcaagggtgaccttgcttgagcccgtcttccttcttcctcagctaggcacccgtgcccatcttcagtccacctagccatgcctacgacgatggcggcggcggcggcagcgtctgctccaagctcgctccgcgtttcgcgccaggggacgatcgggggaggccatgtcctctacagcaggtctcagagggctgccactgtctccgccagagcttccatgaacataacgtgctgcgcgaaccagacgcagacggcgcagcgcaagtcgtattcggggacgacctctccgccgtcaggttcagtgaaagagaaggtgaagccgaggctcgacgacgggggcgtcgggttcccgccgttccggttcgggggaagcggaggaggaggaggcggcggcggcaccagctcgtccggcggggtcatcctcttcgtggccgtcctgctcctggatacctcaaggagttcgagaggaactgcagacgggccancgagggagcgcggtggctacaaccacgggctggcgccacagtagaatcctctctctctcacactctccgtgtgtggtttggaagaggacgtgtactacgtctctaccccaacatgggttgcaaaaatgcctcggggtt

SEQ ID NO: 75555 - protein, 145 aa, Zea mays
  misc_feature: Ceres CLONE 1560028
  misc_feature (132)..(132): Xaa is any aa, unknown, or other
MAAAAAASAPSSLRVSRQGTIGGGHVLYSRSQRAATVSARASMNITCCANQTQTAQRKSYSGTTSPPSGSVKEKVKPRLDDGGVGFPPFRFGGSGGGGGGGGTSSSGGVILFVAVLLLDTSRSSRGTADGPXRERGGYNHGLAPQ

SEQ ID NO: 75556 - DNA, 867 bp, Zea mays
  misc_feature: Ceres CLONE 1560029
  misc_feature: Encodes the peptide sequence at SEQ ID NO. 75557
ctggagctccccgcggtggcggccgctctagaactagtggatcccccgggctgcaggaattcgtctcacccctagaaaaaaccgaccacgttccatatggctacgtgggggatggcactcctccttggcttgctgctgatagtagtagcttcgcccgcgatcgctgatgacgactccggtatctactaccagctggctcttatgtggccagtagcatactgcgagcagaccagcgctgggtgctgcaagcccaccaccggcgtctcaccggcgcgcgacttctacataacgggcttcaccgtccttaacgcgaccaccgacgctgcagtgacgggatgcaacaacaaagttccttacgaccctaacctgattaccggcatccaaggcctgaatcactactggagcaacatcaggtgccccatcaacaacgggcagagcatctggaagaacgcctggaagaaggccggcgcctgctccggcctcagcgagaaagactacttcgagactgccctctccttccgtagccggatcaacccactcgttcgcctcaaagccaaatgtatcaagccggacttcgggctctacagcctcgaggcgatcaccaaggtcttcaacagctgcatcaacgcgacgccaggagatccagtgcagcaacggccccttctacaagtacatgctgttccagctctacttctgcgcggcggtgaactgcacgttcatcgactgcactgcgcacagcagtacacatgactcgaggagatcctcttcacccccttcgagcagtgatgctcagcagcagctcaccaggacgacgaccctttcaagctgcctggcgtcaccatgaacaactgaaacaccgtaccgacg

SEQ ID NO: 75557 - protein, 217 aa, Zea mays
  misc_feature: Ceres CLONE 1560029
  misc_feature (30)..(201): Pfam Name: Ribonuclease_T2 Pfam Description: Ribonuclease T2 family
  misc_feature: SWISSPROT Homolog: EC 3.1.27.1 Ribonuclease T(2)
MATWGMALLLGLLLIVVASPAIADDDSGIYYQLALMWPVAYCEQTSAGCCKPTTGVSPARDFYITGFTVLNATTDAAVTGCNNKVPYDPNLITGIQGLNHYWSNIRCPINNGQSIWKNAWKKAGACSGLSEKDYFETALSFRSRINPLVRLKAKCIKPDFGLYSLEAITKVFNSCINATPGDPVQQRPLLQVHAVPALLLRGGELHVHRLHCAQQYT

SEQ ID NO: 75558 - DNA, 827 bp, Zea mays
  misc_feature: Ceres CLONE 1560031
  misc_feature: Encodes the peptide sequence at SEQ ID NO. 75559
  misc_feature (631)..(631): n is a, c, t, g, unknown, or other
  misc_feature (687)..(687): n is a, c, t, g, unknown, or other
  misc_feature (706)..(706): n is a, c, t, g, unknown, or other
ctggagctccccgcggtggcggccgctctagaactagtggatcccccgggctgcaggaattcgtctcacccctagaaaaaaccagcaagaccaaccaacccacttctgactgaccactgtgccgcgccgtgctcaccgaacggtcgaccacacagaacgacgatggccgcgtcggcgctgcaccagaccaccagcttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggagaccttcgcgcgcaaccgggagctagaggtgatccactcccggtgggcgatgctgggggcgctgggctgcgtgttcccggagatcctggctaagaacggcgtcaagttcggcgaggcggtgtggttcaaggccggcgcgcagatcttctcggagggcgggctggactacctggggaacctcaaccctgtgcacgcgcagagcatcctggccatctggncgtgccaggtggtgctcatgggcttcgtcgagggctaccgcgtcgggcggcgcccnctcggggaagtcttcgacnaggtgtacccccggcggcgccttcgacccgctggggcttcgccgacgacccgggaccccgccctcgagcttaaggtgaaggagctcaggaacgggccgcctttgcagggttctcctggtcc

SEQ ID NO: 75559 - protein, 221 aa, Zea mays
  misc_feature: Ceres CLONE 1560031
  misc_feature (59)..(213): Pfam Name: Chloroa_b-bind Pfam Description: Chlorophyll A-B binding protein
  misc_feature (157)..(157): Xaa is any aa, unknown, or other
  misc_feature (182)..(182): Xaa is any aa, unknown, or other
MAASALHQTTSFLGQALVARAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNLNPVHAQSILAIWXCQVVLMGFVEGYRVGRRPLGEVFDXVYPRRRLRPAGASPTTRDPALELKVKELRNGPPLQGSPG

SEQ ID NO: 75560 - DNA, 755 bp, Zea mays
  misc_feature: Ceres CLONE 1560032
  misc_feature: Encodes the peptide sequence at SEQ ID NO. 75561
ggagctccccgcggtggcggccgctctagaactagtggatcccccgggctgcaggaattcgtctcacccctagaaaaaaaacacacagcaccagctaagctagctcacgcccgccgaggccatatccttcccagcacgcccgtagacgccgacgccgacgcttgacgccatgcaggagttccaatccatcccggggctggcggggcggctgttcggcggggcagcggccgccggcctccggcgcgcccaggggcagggcctaggggcgctgtgcggcggcggcggcagcgggggtgcctcgcccgcggcggccgtgaagtgcccgcggtgcgagtccaccaacaccaagttctgctactacaacaactacaacctgtcgcagccgcgccacttctgcaagggctgccggcggtactggaccaagggcggcgtcctgcgcaacgtgcccgtgggcgggggctgccgcaaggccaagcgctcgtcggcgccgtccacgcccacgtcggcggtgggcgacgccaagagcccgcgccgcgcctcggcgtcctcgccccgcggctccatcagcagcggcagcggcagcgcgagccccacgcccaacgggcttcgccttctcttcacggccgacgtggtggcgccgccgcccggcgcccatattcgccgatcaggcggcgggcgctggggttctctcttggggcctccgccggcggttccgggggtttaagctttcgggggcggcccaggctaaaggagga

SEQ ID NO: 75561 - protein, 184 aa, Zea mays
  misc_feature: Ceres CLONE 1560032
  misc_feature (44)..(106): Pfam Name: zf-Dof Pfam Description: Dof domain, zinc finger
MQEFQSIPGLAGRLFGGAAAAGLRRAQGQGLGALCGGGGSGGASPAAAVKCPRCESTNTKFCYYNNYNLSQPRHFCKGCRRYWTKGGVLRNVPVGGGCRKAKRSSAPSTPTSAVGDAKSPRRASASSPRGSISSGSGSASPTPNGLRLLFTADVVAPPPGAHIRRSGGGRWGSLLGPPPAVPGV

SEQ ID NO: 75562 - DNA, 792 bp, Zea mays
  misc_feature: Ceres CLONE 1560033
  misc_feature: Encodes the peptide sequence at SEQ ID NO. 75563
  misc_feature (364)..(364): n is a, c, t, g, unknown, or other
  misc_feature (598)..(598): n is a, c, t, g, unknown, or other
  misc_feature (624)..(624): n is a, c, t, g, unknown, or other
ggagctccccgcggtggcggccgctctagaactagtggatcccccgggctgcaggaattcgtctcacccctagaaaaagccggtgctccccgcgcaaacacgcacgcacactctggacgcgcgctggctggctgcaactgcaaggcgtcgccaccaaccgcagctataataggtgtattgaacaggcaggcagagcagggcaggcagtgtaggctccatcagatccaacgccaccagctagcagcagcagcagcagcatggccaccaccagcacgcctcgcctcgccaccctcctggtgctcctggcggcggcgtcaccgctgctgagcgcagctcaaaaggccgcccccaaggctccggcggncggcgaaggcggcgccagggccggcggcgtcgtcgtcgtccggcgcgggcgcggcggacgcggcccctcccacagacgtgaacaaggcgctcaaggacgaccagttcagcgagttcaagcagctgctgcacgacacgcgcgtggacacgcagatcaacgcgcagctgacggacagctacaacgggctgaccatcatggcgcccaccaacgccgccttcgacaagatgaaggccngcgtgctcaacgggctgtcgccgcangaccagatccagctcgtcctctactgcgtgctgcccggctactacagcctctcatgctcggcaccctcgacggcaaggtcaacacgcagggctcccgccacgaacgggtcctacaagtacaacattcaagcggttcggcaaacaacgtcaaccttgttccccgggcgt

SEQ ID NO: 75563 - protein, 78 aa, Zea mays
  misc_feature: Ceres CLONE 1560033
  misc_feature (14)..(14): Xaa is any aa, unknown, or other
  misc_feature (22)..(22): Xaa is any aa, unknown, or other
MAPTNAAFDKMKAXVLNGLSPXDQIQLVLYCVLPGYYSLSCSAPSTARSTRRAPATNGSYKYNIQAVRQTTSTLFPGR

SEQ ID NO: 75564 - DNA, 821 bp, Zea mays
  misc_feature: Ceres CLONE 1560037
  misc_feature: Translation starting site: 138
  misc_feature (659)..(659): n is a, c, t, g, unknown, or other
  misc_feature (746)..(746): n is a, c, t, g, unknown, or other
  misc_feature (781)..(781): n is a, c, t, g, unknown, or other
ctggagctccccgcggtggcggccgctctagaactagtggatcccccgggctgcaggaattcgtctcacccctagaaaaaagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactaccttggcaaccccagcctgatcacgcgcagagcatcctcgccatctaggcctgccaggtcgtgctcatgggcgccgtcgagggctaccgtattgccngcgggccgctcggcgaagtcgtcgacccgctgtaccttggcgcaagcttcaaccccctcggcttgccgacgaaccccaagtcttcgncgagctcaaggtgaggagctcaagaacggccgccntcgccagtttttcatgttcgggcttcttgtccaaggcatc

SEQ ID NO: 75565 - DNA, 860 bp, Zea mays
  misc_feature: Ceres CLONE 1560042
  misc_feature: Translation starting site: 329
  misc_feature: Pfam Name: S-AdoMet_synt_M Pfam Description: S-adenosylmethionine synthetase, central domain
  misc_feature: SWISSPROT Homolog: EC 2.5.1.6 Methionine adenosyltransferase
  misc_feature (326)..(326): n is a, c, t, g, unknown, or other
gctggagctccccgcggtggcggccgctctagaactagtggatcccccgggctgcaggaattcgtctcacccctagaaaaagctacacatccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggntgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcgggcgaccagggccacatgttcggggtacgccaccgacgagacccccgagctgatgccgctcagccacgtgctggccaccaagctgggcgcgcgcctcaccgaggtgcgcaagaacggcacctgcgcttggctgaggcccgacgcaagacccaggtgacgggtgagtacgtgaacgagggcggcgccatggtgcccgtccgcgtgcacaccgtgctcatctccaccagcacgacgagaccgtcaccacgacgagatcgccgcgacctcaggagcacgtcatccaagccgtgatccctgagaagacttcgacgaaagacatcttccc

SEQ ID NO: 75566 - DNA, 793 bp, Zea mays
  misc_feature: Ceres CLONE 1560043
  misc_feature: Encodes the peptide sequence at SEQ ID NO. 75567
  misc_feature (420)..(420): n is a, c, t, g, unknown, or other
  misc_feature (554)..(554): n is a, c, t, g, unknown, or other
  misc_feature (595)..(595): n is a, c, t, g, unknown, or other
  misc_feature (597)..(597): n is a, c, t, g, unknown, or other
ctggagctccccgcggtggcggccgctctagaactagtggatcccccgggctgcaggaattcgtctcacccctagaaaaaagcttgccacacctgcttggggctgccaagtaaaagtagtaagctagagaagcaaagcaaagctccgatccaatccaatccaccgcgaggattatgtctctggtaaggctcctggacacgctggccctggactcgtgggtgcggaacccgttcaccatcttcggcacggcggtggccgccgacgcgtggctggccagcgacacgtcggcgttcgccaacacgcacatcgagagccgggacacggcggccgcctacgtgttcagcgccgcgctcccgccgggcgtcaagaaggaggaggtcacggtggagctggacgaaggcaacgtgctggtcatcgccngcgagcgcagcgtgtgccgccagaagcgcagcgacgggtgccaccacatcgagcgcagccgcgccaccttccctcgcaggtccaccctgccgaggacgccgccgtcgacggcgtcaaggccgccttggacgccngcagctcaccgtcaccgtgccaaggtcggggcccgccgccncnccatcgtgcccaaaaaagcccgcccccaacccccgggggctgggcccggtgccgttcaaggcccggcccctggttaacttctgaaaaagcccaaacccaaaccccaaacaaaaagggccggcccgggttccctgtttccccccccgtaaaaccccccccttgtccggggaaaaagggaaaaaaaacggtccccccc

SEQ ID NO: 75567 - protein, 166 aa, Zea mays
  misc_feature: Ceres CLONE 1560043
  misc_feature (46)..(161): Pfam Name: HSP20 Pfam Description: Hsp20/alpha crystallin family
  misc_feature (83)..(83): Xaa is any aa, unknown, or other
  misc_feature (141)..(141): Xaa is any aa, unknown, or other
  misc_feature (142)..(142): Xaa is any aa, unknown, or other
MSLVRLLDTLALDSWVRNPFTIFGTAVAADAWLASDTSAFANTHIESRDTAAAYVFSAALPPGVKKEEVTVELDEGNVLVIAXERSVCRQKRSDGCHHIERSRATFPRRSTLPRTPPSTASRPPWTPAAHRHRAKVGARRXXIVPKKARPQPPGAGPGAVQGPAPG

SEQ ID NO: 75568 - DNA, 786 bp, Zea mays
  misc_feature: Ceres CLONE 1560044
  misc_feature: Translation starting site: 128
  misc_feature (488)..(488): n is a, c, t, g, unknown, or other
  misc_feature (490)..(490): n is a, c, t, g, unknown, or other
  misc_feature (491)..(491): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (535)..(535): n is a, c, t, g, unknown, or other
  misc_feature (539)..(539): n is a, c, t, g, unknown, or other
  misc_feature (542)..(542): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (553)..(553): n is a, c, t, g, unknown, or other
  misc_feature (554)..(554): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (585)..(585): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (614)..(614): n is a, c, t, g, unknown, or other
  misc_feature (616)..(616): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (635)..(635): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (650)..(650): n is a, c, t, g, unknown, or other
  misc_feature (657)..(657): n is a, c, t, g, unknown, or other
  misc_feature (658)..(658): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (728)..(728): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (742)..(742): n is a, c, t, g, unknown, or other
  misc_feature (743)..(743): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (756)..(756): n is a, c, t, g, unknown, or other
  misc_feature (762)..(762): n is a, c, t, g, unknown, or other
  misc_feature (770)..(770): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
tggagctccccgcggtggcggccgctctagaactagtggatcccccgggctgcaggaattcgtctcacccctagaaaaggcttattcgatcggctcgcgccattgcaccgcagcagcgttcggcggcatgtcgtcgtcgccggagacggaggccgccgggagcagcagcagcagcaggaagttcaagggcgtgcggaagcgcaagtggggcaagtgggtgtctgagatccggctacccaacagccgcgagcgtatctggctgggctcctacgacgcccccgacaaggccgcgcgcgccttcgacgccgccttcgtctgcctccgcggccgcggcgccgccggcgcggacctcaacttcccggactcgccgccgccgtgccgcgcgggggggcgcagcagcgacccgcgggaggtgcaggcggccgcgctctcccatgccaaccgcgccgccgtcacggcccagcaggcggccgccgcgctcctgaaangnngggggggggggtgttttttttnnnnnnnnnntttnnnntttttntttnttnttttttnnntnntnnnnnnnnnttnnnnnnntttttttttttntttttttnnntttnnnnnntnnnnntttntntttttttnnnnnnnttttnttttnnnnntnnntnttttttnntttttnnnntttttttttnnnnnnnnnnnnntnnnnnnttttttttnnnnttttttttttttnnnnnntnttttnnnttttttnnttttttttnnntntttttntttttttntttnnnnnnttttttt

SEQ ID NO: 75569 - DNA, 903 bp, Zea mays
  misc_feature: Ceres CLONE 1560046
  misc_feature: Encodes the peptide sequence at SEQ ID NO. 75570
  misc_feature (697)..(697): n is a, c, t, g, unknown, or other
ctggagctccccgcggtggcggccgctctagaactagtggatcccccgggctgcaggaattcgtctcacccctagaaaaacctgcactttcactctatcatcatcacctaccaggctatactagcataacaaatcgccaatccctccccgacccgagagagtcagaaatggcatcatctcatagttgctttcgcggctggcagagcacgagacacgtggcagttgcgctggtgtccgtgctgatcctgagctcggcacgtctctccgcgggcggcaggagcctgctggagctgtacaagccgccggccagcgcgctcctgacgtaccacaacggcgccgtgctgcagggccgcatcccggtgtccatcatctggtacggccgcttcacgccggcgcagaaggccgtggtcaccgacttcctcgggtccctcaccaccgccgccgcctcgccgccggcaccgtccccgtccgtgtcgcagtggtggagcaccatcgaccagctgtacctcatcaaggcgcggggcatgggcagcggcggcggctgcggcacgcgggtggcgctcgtcggccaggccaccgacgaagggtgctcgctggggaagcgcctgacgctggcccagctcccgcagcttgcagcgcgggccgggccccagaagggcgggatcgcgctggtgctcactgcgcaggacgtgggccntggacgggttctgcacgagccgctggcggctgcacggctccgacgcctggaccggggaccgcgttacttctgggtcggcaacttcgccttcccagtgcccggggcagtggcgcgtggcgttccaacaggcctctggtacggtcccaaaaacccggggctcgtgccgcccaaggggcaacctctggcccgaacggcatggttgatcc

SEQ ID NO: 75570 - protein, 245 aa, Zea mays
  misc_feature: Ceres CLONE 1560046
  misc_feature (51)..(238): Pfam Name: Phi_1 Pfam Description: Phosphate-induced protein 1 conserved region
  misc_feature (177)..(177): Xaa is any aa, unknown, or other
MASSHSCFRGWQSTRHVAVALVSVLILSSARLSAGGRSLLELYKPPASALLTYHNGAVLQGRIPVSIIWYGRFTPAQKAVVTDFLGSLTTAAASPPAPSPSVSQWWSTIDQLYLIKARGMGSGGGCGTRVALVGQATDEGCSLGKRLTLAQLPQLAARAGPQKGGIALVLTAQDVGXGRVLHEPLAAARLRRLDRGPRYFWVGNFAFPVPGAVARGVPTGLWYGPKNPGLVPPKGQPLARTAWLI

SEQ ID NO: 75571 - DNA, 853 bp, Zea mays
  misc_feature: Ceres CLONE 1560047
  misc_feature: Encodes the peptide sequence at SEQ ID NO. 75572
tccccgcggtggcggccgctctagaactagtggatcccccgggctgcaggaattcgtctcacccctagaaaaaaatcgcgagcaacttcttccggattcgcaccaagctctccacaattctatcgctatgctgcggaaggccgacgtcgccttcatcgactgcaccgccttcttcctcgccttctctgcctactcccgtcgccagggcgttgcagaggttcaattaccagcagttactcacagggtctacctagatgtagaaattgatggccaacacataggtagaattgttattggtctctatggggaggtcgttccaaaaacagttgaaaactttagggctctttgtacaggtgaaaaaggtgtcgggtccaatggcaaacctcttcactataagggaacaccattccatcgtattatccctggcttcatgattcagggcggtgacatagttagaggcgacggtaaagggagtgagtctatatatggaggcatcttcccagatgagaatttcactgtaaaacatacacatccaggggttgttgctatggcgaattctggacttgattctaatggatctcagttttacataactactatcaagacaagctggttggatgcggagcatgttgtcttcggcaggctgatccaaggaatgtataccgtgtacgccatagaacggggcgctgggacttacaatggcaagccaaggaagaaggcggtgatcaccgacgctggtgagatacccacgagaaatgggggtgatcagaaagccgaggggtgtttttctacttcgttgtcacctcaaatcaggtagccatgtacttcctttttttccctggacccccagggg

SEQ ID NO: 75572 - protein, 229 aa, Zea mays
  misc_feature: Ceres CLONE 1560047
  misc_feature (39)..(206): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MLRKADVAFIDCTAFFLAFSAYSRRQGVAEVQLPAVTHRVYLDVEIDGQHIGRIVIGLYGEVVPKTVENFRALCTGEKGVGSNGKPLHYKGTPFHRIIPGFMIQGGDIVRGDGKGSESIYGGIFPDENFTVKHTHPGVVAMANSGLDSNGSQFYITTIKTSWLDAEHVVFGRLIQGMYTVYAIERGAGTYNGKPRKKAVITDAGEIPTRNGGDQKAEGCFSTSLSPQIR

SEQ ID NO: 75573 - DNA, 885 bp, Zea mays
  misc_feature: Ceres CLONE 1560049
  misc_feature: Encodes the peptide sequence at SEQ ID NO. 75574
  misc_feature (773)..(773): n is a, c, t, g, unknown, or other
  misc_feature (805)..(805): n is a, c, t, g, unknown, or other
  misc_feature (856)..(856): n is a, c, t, g, unknown, or other
  misc_feature (857)..(857): n is a, c, t, g, unknown, or other
  misc_feature (863)..(863): n is a, c, t, g, unknown, or other
ctggagctccccgcggtggcggccgctctagaactagtggatcccccgggctgcaggaattcgtctcacccctagaaaaaacttgacactcctgtcctgctcctccactcccacgctcccagccgagctcgagcgcacgcacacgcgcacaagcaggagctcctgtcccgctagatcccaaacagtctcctgcccgcgcgcgtttgggggggggcgcgaaggaatcaccggatggcgatgttcgcgcggccgctgctggccaccctgctgctgctgccggcgttcctgctctctgccgcctcggccgccgacagcaagagcaaccctgctgatgagctcgtggcactgatcaacagcaaccgcactgctggcaaggcatcttctgtttcggacaaccaaggtttgggatgcatcgctctgcagtacatcaaagcatacgaaggccattgtgaccaggtggacgacaagaagccgatggagtcaagcttcaccgacacgttcgccccgacctgtggcgtccaggccacaaccctctccaagatcaccggaaggctggtggcttgccagtcccagtacttggctccagctgaggcctttggcgtcttgttggtgaacgacgcgaagggcctccagatactgcgcagcaagaaccacacggaggtcggggcggctgtgagcggcaccgatggcggtggactgtacttctggtgcgtcctgttcagtgacggcaagccgactacagcttttcaagtggggatggcaaagtgccgaangcagccatccatccggggatgcttcagtggcnacaatgaacgaactgctcggtcccccacaaatggcgcccgttatgaaccanntgctgntgccctgaaggctggtgaacgc

SEQ ID NO: 75574 - protein, 218 aa, Zea mays
  misc_feature: Ceres CLONE 1560049
  misc_feature (181)..(181): Xaa is any aa, unknown, or other
  misc_feature (192)..(192): Xaa is any aa, unknown, or other
  misc_feature (209)..(209): Xaa is any aa, unknown, or other
  misc_feature (211)..(211): Xaa is any aa, unknown, or other
MAMFARPLLATLLLLPAFLLSAASAADSKSNPADELVALINSNRTAGKASSVSDNQGLGCIALQYIKAYEGHCDQVDDKKPMESSFTDTFAPTCGVQATTLSKITGRLVACQSQYLAPAEAFGVLLVNDAKGLQILRSKNHTEVGAAVSGTDGGGLYFWCVLFSDGKPTTAFQVGMAKCRXQPSIRGCFSGXNERTARSPTNGARYEPXAXALKAGER

SEQ ID NO: 75575 - DNA, 860 bp, Zea mays
  misc_feature: Ceres CLONE 1560050
  misc_feature: Encodes the peptide sequence at SEQ ID NO. 75576
  misc_feature (860)..(860): n is a, c, t, g, unknown, or other
tggagctccccgcggtggcggccgctctagaactagtggatcccccgggctgcaggaattcgtctcacccctagaaaaaatcactcccagactgcttccacctacgttcattatttccgcaatgtacaaccgagtatgatatgcagtcgtagtatcatggataaccaccttatgtcgtccttcgccatcctactgctttcttcttttgctgcaatggttgcatatcctgctcgcagtgaattacagcctaaccagatgaaaaaccaccattctgtatcatcatacagcccacaaccgaaggattttccaactgagcaactctacagcgcctacctagtaatccagcgattcaagagcaccatcactagcgaccccaagaacgtcaccgccacctggattggtcatgatatctgcggagaaacgacctacgtggggttctactgcggatcgccggccggaggagataagaagttgacagtcacgggggttattttgaatggctatagtctacatgcaccaacattggaaggtttcgtcaatcagctccctgatctagctcttttccatgctgcttccaacaattttggtggcgatataccccagctaaccgcccttgggtacatgtacgagctcagtgtcgccgctaaagatgtgccattacagactacggatgcgcatgattttgctggggcggaggggcatcggtcgcgtgcaattacgtagatgcgtaactgctgactttgacttttcatttaatgtcggaattaataagggtcacaaattttactggttttacgcattgccaggctctacgtctcagcgacaacaatttgtccgggtcacctgcggtcaaacgtcgn

SEQ ID NO: 75576 - protein, 188 aa, Zea mays
  misc_feature: Ceres CLONE 1560050
MDNHLMSSFAILLLSSFAAMVAYPARSELQPNQMKNHHSVSSYSPQPKDFPTEQLYSAYLVIQRFKSTITSDPKNVTATWIGHDICGETTYVGFYCGSPAGGDKKLTVTGVILNGYSLHAPTLEGFVNQLPDLALFHAASNNFGGDIPQLTALGYMYELSVAAKDVPLQTTDAHDFAGAEGHRSRAIT

SEQ ID NO: 75577 - DNA, 852 bp, Zea mays
  misc_feature: Ceres CLONE 1560051
  misc_feature: Encodes the peptide sequence at SEQ ID NO. 75578
ctccccgcggtggcggccgctctagaactagtggatcccccgggctgcaggaattcgtctcacccctagaaaaaatctcacggctagctagcacaagcatagtgcaggggcttgccacctaagtaaggcccgcctgagagccatggcatccaaggccgtcctcttcatggctctcaacctcctgttcttcacggtggccaacgcctgcggcaactgcccgaccccaacgcccccggtcgagccaccgccgccgcctcctgctgataccccacccccttcgtccagcggcaagtgcccgctgaacgcgctcaagttcggcgtgtgcgccgatgtgctcggcctcgtcaaaggcgaggttggcaaggtgcctgccgagacatgctgtaccctcatcaaaggccttgcggacttcgaggccgccgtctgcctctgcacaggcatcaaggccaacgtgctcagcgtcgtcgtcgatgtccccatcaagctcagcgcgctcgtcaactactgtggcaagtgcgtgcccaagggctacatgtgcgcgtaagcatctccaggcggttacactctcgtagctgttcacgtacgagattatatatgcacgcaccctgcatggcacgaatgcatgcattgtgtccgctgatatatctctcctgtctcagatgtgcacctagctttcggttctacaaaacctagaaccattccagccaaatacttgtcagatcaaatcgcatgtattgtcacttgttgagttcgcattatttttctattggatttggtcacttcctcgtaagagtccgacaccttctcgaaggaaaaaaagaggggggctgcttctagttttttatatctaca

SEQ ID NO: 75578 - protein, 133 aa, Zea mays
  misc_feature: Ceres CLONE 1560051
  misc_feature (51)..(132): Pfam Name: Tryp_alpha_amyl Pfam Description: Protease inhibitor/seed storage/LTP family
MASKAVLFMALNLLFFTVANACGNCPTPTPPVEPPPPPPADTPPPSSSGKCPLNALKFGVCADVLGLVKGEVGKVPAETCCTLIKGLADFEAAVCLCTGIKANVLSVVVDVPIKLSALVNYCGKCVPKGYMCA

SEQ ID NO: 75579 - DNA, 837 bp, Zea mays
  misc_feature: Ceres CLONE 1560052
  misc_feature: Encodes the peptide sequence at SEQ ID NO. 75580
  misc_feature (604)..(604): n is a, c, t, g, unknown, or other
ggagctccccgcggtggcggccgctctagaactagtggatcccccgggctgcaggaattcgtctcacccctagaaaaattcttccccctccggcgccgcctcccccagacacttcgccgccggcaagatgggccgcgtgattcgcgctcagcgcaagggtgcggggtccatgttcaagtcccatacccatcaccgcaagggccctgcccggttccggtccctcgacttcggcgagcgcaacgggtacctgaagggcgtggtcaccgacgtcatccacgacccgggccgcggcgcgccgctggccaaggtcaccttccgccatccattccggtacaagcaccacaaggagctgttcgtggctgctgagggcatgtacactggccagttcgtttactgcggacgccgtgctacactctccattggcaacgtcctgccgctcagggggatccctgagggtgccgttgtctgcaacgttgagcaccacgtcggggatcgcggtgtcttcgccagcgcgtctggagactacgcgatcgttatcagccataacccagaacacggcacatcgaggatcaagctcccctctggtgctaagaagaaatgtccnagtagctgccgtgccatgattgggcaggtcgctggtggtggcaggactgaaaatccatgctgaaagctggcaatgcctaccacaagtacccgtccagaagaacagctggcctaaaggggcctggtgtggccatgaaccctggtgacattctccttggaggaagtaccccccaccccttggtcatggctcccccgtcccccgggaacccccccctggccaaaagttgggttttt

SEQ ID NO: 75580 - protein, 179 aa, Zea mays
  misc_feature: Ceres CLONE 1560052
  misc_feature (11)..(90): Pfam Name: Ribosomal_L2 Pfam Description: Ribosomal Proteins L2, RNA binding domain
  misc_feature (96)..(178): Pfam Name: Ribosomal_L2_C Pfam Description: Ribosomal Proteins L2, C-terminal domain
MGRVIRAQRKGAGSMFKSHTHHRKGPARFRSLDFGERNGYLKGVVTDVIHDPGRGAPLAKVTFRHPFRYKHHKELFVAAEGMYTGQFVYCGRRATLSIGNVLPLRGIPEGAVVCNVEHHVGDRGVFASASGDYAIVISHNPEHGTSRIKLPSGAKKKCPSSCRAMIGQVAGGGRTENPC

SEQ ID NO: 75581 - DNA, 1008 bp, Zea mays
  misc_feature: Ceres CLONE 1560056
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaactggagctccccgcggtggcggccgctctagaactagtggatcccccgggctgcaggaattcgtctcacccctagaaaaagcggaagctgtccagatcgcgtgattccgcatcccgttcgcgagcgcgacacagcgctgacagctcacggctgaccttcccgacggcctccagctccgtcttgattcttgaggcgaagccccggtgagccaagcccatcggccaaacactagcaatccagctgcttccgcttcaacgctccgtggctcgattcagtacggtttcggaatatggctgcgaaggactaactctttcggacggcgattctgtctcaggtgcataagagtctgccatgggcagcgagaagtaggacttggggttcgagaaagtcggcaagcaccaacgtcaccgagggactgctggaataaccatcgccgggcagggtgcaagttattctggctctggctccatactcgggttcccccttttgtgggggggcttgggaattttgggaaaaaccggttggggcatgcccctctgggggggttttcccgtggacggaaaacccgtttttttgggggaaaatgggctttgggggggtcccccccctccggggggggaaaaggggcaaaacccccccccttttcggaaaccccccccctttgggttttcccaaaaaagggtttttttttcccccccctttgggaggggaaaaggtttttttccgcgcccgcccttctctttgttgttttaaaaaaaaaaaaaaaagcgcgtcccctcttttataaaaaaagggtgtttttttttgggggggaagaaaaataaatttttttccgttggtggggaaaaaaacagagggggcgttttccttctttcccgcgcgcgggggggaaaaaaaatttaagattaaataa

SEQ ID NO: 75582 - DNA, 745 bp, Zea mays
  misc_feature: Ceres CLONE 1560058
  misc_feature: Translation starting site: 121
  misc_feature (430)..(430): n is a, c, t, g, unknown, or other
ggagctccccgcggtggcggccgctctagaactagtggatcccccgggctgcaggaattcgtctcacccctagaaaaaaccaacctcagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaagtggcgaaacatcgacctcctctgaccggccctgtggttcccggcgcctgcgccgactacctggacggctcctggtcggcgactacgttcgaccgttcgtctcgggagcccgtgagtactgcagtcgagtggactcctggacagaactggccaagaatgagccggcggcatcatcngcacccgttcgagtcctcgaagtcaagtccaccccgttgcagccctacagcgaggtgttccgcctcccagcggtttccgcaatggcgaagcttatccaccggccgctgggccaatggttcgccacccttgggggccttcttccgtgaaaggggttaaccggggtcacctggcaggacccccggaaagggggaacctggggaaagggtccctcctacccggggccaaccccttgcccttttccatttttgagcccttatttggaaacaaggggccctcggaaacgggctaccccccagttccccgccccaccccca

SEQ ID NO: 75583 - DNA, 871 bp, Zea mays
  misc_feature: Ceres CLONE 1560061
  misc_feature: Encodes the peptide sequence at SEQ ID NO. 75584
  misc_feature (797)..(797): n is a, c, t, g, unknown, or other
ctggagctccccgcggtggcggccgctctagaactagtggatcccccgggctgcaggaattcgtctcacccctagaaaaagcgcgtccccccttatcccgagcgcgtttctttccgatcccaaagctcccgcacaccctgcctgatccctcccaataagctccccagctccacgccggacgcagcagcagcagcagtagagatggccgccctcgccgcctcctccacggccgccttcgccgccaagccgcgcctcccacgcgcgcgcctcaccgtggcctgctccgccaccggcggcgacggcaacggcagcagcagcagcgtgtcgctcgcatcctccgtgaagacgttctcggccgcgctggctctgtcgtcggtgcttctctcctcggccgccacctcccctccccccgcggccgccgacatcgcggggctgaccccgtgcaaggagtccaaggcgttcgccaagcgcgagaagaactcgatcaagaagctcaccgcgtcgctcaagaagtacgcgcccgacagcgccccggccctcgccatcaacgccaccatcgagaagaccaagcggcggttcgagaactacggcaagttcggcctgctctgcggcgccgacggcctgccgcacctcatcgtcagcggcgaccagcggcactggggcgagttcgtcaccccgggcctgctcttcctctacatcgcccgggtggatcgggtgggtcggcaggagctacctcatcgacgtcagcggcgagaagaagctgccatgaggtagatcatcatcgacgtcgaggtcgncaccctgctcctccccagggggttcatctgggcccgtcgcggcctacggcgagctcatcaatgggagacttcgt

SEQ ID NO: 75584 - protein, 190 aa, Zea mays
  misc_feature: Ceres CLONE 1560061
  misc_feature (49)..(190): Pfam Name: PSI_PsaF Pfam Description: Photosystem I reaction centre subunit III
MAALAASSTAAFAAKPRLPRARLTVACSATGGDGNGSSSSVSLASSVKTFSAALALSSVLLSSAATSPPPAAADIAGLTPCKESKAFAKREKNSIKKLTASLKKYAPDSAPALAINATIEKTKRRFENYGKFGLLCGADGLPHLIVSGDQRHWGEFVTPGLLFLYIARVDRVGRQELPHRRQRREEAAMR

SEQ ID NO: 75585 - DNA, 861 bp, Zea mays
  misc_feature: Ceres CLONE 1560063
  misc_feature: Encodes the peptide sequence at SEQ ID NO. 75586
  misc_feature (787)..(787): n is a, c, t, g, unknown, or other
ggagctccccgcggtggcggccgctctagaactagtggatcccccgggctgcaggaattcgtctcacccctagaaaaaatgggccaccaatggcgacccccaccgccaccgcactcacctgctcctgccgcccttcgtcgccctcctcatcctccgccgccatccgccggctgaacatcttcgcccccgtctccggcgcccattctcctactcgacgccgcctccgtctcgcgccattgcacgtcgtcgacgactccaaggacccccccgaggagaggtctgagacggataagatggtcgacggcatggacttcggggagctctgcagcgacttcgagtgcataagcagcccctacgtggagtcgacggcgaggcaggtcgcgcgggacatcctggagctccgtgaggacaaccgcgcattcaactgctacgccgtctccgtcaagtacaaggacccactcaggacatttgttgggcgtgagaagtacaggaggccgttgtggatcaccaaggcgttggaaaaccctgtagtgacagtccaggaaatgtcaatgcagtcgacgagcaacctgaccatcagatgggcgttgagagggaagcctaagaacccgttgttcgcgagcgtcggaggagacgtcatcgtccgcgtcgagtcacggttcgtcctgaaccagataagcgggcaggtgctggagcaagccgagtcctgggaactctacgcctcgtccctcctgcgcaggcctacttctggctgtcccgaagggtctactccgccgtggagtccggnaacgacgccatcgaagccgcaagagcgcggcgtcgtctgggctgacgaccgagggagacagaatctcgagcctt

SEQ ID NO: 75586 - protein, 189 aa, Zea mays
  misc_feature: Ceres CLONE 1560063
  misc_feature (165)..(165): Xaa is any aa, unknown, or other
MVDGMDFGELCSDFECISSPYVESTARQVARDILELREDNRAFNCYAVSVKYKDPLRTFVGREKYRRPLWITKALENPVVTVQEMSMQSTSNLTIRWALRGKPKNPLFASVGGDVIVRVESRFVLNQISGQVLEQAESWELYASSLLRRPTSGCPEGSTPPWSPXTTPSKPQERGVVWADDRGRQNLEP

SEQ ID NO: 75587 - DNA, 849 bp, Zea mays
  misc_feature: Ceres CLONE 1560064
  misc_feature: Encodes the peptide sequence at SEQ ID NO. 75588
ctggagctccccgcggtggcggccgctctagaactagtggatcccccgggctgcaggaattcgtctcacccctagaaaaaaagcgttccagatcgtactggaccaatctgccaccacactttgatcacacacagacacaggaagttgagatcagaaagatgcaggctgccgctactgccgccgggttctcggccgtgctgcccgccaagggcaggccggcggcgaggagcagggtggtggcccgtgtccccgccacaaggaggagcgtccgcgcagctgccgtcgtcgcgaccgaggccgcgcagatcgactacagctcaagcgtctcggtgttcccgatggaggcctgcgacctgcttggtggcgacgcgtgcaacgggcccatgttcccggaagccaagcccgcctcggcggcggcggcggcgagcaggagtgtggtcggggtggacagggactacctgtcctacgacgagccaaagacggtgttcccgggcgaggcgtgcgacgacctcggcggcgagttctgcgaggcgccgtaccaggacggcgtctccagggagctggcgcacgcctgaagaccctgatccatccatgtctgtcaccacgctatgtacgtatgtgtagcagatgggttacatctacggtgttagaacaactccagcagcactccgcatgccggctccggatcccttattttgcggagcccaagctccttatttcatcagtccagcagggttcggcattccgggttcctaaaaaacccaacgggcctggaacctggcacttcccccattttccagcgtttttttctcttcctttcccccgggaaatttttttgtgggggggcgg

SEQ ID NO: 75588 - protein, 138 aa, Zea mays
  misc_feature: Ceres CLONE 1560064
  misc_feature (1)..(126): Pfam Name: Lir1 Pfam Description: Light regulated protein Lir1
MQAAATAAGFSAVLPAKGRPAARSRVVARVPATRRSVRAAAVVATEAAQIDYSSSVSVFPMEACDLLGGDACNGPMFPEAKPASAAAAASRSVVGVDRDYLSYDEPKTVFPGEACDDLGGEFCEAPYQDGVSRELAHA

SEQ ID NO: 75589 - DNA, 854 bp, Zea mays
  misc_feature: Ceres CLONE 1560065
  misc_feature: Encodes the peptide sequence at SEQ ID NO. 75590
  misc_feature (310)..(310): n is a, c, t, g, unknown, or other
  misc_feature (474)..(474): n is a, c, t, g, unknown, or other
  misc_feature (624)..(624): n is a, c, t, g, unknown, or other
  misc_feature (665)..(665): n is a, c, t, g, unknown, or other
  misc_feature (697)..(697): n is a, c, t, g, unknown, or other
  misc_feature (762)..(762): n is a, c, t, g, unknown, or other
  misc_feature (817)..(817): n is a, c, t, g, unknown, or other
ctggagctccccgcggtggcggccgctctagaactagtggatcccccgggctgcaggaattcgtctcacccctagaaaaaggagcactcaccagtcaccactcagcagcgatcgcagcaccgcggcgagataatgagcagcctgtcctccggcatctctgcctcgccatctgcagcgcccagcaccgctcggcgccgccatgacgcagcgccgcagcagctgaagggtgaaggcggcggcgcggccacagctgctgcacgccggccgccggcgttcgagtgtcgggaggaggccgggcggggggtggtgngtgtgttgagggccgggcctgggccgctgtcggagatcgagccggacctggaggaggacgccatcgacgtgtaccgcaccaacggcatcagcccggaggacttcgagtacgggaagtatgacggacaccacacctatttcgaaggtcaagacaagaagggcttnctgggaggattgtctccgagtggtaccaagaagctgagcctcctcagggctttcaagcactcatctcctgggcatttcctcctgcgatcatcctcggcatggctttacatgtgccggggggagtacctgtacatcggggcggccgtcttncatcgtggtgttctgcgtcatcgagaatggcaagcccgacnagccgcacaacttcgagccggagatctattgnattggagaagtccgcccgcgacaagctcatcggcgactacaactccatgaacatctgggacttcnacgagaagttacgcgagctcctgggacttcaccgtccacacagggacgacatccntcagtcgaacctagatgcggtgcatacaccgctcgct

SEQ ID NO: 75590 - protein, 204 aa, Zea mays
  misc_feature: Ceres CLONE 1560065
  misc_feature (60)..(60): Xaa is any aa, unknown, or other
  misc_feature (114)..(114): Xaa is any aa, unknown, or other
  misc_feature (164)..(164): Xaa is any aa, unknown, or other
  misc_feature (178)..(178): Xaa is any aa, unknown, or other
  misc_feature (189)..(189): Xaa is any aa, unknown, or other
MSSLSSGISASPSAAPSTARRRHDAAPQQLKGEGGGAATAAARRPPAFECREEAGRGVVXVLRAGPGPLSEIEPDLEEDAIDVYRTNGISPEDFEYGKYDGHHTYFEGQDKKGXLGGLSPSGTKKLSLLRAFKHSSPGHFLLRSSSAWLYMCRGEYLYIGAAVXHRGVLRHREWQARXAAQLRAGDLLXWRSPPATSSSATTTP

SEQ ID NO: 75591 - DNA, 931 bp, Zea mays
  misc_feature: Ceres CLONE 1560068
  misc_feature: Encodes the peptide sequence at SEQ ID NO. 75592
ctggagctcaccgcggtggcggccgctctagaactagtggatcccccgggctgcaggaattcgtctcacccctagaaaaaaacggtcacttgatcacttctagctctcgtggagtcatgcgtcctacatcgtagcctctactcccgcggtcagggtaacgccgcgagtctcccgtcacatactcactcacacccatggccgcaccgacggccgcctcactagaggcactcgccgacctcccaccgcgccttagcccaacaacagattctcaccttgaccccgccatcctcggtccacagaatccgccgccagtacctccttctccgaccgctcggtatcgctggcggagactgccacggaggcggccaactccccatccactgccttcctcgactacggggcccgagccatgtatcgtgcgatgcgcataagctacgtacatatcacatccatggtcacggatcagaccgtaccgattcatacacatgaccgacactcacggattgagttgtctgtggttgcgctgctaatggcattgcaggtgcctatactgactagaacatgagcctctcatctgaggggaaccgttagtagagatcgcatttcggctgaaagaaaacggaattacccgtttggcaaagtcacctccaccttaaagccccctattacttgtcggaaccagtgccctttttgctggggggaatacttctttggccgattcccaaaggggaagggccaaaaaactccctgggggaaaaaacctttggggggttgttcccacaaaattctttaattcccggccattggggaaaaagggaataaaaggggttaaaaacctcttaaaaagaaggggtgaaaaaatttttaaaattttaacccccccccaaaaaataatggggaaagtgtcccaacaaaaaggtggggagaagat

SEQ ID NO: 75592 - protein, 51 aa, Zea mays
  misc_feature: Ceres CLONE 1560068
MYRAMRISYVHITSMVTDQTVPIHTHDRHSRIELSVVALLMALQVPILTRT

SEQ ID NO: 75593 - DNA, 866 bp, Zea mays
  misc_feature: Ceres CLONE 1560069
  misc_feature: Encodes the peptide sequence at SEQ ID NO. 75594
  misc_feature (750)..(750): n is a, c, t, g, unknown, or other
aagctggagctccccgcggtggcggccgctctagaactagtggatcccccgggctgcaggaattcgtctcacccctagaaaaaacgtgcgcaccgcctgctcgacgcaattccccactcgcccaccaaccttcccgtccccgatggcgatcatggcggccaccgccactgccgtggcttccccctccagctccacctcgccaggtcccctccaacccagcccccgcttcctccctcccgtctccacgcccgctcgctgccatctcctccccaagccgcggcggtggtgcgcgcgcctccacatcgagcgtcgggtggccgtcggcagcgacgtgtcctcgtcccatgacgtggctgccgaggaggccgctgctgcgtccaaggtcgggaagcgcgtgcgcgtcacggtgcccgtccgcgtccaccacgttgccaaggcgcccggcctggacctgcgcggcatggagggcgtcgtcaagcagtacatcggcgtttggaaggggaagcgcatcacggccaatctccccttcaaggtggagttcgagctcaagctggacggccatgacaagccggtccagttcatcacccacctccgctagcaagagatcgagatcctcgcggaggaatagagctctgcactagagaataacgcgctctcatcggcggctgtggcatctgtatactattgtgtctgcgctaaagaagacgtggtcaagggtgcggggagataggagattgcaactttgctagnaagctccctgtttgtttgcttatatgcggtgcggcttctcccctcttcaccctttaacattgaaaattcctaatgtgaaggattgaggaaatggtccgatggtggatacttaggaa

SEQ ID NO: 75594 - protein, 151 aa, Zea mays
  misc_feature: Ceres CLONE 1560069
  misc_feature (81)..(152): Pfam Name: FeThRed_A Pfam Description: Ferredoxin thioredoxin reductase variable alpha chain
MAIMAATATAVASPSSSTSPGPLQPSPRFLPPVSTPARCHLLPKPRRWCARLHIERRVAVGSDVSSSHDVAAEEAAAASKVGKRVRVTVPVRVHHVAKAPGLDLRGMEGVVKQYIGVWKGKRITANLPFKVEFELKLDGHDKPVQFITHLR

SEQ ID NO: 75595 - DNA, 866 bp, Zea mays
  misc_feature: Ceres CLONE 1560070
  misc_feature: Encodes the peptide sequence at SEQ ID NO. 75596
  misc_feature (632)..(632): n is a, c, t, g, unknown, or other
  misc_feature (846)..(846): n is a, c, t, g, unknown, or other
ctggagctccccgcggtggcggccgctctagaactagtggatcccccgggctgcaggaattcgtctcacccctagaaaaacccgccgcgctcggccagctcgtctactccgtccccggcgctaagcacatcctcgagatgccccccatgaccgcgcaggtgacgaggttcaagtgtgggggcttcgcgctcggcctggccatgaaccactgcatgttcgacggcatcggcgccatggagttcgtcaactcgtgggcggagacggcgcgcggcgtcgccgagctcaccgtgccgccgttcctggaccgaagcgtcctgaaggcgcgcgacccgcccgtgcccaccttcccccaccacgagttcgccgagatccccgacgtctccgacacggcggcgctctacggcgcgcaggagctgctgtaccgctccttctgcttcgacccggaccggctggagcgcgtgcgcgggcttgcgctcgccgacggcgccctgggccgctgcaccaccttcgaggcgctgtcggggcttggtgtggcgcgcgcgcacccagggcgctggggctggcgcccgagcagcgcaccaagctgctgttctccgtggacgggcggcgccggttcgcgccgccgctccagncggggctacttcggcaacggcatcgtgctcaccaacgccctttgcacggccggcgagctgctgtcccccccccttgtcccccccggccgggcttgggtccagaccccctgcggatggtcaccgacaataacttgcgctcggcggggggactactttggaggggacccgggcccggccctttcttcccgtccccccttgtcataacacacctgtnttcggcccccaggttccccg

SEQ ID NO: 75596 - protein, 277 aa, Zea mays
  misc_feature: Ceres CLONE 1560070
  misc_feature (3)..(277): Pfam Name: Transferase Pfam Description: Transferase family
  misc_feature: SWISSPROT Homolog: EC 2.3.1.162 Taxadien-5-alpha-ol O-acetyltransferase
  misc_feature (210)..(210): Xaa is any aa, unknown, or other
GAPRGGGRSRTSGSPGLQEFVSPLEKPAALGQLVYSVPGAKHILEMPPMTAQVTRFKCGGFALGLAMNHCMFDGIGAMEFVNSWAETARGVAELTVPPFLDRSVLKARDPPVPTFPHHEFAEIPDVSDTAALYGAQELLYRSFCFDPDRLERVRGLALADGALGRCTTFEALSGLGVARAHPGRWGWRPSSAPSCCSPWTGGAGSRRRSXRGYFGNGIVLTNALCTAGELLSPPLVPPGRAWVQTPCGWSPTITCARRGDYFGGDPGPALSSRPPLS

SEQ ID NO: 75597 - DNA, 880 bp, Zea mays
  misc_feature: Ceres CLONE 1560075
  misc_feature: Encodes the peptide sequence at SEQ ID NO. 75598
ggagctccccgcggtggcggccgctctagaactagtggatcccccgggctgcaggaattcgtctcacccctagaaaaaaccacacctccagtcctccactgacaagccgccgccgctcttccacctacctctccccggcctcgcacccatggccacggctttgatggttgcagccaccacctcctgctccccgggccgcgccgcgccgcgcctgaagccggtggcctcctcctcctccagcagcagcagcagcagctcggcgcggccgcggcggcccttggcgcaacagctcccgcggctgctggcgacggcagctgcggcggcagaagcagccgcgccgctcccggcactggcggagcacatggagaaggccgcactgtttgacttcaacctgacgctcccggcgatcgcgacagagttcctgctgctcatggtggcgctggacaagctctacttcacgccgctagtcaagttcatggatgagcgtgacaccaagatctgcggtgagctcggcgatgtcagggcaacttccatgatgtgaagcagctggaggacagagctgcgccatcatgaaggcgtgccccgtctagatccccgcggcgcttaacaagagacgtagggtaccaccgccgaatttggaggcaagctggacaaaggatcccaccctggggaaggccgaaaatttaaaaagccctcccccaacttcaaggccaaaaggagaagcctttaaaggggtttcaaacccgaattcccttcctcccggggaaaaagcccccgaaaaggtccctcccttcccggagaaaaacacaaacgggcccccggctttaatcccgccaccaaagttaacgggaaaccttttaaatcctggggaattttggaa

SEQ ID NO: 75598 - protein, 130 aa, Zea mays
  misc_feature: Ceres CLONE 1560075
  misc_feature: SWISSPROT Homolog: EC 3.6.3.14 H(+)-transporting two-sector ATPase
MATALMVAATTSCSPGRAAPRLKPVASSSSSSSSSSSARPRRPLAQQLPRLLATAAAAAEAAAPLPALAEHMEKAALFDFNLTLPAIATEFLLLMVALDKLYFTPLVKFMDERDTKICGELGDVRATSMM

SEQ ID NO: 75599 - DNA, 958 bp, Zea mays
  misc_feature: Ceres CLONE 1560077
  misc_feature: Encodes the peptide sequence at SEQ ID NO. 75600
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (303)..(303): n is a, c, t, g, unknown, or other
  misc_feature (342)..(342): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnaaaaaaactgggaaactccccgcggtggcggccgctctagaatagtggatcccccgggctgcaggaattcgtctcacccctagaaaaatgttttgttctctgtgagcgtcgtgggtgttgatggcgtcaacggcgtactcgcggccatccaagccgcctgggccggcggccggagacaggagcggaccgcggctggtccaagagctcggcaggatcgagcccnagaagctgggcatcgggctggttgccggctgctgcttcncgctgctcacctacctctcttttgcccgggctgttgcatctactcgccggtttcgacagctcgtcgtccatgtggtgagaaaaatggcgccagcaacgaccaagggggccgggtacagctaccggggcccctccccggggaagaaccaaaaaaagggtttctgcccccttaaaggggaaccccccattttcccaaaatttttccggggggccccccaaaagaggtcttccccgggggggggggcccggtgaaaaaaaaaccccccgggggggggggcccacttttttatcaaaagggcccaaaatatatccccctttttccaaaaaaaaaaggggggccttcaaaaaaaggggtgtttttctctaaaaaaacaaggagcgcccccgcggttttttttagaaaaaaaaaaccgggggaaaaaaaacaacgggtggttgccccccccctaggagaaaaaaacaaaattttttttttttttttttataaaaggccccgggggggggggggcgccctctttttttttttctccttcctgggggggggaaaaaaaaaaaaaaaaaaaccccttttttctctcccccgggggggaagagattattactttctctttccccgg

SEQ ID NO: 75600 - protein, 130 aa, Zea mays
  misc_feature: Ceres CLONE 1560077
  misc_feature (35)..(35): Xaa is any aa, unknown, or other
  misc_feature (48)..(48): Xaa is any aa, unknown, or other
MASTAYSRPSKPPGPAAGDRSGPRLVQELGRIEPXKLGIGLVAGCCFXLLTYLSFARAVASTRRFRQLVVHVVRKMAPATTKGAGYSYRGPSPGKNQKKGFCPLKGEPPIFPKFFRGAPQKRSSPGGGAR

SEQ ID NO: 75601 - DNA, 859 bp, Zea mays
  misc_feature: Ceres CLONE 1560078
  misc_feature: Translation starting site: 203
  misc_feature (855)..(855): n is a, c, t, g, unknown, or other
ccccgcggtggcggccgctctagaactagtggatcccccgggctgcaggaattcgtctcacccctagaaaaaactgcgagggaaggagggagagaaaaaggggagcccgatccaatcccaatcccctcccgccgcgtcacatcgccgccgtcctcgtgccccgttacctctaaaaccctagcggggagccgccgagccggggatgaagatccagtgcaacgcgtgcggggccgcggaggcgcgggtgctgtgctgcgcggacgaggccgcgctctgcgtcgcctgcgacgaggaggtgcacgccgccaacaagctcgccgggaagcaccagcgggtgccgctcctgacggacgccgccgccgctgccgccgcagcggcgccggccgtgcccaagtgcgacatctgtcaggtggaacaaataggtaatcttcaagatgaaagacaagatcgctacacaatgcacacaatagctcaggctcatgtgtgtgttgcatcccacagtctcatgcgcatgtttacttgcagaagttcatgaaaagacacgtgcacttgaggcttctgggtacttcttctgcctagaggaccgtgcactactttgtagagactgtgatgttgctatacacacagtgaattcctttgtttcagcacatcagagattcctgctaactggagttcaggtgggtcttgatcctgctgatccagttccacctattgctgaaaagcatgttaatgctgctggtggatcagtaaaatcaccagtgagacatcagccaaggagaagcccgacagttcaattttcaggtgaaagggagtgcttctgttcctaccaaaatgtaccaaatggagattgttcanggca

SEQ ID NO: 75602 - DNA, 787 bp, Zea mays
  misc_feature: Ceres CLONE 1560081
  misc_feature: Encodes the peptide sequence at SEQ ID NO. 75603
tccccgcggtggcggccgctctagaactagtggatcccccgggctgcaggaattcgtctacccctagaaaaatcctcccctcccctccccatctcgctcttggggagatcgaagagaagctgaggcttagcgccgcacccgccgccgcatcagccatcagccatgacgctggccgctcgcctcgtctcgcgctcccgtcagctacattcggttcaagctgcttttgctaatggaggtgccactcaagttcgctcctttgccaaggatgcagctccagctgaccgccctcctgttagtggggatgatctcctgaagggcatattctttgaggtaaagaagaagtatgagacagctcttggcgtccttaagagggacaagattactattgatccagatgacccagcggcagtttctacatatgctcaagtcatgaagactgctagggaaaaggcggatcttctttctgaatctcaaagggataaatataccagttgagacttttcacaagggcatccctgaatgcacggacttacctgaataactcttcagcggctcagaattaaagaagtggtcttatggatccaaatgggaagtcggaccctttgaatgaaaggaaagcccctgaaaaaaaatcgggaacgggatttttaaaaaaacccccttttttaaagggggtgaccccaaaaaaaaaacagggcgcccccctttttggggccaaagatttttgaaaaaaaattaaacccccaaagaacttggtgggattttcttaaaaaagggaggaattttt

SEQ ID NO: 75603 - protein, 110 aa, Zea mays
  misc_feature: Ceres CLONE 1560081
MTLAARLVSRSRQLHSVQAAFANGGATQVRSFAKDAAPADRPPVSGDDLLKGIFFEVKKKYETALGVLKRDKITIDPDDPAAVSTYAQVMKTAREKADLLSESQRDKYTS

SEQ ID NO: 75604 - DNA, 892 bp, Zea mays
  misc_feature: Ceres CLONE 1560083
ctccccgcggtggcggccgctctagaactagtggatcccccgggctgcaggaattcgtctcacccctagaaaaaattgcccccctcacacacacacactctctctctctccccccattgtgtcactgtaactagcaattgagctcttaaaattttggttgaggtgcagtagcaaggcacactactacgatctacaaacaagatgatcagttgatgcccggtgtcttcaggatcttttcaggttcgcgaggtcccattttgcttctccccccgggcttgcagttgcgtttgagtgcacctctgaggctttggttggccctcgcgctgcgtacttaagctctccgctccctccacggcgttgcatctctcatggcactcggtgtctcctgatagctgctgcttcgatctactccacctaaccgagagagcgtcgtgtagggtcttggattcttggtccagtgctgttggcctgtttcttgagatcgaagatccaggagatgatcctgcggcggagatcgaggtcgatgaacagcagcgtcggcgcccagagaagccacgtccccgatcagtccccgagatcgtcgaccagtccatgcaacggtgacagtgggcggggccgggccccccggcaacaagaatgccaccgcgcgtgccctgttcccttccccgaaggtggtggaatttttttccctggcccccggaaccgttcccttttccaaaaaaccccggcccgaaaccaaaaccccaaagggcctttcccttaaacccaacctcccgtgtctaaaccggggggggccttttcccccgggaaaaaaaggcccccgaaaaacccccccccccggggggggggccgaaaaaaaaaagatcctcagaaacccttggaatcacaaccc

SEQ ID NO: 75605 - DNA, 812 bp, Zea mays
  misc_feature: Ceres CLONE 1560086
  misc_feature: Encodes the peptide sequence at SEQ ID NO. 75606
  misc_feature (646)..(646): n is a, c, t, g, unknown, or other
ctggagctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactaccctcggaaaccgagcctcatccacgcgcagagcatcctcgccatctgggccctgcaggntcgtgctcatggggcgccgtgaagggctaccgcatcgcccggggcccgcctcgggcaaggtcgtcgaaccgctctaaccccggggggaacttttcaaacccgtttggccttccccgaggaaccccaagggccttttccttaaagttcaggggaaagggacttccaa

SEQ ID NO: 75606 - protein, 172 aa, Zea mays
  misc_feature: Ceres CLONE 1560086
  misc_feature (65)..(173): Pfam Name: Chloroa_b-bind Pfam Description: Chlorophyll A-B binding protein
  misc_feature (166)..(166): Xaa is any aa, unknown, or other
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYPRKPSLIHAQSILAIWALQXRAHGAP

SEQ ID NO: 75607 - DNA, 868 bp, Zea mays
  misc_feature: Ceres CLONE 1560087
  misc_feature: Encodes the peptide sequence at SEQ ID NO. 75608
  misc_feature (588)..(588): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (596)..(596): n is a, c, t, g, unknown, or other
  misc_feature (599)..(599): n is a, c, t, g, unknown, or other
  misc_feature (600)..(600): n is a, c, t, g, unknown, or other
  misc_feature (602)..(602): n is a, c, t, g, unknown, or other
  misc_feature (603)..(603): n is a, c, t, g, unknown, or other
  misc_feature (605)..(605): n is a, c, t, g, unknown, or other
ctggagctccccgcggtggcggccgctctagaactagtggatcccccgggctgcaggaattcgtctcacccctagaaaaaaatcctggggcgagcgactgcctccttccctcgatctattccccatcttgtcctccctttgctaaaaataacgaggcagaggcatcttcgatttgacgtgcgcttcctcttcctcgctcgctctcggtcgcagtgatggctgatgtcgacgagtaccgttgcttcattgggaacctgtcctggtcaacgactgatgaaagcctcaaggatgcgttcagcaaattcggcaacctcactgaggcaaaggtggttcttgacaaattttcaggacgttctcgtggtttcggctttgtaacttttgatgagaagcaagccatggaggatgctattgagggaatgaatggactggacttggacgggaggaacatcactgttgataaagctcagccacaaggacctggtagagaccgtaatggtgaccgtgattatgaccgcgagcgtggatctcgttatgaacgtggtcgtgactatggtggtgggcgtgcaccgcgaggtggtggggtggttnttnnnttngcnntnncnactgcttcaggtgggggaaacctggttctgttgctagaaagtgcccattctgggatggtgggaaaaggtacagatttggttgggagaccataccggtatgggtgccaaccccctttttcccccgctaaaagctttcgacccgggtggggctccccagaacaaggcccgggccctacactggggcccagggtgagggggagcccaaaaccggtccccctttgccccgttttcgcttttgcgggggggccccctccccgcgcgag

SEQ ID NO: 75608 - protein, 217 aa, Zea mays
  misc_feature: Ceres CLONE 1560087
  misc_feature (9)..(80): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (125)..(125): Xaa is any aa, unknown, or other
  misc_feature (126)..(126): Xaa is any aa, unknown, or other
  misc_feature (127)..(127): Xaa is any aa, unknown, or other
  misc_feature (129)..(129): Xaa is any aa, unknown, or other
  misc_feature (130)..(130): Xaa is any aa, unknown, or other
MADVDEYRCFIGNLSWSTTDESLKDAFSKFGNLTEAKVVLDKFSGRSRGFGFVTFDEKQAMEDAIEGMNGLDLDGRNITVDKAQPQGPGRDRNGDRDYDRERGSRYERGRDYGGGRAPRGGGVVXXXAXXTASGGGNLVLLLESAHSGMVGKGTDLVGRPYRYGCQPPFSPAKSFRPGWGSPEQGPGPTLGPRVRGSPKPVPLCPVFAFAGGPPPRA

SEQ ID NO: 75609 - DNA, 817 bp, Zea mays
  misc_feature: Ceres CLONE 1560088
  misc_feature: Encodes the peptide sequence at SEQ ID NO. 75610
  misc_feature (695)..(695): n is a, c, t, g, unknown, or other
gagctccccgcggtggcggccgctctagaactagtggatcccccgggctgcaggaattcgtctcacccctagaaaaagtattccttcagggaacggcttccatagcgctgaagcgaggcgtgccgcattgggttgttcgagagctcctagtgttgccctactacatgatggagggcgatctccccacgcccgcgaacgctagggttgttgccgtggtcaccggcggcaacaaggggatcgggctggaggtgtgccggcagctggcctgcagcggcgtcaccgtcgtcttgacagccagggacgacgcgaggggcgcggcggccgtggagaacctcagaggcctggggctctccgatgtcctcttccaccgactggacgttaccgacgctccgagcatcgctcgactcgctggtttcctcgagacccgtttcgggaagctagacatcctggtaaataatgccgcgattggcggggttgagtatgttcatgaccaagattgtggctcagtaacgagcgaggaaaaggcaaagttgagcggcatggacatggatcagaggcttggatggctgtgggagaattgccgggagacctacgacgatgcaaagacaggcctacgaacaaactactacggcacaaagcaagtaatcgagactttactgtctctactgcaagccctcctcggatgggaggatcgntaacggtctccttccacttcggccagctaaggctttttccaaaaacaaggaacttaaacccgggaccttaaacaaatttgaaaacccctcccccccaaaaaagctggagggccctccttgaa

SEQ ID NO: 75610 - protein, 176 aa, Zea mays
  misc_feature: Ceres CLONE 1560088
  misc_feature (13)..(172): Pfam Name: adh_short Pfam Description: short chain dehydrogenase
  misc_feature: SWISSPROT Homolog: EC 1.1.1.184 Carbonyl reductase (NADPH)
MEGDLPTPANARVVAVVTGGNKGIGLEVCRQLACSGVTVVLTARDDARGAAAVENLRGLGLSDVLFHRLDVTDAPSIARLAGFLETRFGKLDILVNNAAIGGVEYVHDQDCGSVTSEEKAKLSGMDMDQRLGWLWENCRETYDDAKTGLRTNYYGTKQVIETLLSLLQALLGWEDR

SEQ ID NO: 75611 - DNA, 796 bp, Zea mays
  misc_feature: Ceres CLONE 1560091
  misc_feature: Encodes the peptide sequence at SEQ ID NO. 75612
ctggagctccccgcggtggcggccgctctagaactagtggatcccccgggctgcaggaattcgtctcacccctagaaaaaagggagccgtagaggagcagcaggtgcaccaaaaggatggcagcgccaggctccctgcgacttctccaggccccgtccttcggtgcggccaagtgccagccgatggcgggccgggcatcggcgcggcgagcgccacggccactgttcgccgtgcgcgcttcggctgctgacgccgccaacagggacgccgtgcttaaggccttccgcgagaacagggctctcaagataatttccgggcttcagaactttgacaggagcagtgttgcatctgttgtcacagctgcagataagggaggtgcaacccatgttgacatagcatgtgacaaggacttagtaaagcttgccatggatcttaccaaccttccgatctgtgtctcatctgtagatccttcagcgttccattctgcagtacaagcaggagctaaaatgggttgagattggaaactatgattctttttatgagatgggcattgagtttttctctgagcagatactgaagctaacaagggaaacaaagaagatggcttccagacatcacctttatcagtaacaagtttcctcccacaccttaagtttgcccggatccgaatgaaaactagccggagcctcctccaaagaagaaaggaccttgatttaattcccaaactgaaggggggggaaaaaagtttctagccccggaacaaaaaccgggaaaggccttgggaattgaaatgaaa

SEQ ID NO: 75612 - protein, 110 aa, Zea mays
  misc_feature: Ceres CLONE 1560091
MAGRASARRAPRPLFAVRASAADAANRDAVLKAFRENRALKIISGLQNFDRSSVASVVTAADKGGATHVDIACDKDLVKLAMDLTNLPICVSSVDPSAFHSAVQAGAKMG

SEQ ID NO: 75613 - DNA, 856 bp, Zea mays
  misc_feature: Ceres CLONE 1560092
  misc_feature: Encodes the peptide sequence at SEQ ID NO. 75614
  misc_feature (330)..(330): n is a, c, t, g, unknown, or other
ctggagctccccgcggtggcggccgctctagaactagtggatcccccgggctgcaggaattcgtctcacccctagaaaaaagtggctggcggcgcatagatagatagccatggcgaagaagctagtggaggaagcgctcctcgcagcggcggacgagcacgaggaggagaacctgagcgtgcgcgaggagctgaagaagcagctatggctggctgggcccatgatcgccggcgcgctcctgcagaacgtgatccagatgatctccgtcatgtacgtgggacaccttggagagctgcccctcgctggcgcatccatggccaacttcttcgncaccgtcacggcctcagcctgctgctaagcatggcaagcgctctagacacactgtgcggccaagcgtttccgcgcgaagcagtactatctcctggggcatctacaagcagcgcgcccatgttccctgctgaccctggggagcgtgccctcttgtcccgggggtggggtctccacccgcgagattctccctcctgttttgggccaggaccccggaaatctccctcaaaggcccgggacctaaacccggggggatgaatcccccctgctgttttcctaacgggcttcttgtaaaggccccaccccgggtcctcccacaacccaaaaaatcttggtggccccctgaaaggggaaaaagccggggccccccccgggccttccaccaatttttttttttttgggggggccgggggttccccccccccggaagggggagacaaaggggggggggggttatataaaacccctctttcctccttggggggaaaccagggcccctctttttcctttttaatttgggggggggtcc

SEQ ID NO: 75614 - protein, 82 aa, Zea mays
  misc_feature: Ceres CLONE 1560092
  misc_feature (74)..(74): Xaa is any aa, unknown, or other
MAKKLVEEALLAAADEHEEENLSVREELKKQLWLAGPMIAGALLQNVIQMISVMYVGHLGELPLAGASMANFFXTVTASACC

SEQ ID NO: 75615 - DNA, 842 bp, Zea mays
  misc_feature: Ceres CLONE 1560093
  misc_feature (478)..(478): n is a, c, t, g, unknown, or other
  misc_feature (571)..(571): n is a, c, t, g, unknown, or other
  misc_feature (572)..(572): n is a, c, t, g, unknown, or other
ctggagctccccgcggtggcggccgctctagaactagtggatcccccgggctgcaggaattcgtctcacccctagaaaaaatcggacggctgcggcctcaattgctgatcggatcgcggccgctggaaatctgcgtgactgcatctatactgcgcaggcacgagggtttgtgttgcggcggggttttcgtgcggccgctgcggtgacaagcaggtcctccctcaagctcgcggcggatcagcgaccgatcgacccgtcatcctcggttcctcatccatccgggcatccggattccggtgagcggaggaaggcgccatgaaagctgcggaggacgccactcgctgccctcagatcccccggcgttgccaccactgtgccgggccactctccaaggacatggaaacgagcagctggacagtacctccgttggttcgagatagcttctccatgattggttcggctctttggggtatagcangagcgttttatggtttcaaccatgttatgcctgtttgtcgacgtcacataaagggccccatgtggatgcatttttttgttggtgcaccaccanngtatgtgttctcttctgcatgtgctggattagcaggtggtacaatacagccaccgcacagctgggttcatcatcctggcatggcggggcatcccactcctttgccccgtctttccgggtaccaaacaatggacccttctttccccccgttggattctagggaaaaactggccaaaaaaaaaaaccccctcaccgtgttaaaatttatcggaaaaaaaaattccccctcaaaaaacccccccggccctggagaaaacccccccattttttt

SEQ ID NO: 75616 - DNA, 858 bp, Zea mays
  misc_feature: Ceres CLONE 1560094
ctggagctccccgcggtggcggccgctctagaactagtggatcccccgggctgcaggaattcgtctcacccctagaaaaaccgcccgcgcccgcttggtccagcgccggccctgcctgcagccagccaccgttgtccgttccctcccgcgatccactcctctcgagctctaggggacggaaggaatccggcgggggtggggtgcgagcagggggagggagaagagcagccgcccgccccgcgagggggcaacagctgcccaagaacctgaccggaagagttgtgggagcggcggcggaaagatggggcaggccctgcgcagggctcttcgactcctttcttctccacccagggagatgaaggggtttggtgaaagccttggggtccttggaaaatcccccctgggtaaaaaaaaaaactttgaaagggttttccttggggaaaggggttttttaacgagcccctaaggggcggttttatagtgtccaaaaggggtcccttaaaaaaaaaggggggttcttctctttttgggaaaaagggggggggcaaaaaaaaaaaccccggccccctctgggaaagaaaatcccccccgaaaaattttttgggccgccgccccttttttggggggatatttcttcttccccaaaaaaaaaaagaaaataaaacaacccgcggcggggaaaaattttcccacacacaatttttttagagcccccccttttttttgggaaaaaaaaaaaaaaaaccttttttggttttttttttcaccaacaaaaaacaccccccctctgtggggggggggatttttaaacccccccccgccgagggtgtttctttttagggggggggggggtggggt

SEQ ID NO: 75617 - DNA, 884 bp, Zea mays
  misc_feature: Ceres CLONE 1560095
  misc_feature (788)..(788): n is a, c, t, g, unknown, or other
  misc_feature (858)..(858): n is a, c, t, g, unknown, or other
  misc_feature (862)..(862): n is a, c, t, g, unknown, or other
acaaaactggagctccccgcggtggcggccgctctagaactagtggatcccccgggctgcaggaattcgtctcacccctagaaacggcttacagctgctctgcttcagcttgctcctgataagcagtacctgctgcctagttcatcaactagtacaagtttgaaccatggtgtgctggttggtccctttcctgataggggtgtagggagggccccagcagttgagaataaaggtaacctggcaggcacgtcttatggggaaaagagaactgttgaacacacagaaaatggtcatgtgttgtcaaccagttctgtcagagcaaatgagggaactaaactcagaaaagcggaaaatgaaatggtctggcaagctgtgcttgagagtatccaatcagatacattgagaaaaatgatggctaaagaggccaggctaaactctatcagccttggaacagaaccaacagtgcaactaataattagctcacatatcagtaagtccaaagccgaaaactacagagctcagattctgcaggcatttgagtccgttcttcgttctgctataatacttgaaattcgatatgaatcaaagaatgatgcaaaaccaggtcatactccatcaatgtttccttaccctgagaatgactcgacactgaggaggtcctttactaaacatagtccactctcttctggagaaggtgaaataattgaagttggaccttctcgcatgcattggcatgctcaaacaataatgatgttcttgacgtaaatgaaagaagaaaggagaacacntggggagaaagaacttcgtcatcacaaaaccaggagagcgtgactaatccaaaaggaagaaaatgggacngacngaatcgaccgacagcatagtaa

SEQ ID NO: 75618 - DNA, 750 bp, Zea mays
  misc_feature: Ceres CLONE 1560099
  misc_feature: Encodes the peptide sequence at SEQ ID NO. 75619
  misc_feature (165)..(165): n is a, c, t, g, unknown, or other
  misc_feature (518)..(518): n is a, c, t, g, unknown, or other
tggagctccccgcggtggcggccgctctagaactagtggatcccccgggctgcaggaattcgtctcacccctagaaaaaacctccgcagctagcatcgatccgccattgctcaccgcacaagtgcacgctcacctgtcacctcacacactgcagctaagtagctnaacgccgggagggcgagaactaagaaaaagctctgacatgggccgaaggagaagaagcaggggcctgcagctgctggacttctgggtgagcccattcgggcagcgctgccgcatcgcgatggacgagaagggcctggcctacgagtacctggagcaggacctggggaacaagagcgagctgctcctccgcgccaacccggtgcataagaagatccccgtgctgctgcacgacggccgccccgtctgcgagtccctcgtcatcgtgcagtacctcgacgagggcgtcccggcggcggcgccggcgctgctccccgccgaaccctacgcgcgcgcgcaggccccgcttctgggcnggactacgtcgacaagaagctctacgactgcggcacccggctgttgaagctcaagggggacgggccagcccaggccccccccccaaatgggccaaatctcccccaccctgaagggcgcgctcgggaacgggcctttcttttgggggggaaccccttcgggtttcctcaaaaatcggccccgggccctttaaggtccggggtcccccccccaaaaaccgcttttggggggggt

SEQ ID NO: 75619 - protein, 120 aa, Zea mays
  misc_feature: Ceres CLONE 1560099
  misc_feature (8)..(81): Pfam Name: GST_N Pfam Description: Glutathione S-transferase, N-terminal domain
  misc_feature: SWISSPROT Homolog: EC 4.4.1.5 Lactoylglutathione lyase
  misc_feature (106)..(106): Xaa is any aa, unknown, or other
MGRRRRSRGLQLLDFWVSPFGQRCRIAMDEKGLAYEYLEQDLGNKSELLLRANPVHKKIPVLLHDGRPVCESLVIVQYLDEGVPAAAPALLPAEPYARAQAPLLGXTTSTRSSTTAAPGC

SEQ ID NO: 75620 - DNA, 862 bp, Zea mays
  misc_feature: Ceres CLONE 1560100
  misc_feature: Translation starting site: 208
  misc_feature (735)..(735): n is a, c, t, g, unknown, or other
  misc_feature (766)..(766): n is a, c, t, g, unknown, or other
aagctggagctccccgcggtggcggccgctctagaactagtggatcccccgggctgcaggaattcgtctcacccctagaaaaagtggcgtcgtctccgcttttactagatcatcagtagccagctcaggagccgagcctggtcagggtagccaagcccatcccggtcctctcccggcgtcttctccctccgcaccgcggctccggcgatggcgggcgtcggctccgcgctgcgtcggctctacctctccgtctacaactgggtcgtcttcttcggatgggcgcaggtgctgtactacgcggtcctgacgctgcgtttgagcgggcacaaggccgtctacgccgccgtcgagaggccgctgcagttcgcgcagacagccgccatcatggagatcgttcatgggctcgtagggttggtgaggtctccggtctctgcaactcttccacagattggatccaggttgttccttacgtggggtgtcttgtggagttttcctgagacccagtcacaccttcttgttactaccctggtcataagctggtctatcactgagatcatcagatactctttctttggacgaacgaggcatttggctctgcgccttcctggttattatggcttaggtacagcacctttatgttgttgtatcctactggcatctctagtgaagttggtctgatctacattgacctgccatacatgaaggcatcggaaaaatactgtattacgatgcccnacaatgggacttctcatacgattacttctantcatccggccttcccttctggatctaggttccaggagcccacacatgtaccgttacatgctctccccgaggaagaaagggctatcaaaggccaagg

SEQ ID NO: 75621 - DNA, 864 bp, Zea mays
  misc_feature: Ceres CLONE 1560101
  misc_feature: Encodes the peptide sequence at SEQ ID NO. 75622
  misc_feature (496)..(496): n is a, c, t, g, unknown, or other
  misc_feature (649)..(649): n is a, c, t, g, unknown, or other
  misc_feature (781)..(781): n is a, c, t, g, unknown, or other
  misc_feature (811)..(811): n is a, c, t, g, unknown, or other
ctggagctccccgcggtggcggccgctctagaactagtggatcccccgggctgcaggaattcgtctcacccctagaaaaagtcttgttcgaagatgtaatggcaatattgatctaataaatgtgctaagagagtttgaatcaaaacaggaggcacatggtgaccaaattttgatcaaggcctcagtcctggctgagttacagaggcggatactaaaagccgaggccacagtacgtgaaaaggatgaagagaacgagatgcttcatcagcggcttcagcaatatgaaaaccgctggttagagtacgaacagaaaatgaaagctatggaggaaatgtggcagaagcaaatgcgttcgctgcaatcgagcctttccgtagcaaagaagagccttgttttggatgaaacgcctaggatgtcggactcatcagtggatcagagctgggaaagcaatgggaaccaccatgtcagcagcggttctcagctggtgccacacacntggtggacgtgaaatgaacgctgggcctcagcgtcatcagccgcctggcagaagaattcgagcagcggagccaggttttcgctgatgacgccaagttcctggtcgaggtcaagtctgggcaggcggacgccagcctaaacccagacatggagnctccggaagttgaagcagaacttcgactcgtgggagaaagatttcagtggacggatgagggagaaccaaagtgatcctgaacaagctcggcaatgggcaacgagtcatcgcccaacttgttgaaaacgaaantgggtgggggcagctgaacacctttcaggnttttcgggaggtaattatgtattggagatgggaaaatttgtaagatgttaccc

SEQ ID NO: 75622 - protein, 83 aa, Zea mays
  misc_feature: Ceres CLONE 1560101
MLHQRLQQYENRWLEYEQKMKAMEEMWQKQMRSLQSSLSVAKKSLVLDETPRMSDSSVDQSWESNGNHHVSSGSQLVPHTWWT

SEQ ID NO: 75623 - DNA, 777 bp, Zea mays
  misc_feature: Ceres CLONE 1560102
agctccccgcggtggcggccgctctagaactagtggatcccccgggctgcaggaattcgtctcacccctagaaaaaccctagaaaaaaaaaaaaaaaaaacgaggagtggagaaaaaaaaaaaagaggcgccgcagcgaggtcgaggtgattattatttaggcacaaggggcgctgtccggaaattccccaaatcgacctgggctggacccagccgcgccccgtctgcctcctgcttctctctccgcttccgcttcctgcgcctccaggctccacttctccgctcggcagtctgcactggaaggacagcatgtcggcctcggcgtcgtcaccggcggcggcggcgggcgatgagaagcaggaggcggcgcccgtcaggcgctgcaagggcgtcaaacgacctcgaacaaggtcgtttctccgcgaaggtccgggggcagctccggcagaggttgtacctttgtatggggggggcatgttgacatccttggaaaaggatgaaccttggagaataaattacttttttgtttacccataaaggctattttttcaagccctcccaaaaacttttacctgggaaggaatacccaattatgcttttcccgcaatttttcccaacctttgggggaattttggaaaccccctgggaattttcccagggaaatagggaaccggggaggggtttaaaaaaaaaaaaccccccccccccattttcccggggggcccccacccccccaaaaaaacccctttattgtgtgagacctttgggcccccccat

SEQ ID NO: 75624 - DNA, 834 bp, Zea mays
  misc_feature: Ceres CLONE 1560103
  misc_feature: Encodes the peptide sequence at SEQ ID NO. 75625
ctccccgcggtggcggccgctctagaactagtggatcccccgggctgcaggaattcgtctcacccctagaaaaaacggagaagagaacaagagatagtacttgacactcctgtcctgctcctcccactcccacgctcccaaccgagctcgagcgcacgcacacgcgcacaagcaggagctcctgtcccgctagatcccaaacagtctcctgcccgcgcgcgtttggggtggcgcgaaggaatcaccggatggcgatgttcgcgcggccgctgctggccaccctgctgctgctgccggcgttcctgctctctgccgcctcggccgccgacagcaagagcaaccctgctgatgagctcgtggcactgatcaacagcaaccgcactgctggcaaagcatcttctgattcggacatcaagggttgggatgcatcgctctgcagtacatcaaagcatacgaagggcattgtgacccagtggacgacagaaagcgaaaggagtccaacttcacgaaaacgtcgccccaacctggggggccaaggcccaaaccctttccaaaatacccggaaagggtgtggcttgcccgtcccaatactttgcctcccgctaaggcctttgggctccttgtgggaaaacaacccaaagggcccccaaaaattgggcaaaaaaaaccaccccagagttgggggcgctttttaaccccccccaagggggggggacccaaatttgggggggccccctgttttagggggggaagacccaaaccctttttcccggggggggggggaaaaaccccaaaagggccctctctccccccggggggttcttttggggaaaa

SEQ ID NO: 75625 - protein, 148 aa, Zea mays
  misc_feature: Ceres CLONE 1560103
MAMFARPLLATLLLLPAFLLSAASAADSKSNPADELVALINSNRTAGKASSDSDIKGWDASLCSTSKHTKGIVTQWTTESERSPTSRKRRPNLGGQGPNPFQNTRKGCGLPVPILCLPLRPLGSLWENNPKGPQKLGKKNHPRVGGAF

SEQ ID NO: 75626 - DNA, 849 bp, Zea mays
  misc_feature: Ceres CLONE 1560105
  misc_feature: Encodes the peptide sequence at SEQ ID NO. 75627
  misc_feature (763)..(763): n is a, c, t, g, unknown, or other
  misc_feature (776)..(776): n is a, c, t, g, unknown, or other
  misc_feature (787)..(787): n is a, c, t, g, unknown, or other
  misc_feature (797)..(797): n is a, c, t, g, unknown, or other
  misc_feature (808)..(808): n is a, c, t, g, unknown, or other
ctccccgcggtggcggccgctctagaactagtggatcccccgggctgcaggaattcgtctcacccctagaaaaaaccagacgccagtccaccaccgcttcccgtgcagcgccctccctctacgttcccccatttcctgtgttggcggcgatggcgcggcacttcgtgctcaacaccggcgccaagatcccctccgtggggctcggcacctggcagtctgaccccggcgtcgttggcaacgctgtctacgccgccgtcaaggcgggttaccgacatatcgattgtgccagagtttacggcaacgaaaaggagattggtttggcgctgaagaagctatttgaagagggtgtagtgaagcgagaagatctgtttatcacctctaagctatggaatgatcatcatgctcctgaagatgtgcctgaggcactaaatgacagcctgaatgatttgcagcttgagtacctggatctttatcttatccattggccatttagagtcaagaagggaacaaataccagccctgaaaattttgttacacctgacttccctgctacttggggggcaatggaaaagttatatgatgctggcaaagctcgcgctattggtgtgagtaacttctcctcaaagaaattgggtgacttgcttgctgtagctcgtgtacctccagctgttgatcaggtgggatgtcatcctggttggcagcaaactaagctccatagcttttgtcagtcaactgcttactcaccactaggttcacctggtancacttggatgaantgtaatgtccnttaagaaccnatatcatctcnatagctgagaaactcgggaaaacttctgcaacagtggctct

SEQ ID NO: 75627 - protein, 212 aa, Zea mays
  misc_feature: Ceres CLONE 1560105
  misc_feature (7)..(213): Pfam Name: Aldo_ket_red Pfam Description: Aldo/keto reductase family
  misc_feature: SWISSPROT Homolog: EC 1.1.1.2 Alcohol dehydrogenase (NADP(+))
  misc_feature (205)..(205): Xaa is any aa, unknown, or other
  misc_feature (209)..(209): Xaa is any aa, unknown, or other
MARHFVLNTGAKIPSVGLGTWQSDPGVVGNAVYAAVKAGYRHIDCARVYGNEKEIGLALKKLFEEGVVKREDLFITSKLWNDHHAPEDVPEALNDSLNDLQLEYLDLYLIHWPFRVKKGTNTSPENFVTPDFPATWGAMEKLYDAGKARAIGVSNFSSKKLGDLLAVARVPPAVDQVGCHPGWQQTKLHSFCQSTAYSPLGSPGXTWMXCNV

SEQ ID NO: 75628 - DNA, 859 bp, Zea mays
  misc_feature: Ceres CLONE 1560107
  misc_feature: Translation starting site: 534
  misc_feature (563)..(563): n is a, c, t, g, unknown, or other
ctggagctccccgcggtggcggccgctctagaactagtggatcccccgggctgcaggaattcgtctcacccctagaaaaaaaatccgctggcgtagcgtagaacacagcatctccggtagcgtcaccgtaggcctcgcaagtaaactgacctgccttctccgctttcccctccgtctccgtcgggagtcgagacaaagggagccagagttagtcccggcgccgtgtcgcgagcggaaggagaaggactgaaggaggcgacgatgcaggtgaagcagaaggtctacgagttctacaaagggcacggtggagcgggtcacggccccgcgcaccgtctccgcgttcctcgagaagggcgtcctctccgtccccgagttcattctcgccggcgacaacctcgtcgccaagtgccccacctggtcctgggaagcgggcgatccaagcaagaggaagccgtatctccccgccaataagcagttcctcgtcacccgtaatgtgccctgtttaagacgtgccatctcggttgaggaagagtatgatgcagcaggagcagaggtggttctcnatgaggatggcgaaggctggcttgcaacacatggagtggcagcatcaaagacagaagaggaggaagacattccctctatggacacttggacttagggagatctgatgggataaagtctatccccctcttacttaacggtgggcagggataaaaagagggaggaattccctgaactgggatacttatgaagaccccggggaaaaattggcttgctggctgaacaattctaactttttccccgaaagacccgaaaaatggaaacctttctttattcccgaaaccttttgggtgtttcc

SEQ ID NO: 75629 - DNA, 660 bp, Zea mays
  misc_feature: Ceres CLONE 1560108
  misc_feature: Encodes the peptide sequence at SEQ ID NO. 75630
agctccccgcggtggcggccgctctagaactagtggatcccccgggctgcaggaattcgtctcacccctagaaaaaacggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctcctttgtagtgacaggcaaggaaatacgccataatcaagggagcttgatgagccagttaccctttaaatgatggggacagttggtccctgccggtttcgaaagtggagactttccggagtggcctttggaattggtgggaggttgccctaacctttaagagtcccttcccccccctccaggaaatgcctggggaatggggaattgccccaagggaagttttttgataaaagggggaaactcccctttcccccctttattttttttgttttttggggccccccaaaaataaaaaaaggggggggggggtcccaaccccccccaccaaaagggggt

SEQ ID NO: 75630 - protein, 73 aa, Zea mays
  misc_feature: Ceres CLONE 1560108
MMGGRALLLLLVSALLVQIRASDPLLYEPFDEDFEGRWIVSKKDEYQGVWKHAKSDGHEDYGLLCSDRQGNTP

SEQ ID NO: 75631 - DNA, 775 bp, Zea mays
  misc_feature: Ceres CLONE 1560109
  misc_feature: Encodes the peptide sequence at SEQ ID NO. 75632
  misc_feature (392)..(392): n is a, c, t, g, unknown, or other
ctggagctccccgcggtggcggccgctctagaactagtggatcccccgggctgcaggaattcgtctcacccctagaaaaaccgcgtacctggccgcggtgtgccaggtgctggtgaaggtggtgttcaggtgggacatctcgttcaagctgacgtcgaagcagcccgcgggggacgagaagaaggacccctacgcagacctgtacgtggtgcgctggacctggctcatggtgacgcccatcatcatcatcctcgtcaacatcatcggctccgccgtggccttcgccaaggtgctggacggcgagtggacgcactggctcaaggtggccggcggcgtcttcttcaacttctgggtgctcttccacctctaccctttcgccaagggcatcctgnggaggcacggcaagacccccgtggtggtgctcgtctggtgggccttcaccttcgtcatcaccgccgtgctgtacatcaacatcccacacatccacggggcccggcgggcagcacgggcggcgcgatcgggaaagcacggccggcgacgccacaccaccatggccaagaaggttcgacgggctactacctttctggccgtggaaaccgcccaagcaacctggaatcggtcatggcatgccccattattcccgccctggcccctgaatgggggaaccaattgggggaaccccccccaaggtgtggaaaaagggggaaacccgtttcccccgttttaattccaattcccaatgggttttttctttaaaaaaaaagggggggggccc

SEQ ID NO: 75632 - protein, 166 aa, Zea mays
  misc_feature: Ceres CLONE 1560109
  misc_feature: SWISSPROT Homolog: EC 2.4.1.12 Cellulose synthase (UDP-forming)
  misc_feature (56)..(56): Xaa is any aa, unknown, or other
MVTPIIIILVNIIGSAVAFAKVLDGEWTHWLKVAGGVFFNFWVLFHLYPFAKGILXRHGKTPVVVLVWWAFTFVITAVLYINIPHIHGARRAARAARSGKHGRRRHTTMAKKVRRATTFLAVETAQATWNRSWHAPLFPPWPLNGGTNWGNPPQGVEKGGNPFPPF

SEQ ID NO: 75633 - DNA, 811 bp, Zea mays
  misc_feature: Ceres CLONE 1560110
  misc_feature: Encodes the peptide sequence at SEQ ID NO. 75634
ctccccgcggtggcggccgctctagaactagtggatcccccgggctgcaggaattcgtctcacccctagaaaaagagcgaacctcacccgcagtggctctgtccagtagtagcaatttggatagatatatggcaatcggcaatcgccaaagagaagaagaagaaaaaaatctctctcgctctctctctcgaccgggctggcatcagcacgcgtccacacctacacgacgccacattgtgccatccattcgaatccaagggaaccaaaaccagcagcggaggtcggaagaacactaggactcatccctcctccggatcaatcatcgatcagccagagcccctacaaaaaaaccatccccacatgctggctaatcccacgacgcactgatctttttctaccttaagcgtcttgcgtgctatgtagaatcgatctccaacttacagaaacgtccaggtcacaggtctgagctcgagggacatgactcccttcataatggatacatccatggcttcctccaattccgataccagcagcaacccgctggaagccatgagcgccttcttctcgaagcaagtggaccggcggaagcctggtgcacaccgagaagcgggcgctggacacgcgtctgtcctcatccagcgacacgttcccggggtcagagcaccggccggcggaccggaaccggcggatgggcggagctgggcttcgacaagctgctcgtgcaccaagtggtgtggcccggcacgcacaattcggccaccaagaagattggggggacgctggtgaccggcccccttccggcatgccaagc

SEQ ID NO: 75634 - protein, 97 aa, Zea mays
  misc_feature: Ceres CLONE 1560110
MDTSMASSNSDTSSNPLEAMSAFFSKQVDRRKPGAHREAGAGHASVLIQRHVPGVRAPAGGPEPADGRSWASTSCSCTKWCGPARTIRPPRRLGGRW

SEQ ID NO: 75635 - DNA, 893 bp, Zea mays
  misc_feature: Ceres CLONE 1560112
  misc_feature: Encodes the peptide sequence at SEQ ID NO. 75636
  misc_feature (604)..(604): n is a, c, t, g, unknown, or other
  misc_feature (609)..(609): n is a, c, t, g, unknown, or other
ctggagctccccgcggtggcggccgctctagaactagtggatcccccgggctgcaggaattcgtctcacccctagaaaaaactgcggctgtgcgcttcgttcagttcagttcatccgtgttcttgtttgcgaggtcgagagagactgagagaggatgtcgtgctgcggaggcaactgcgggtgcggctccggctgcaagtgcggcaactgctgcggagggtgcagcaagatgtacccggacatggccgagcaggtgaccaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcaagccggccggaggaagctagctaattataaagcttaatacagtatagcggcgtcgctgtgtgtgtttcgagtcagtcagtcagtcagttgcgtgccatggcatgctccgagtctgagatgatgatgatgcctgatggtcgcgtcatgtactcacctgggcccctggggcgcatctgcnagcantgacgtgtgctgtgtcgggagggtgccgcacgctagcaggctagccagtgccctgctgggatgggtcccccaccctctagaaactttacttaccccccccttttgtaaaaaaaaaaaaaaaaaaaagccgggcccctcgccccccacctaacccaaagtctaagcccgggttttttggtttgttcccccccaaacccctttatatgggggcaaaaaaatggcccccccccttccttttggccgggcgaaaaggcgttttttggcaggaccgcccccccgcgccc

SEQ ID NO: 75636 - protein, 83 aa, Zea mays
  misc_feature: Ceres CLONE 1560112
  misc_feature (1)..(81): Pfam Name: Metallothio_2 Pfam Description: Metallothionein
MSCCGGNCGCGSGCKCGNCCGGCSKMYPDMAEQVTTTTTQALIMGVAPSKGHAEGGFEAAAGAENGGCKCGGNCQCDPCNCGK

SEQ ID NO: 75637 - DNA, 838 bp, Zea mays
  misc_feature: Ceres CLONE 1560113
  misc_feature: Encodes the peptide sequence at SEQ ID NO. 75638
  misc_feature (460)..(460): n is a, c, t, g, unknown, or other
caaagctggagctccccgcggtggcggccgctctagaactagtggatcccccgggctgcaggaattcgtctcacccctagaaaaagcagcagccacaagcccacaaccattattcttattccactgcatcatgtccaagtccaactctccaagcggcaagcgccatgccttcttccgcgcaggttctgctctgcctcgccgccgtgctggcggcggcggcggccaccaccgccgaggcacactcacagtgcctagacaaccagccggaccggtccatccactgccgccagctggccgaggccggcgaggtcctccacgacctccccggtggcctcagggcctacatcagacacgccgcgagctcgagccgcgccgacttcctcgcctccgacgtcttctggtacgaggcaccattgctcacacacatagtagacaaggttgcagaggcagggtacttacnacgtcgtgcccgatatactcgaagggagactacttatacgacaaagaaaacttttacagaatggctcgaggctcactgctccgatgaaagctgcggaagacactaggccactggttcgccgctttttaccaaggaccggaaatccgttcttcgtggggaagcctactgcttggggagggaaaacttaaaccttcaaaagtggggaaaaaaccaccaattcaaaccttgtttggccttttcccccccccaaaaaggggaacctggccaaagaacctaaaaaaagtgtgaaaaggccccaaaaaaaatacccggggggggccaaaaaaaaaacccaacccctttcccccaaaagaaaagtgtcccccggttttttgggat

SEQ ID NO: 75638 - protein, 133 aa, Zea mays
  misc_feature: Ceres CLONE 1560113
  misc_feature (99)..(99): Xaa is any aa, unknown, or other
MPSSAQVLLCLAAVLAAAAATTAEAHSQCLDNQPDRSIHCRQLAEAGEVLHDLPGGLRAYIRHAASSSRADFLASDVFWYEAPLLTHIVDKVAEAGYLXRRARYTRRETTYTTKKTFTEWLEAHCSDESCGRH

SEQ ID NO: 75639 - DNA, 741 bp, Zea mays
  misc_feature: Ceres CLONE 1560114
  misc_feature: Encodes the peptide sequence at SEQ ID NO. 75640
  misc_feature (307)..(307): n is a, c, t, g, unknown, or other
  misc_feature (336)..(336): n is a, c, t, g, unknown, or other
  misc_feature (371)..(371): n is a, c, t, g, unknown, or other
  misc_feature (440)..(440): n is a, c, t, g, unknown, or other
tggagctccccgcggtggcggccgctctagaactagtggatcccccgggctgcaggaattcgtctcacccctagaaaaaagggagccgtagaggagcagcaggtgcaccaaaaggatggcagcgccaggctccctgcgacttctccaggccccgtccttcggtgcggccaagtgccagccgatggcgggccgggcatcggcgcggcgagcgccacggccactgttcgccgtgcgcgcttcggctgctgacgccgccaacagggacgccgtgcttaaggggccttccgcgagaacaggggctctcaangataatttccgggggcttcaggaactttngacagggagcagtggttgcattctgtttgtcacangctgccagataagggggaagggtgcaaccccatggttggacatagccattgtgaccaagggactttaantaaaagctttggccattgaatccttaaccaaaccctttcccaatcctgggggtcctccatctgggaagaaacccttttcagcgggttcccatttctgggccggtaacaaagcccggggaccctaaaaaaggggtttgaaaaatttggggaaaacccatgggaatctcccctttttaaaggaaaaagggggggcccattttggagatttttttcccctcctcggggacgccaaaaaaaccctgggaaaaacccctataaacaaaggggggggagaaacacccagggggaaaaaaaaaattct

SEQ ID NO: 75640 - protein, 85 aa, Zea mays
  misc_feature: Ceres CLONE 1560114
  misc_feature (42)..(42): Xaa is any aa, unknown, or other
  misc_feature (52)..(52): Xaa is any aa, unknown, or other
  misc_feature (64)..(64): Xaa is any aa, unknown, or other
MAGRASARRAPRPLFAVRASAADAANRDAVLKGPSARTGALXDNFRGLQELXTGSSGCILFVTXCQIRGKGATPWLDIAIVTKGL

SEQ ID NO: 75641 - DNA, 900 bp, Zea mays
  misc_feature: Ceres CLONE 1560118
  misc_feature: Encodes the peptide sequence at SEQ ID NO. 75642
  misc_feature (518)..(518): n is a, c, t, g, unknown, or other
  misc_feature (573)..(573): n is a, c, t, g, unknown, or other
ctggagctccccgcggtggcggccgctctagaactagtggatcccccgggctgcaggaattcgtctcacccctagaaaaacacgcccccaacgccaagaacgtcgacgggcgcgacggcatggcggcggcggacccggacaccgaggtgcaggcggagttcccacccctcgtccgccagtacaaaagcggccgcgtcgagcggttcttcaacctggccccgctcccggccggcaccgacccggccacgggcgtcgtgtccaaggacgtcgtcgtcgacccggccaccggcctctgggcgcgcctcttcctccccgccggcagccacgggaagaagctccccgtcgtcgtctactaccatggcggcgcctacgtgatcggctcggcggccgacccgatgacgcacggctacctcaacgcgctcgtcgccaaggccggcgtcctcgcggtcgcgctcgagtaccgcctcgcgccggagcacccgctcccggccgcctacgaggactcatgggagggactncagtgggtggccactcacgtcctccgcctccgtcgctgcgggaagaggaactgtncgccgagccgtggctaaccgagcacggcgacttctcccgcgtgttcctggcgggggcagcgcgggggccaccatcgctcacttcgtagcagtccgtgccggtgagcagcacaagaggcgcgggcctcgaatgccgaatcaggggctgctgattagggacccctacttcagcggcccgggggaacattggcaacaaagggacaaacggggaagggccccaaggccccgggccaaccccattcttgggggttctggtggccttgggaaccccgggggttgaaaaacctttttttcaaaccggttttttgaggcccccggggggacaccc

SEQ ID NO: 75642 - protein, 156 aa, Zea mays
  misc_feature: Ceres CLONE 1560118
  misc_feature: SWISSPROT Homolog: EC 3.1.1.3 Triacylglycerol lipase
  misc_feature (152)..(152): Xaa is any aa, unknown, or other
MAAADPDTEVQAEFPPLVRQYKSGRVERFFNLAPLPAGTDPATGVVSKDVVVDPATGLWARLFLPAGSHGKKLPVVVYYHGGAYVIGSAADPMTHGYLNALVAKAGVLAVALEYRLAPEHPLPAAYEDSWEGLQWVATHVLRLRRCGKRNCXPSRG

SEQ ID NO: 75643 - DNA, 849 bp, Zea mays
  misc_feature: Ceres CLONE 1560119
  misc_feature: Translation starting site: 146
  misc_feature (1)..(1): n is a, c, t, g, unknown, or other
  misc_feature (619)..(619): n is a, c, t, g, unknown, or other
  misc_feature (768)..(768): n is a, c, t, g, unknown, or other
  misc_feature (769)..(769): n is a, c, t, g, unknown, or other
  misc_feature (830)..(830): n is a, c, t, g, unknown, or other
naaagctggagctccccgcggtggcggccgctctagaactagtggatcccccgggctgcaggaattcgtctcacccctagaaaaagcattttggctcctcactgccgcgccgccaccccctacaggtaaggaagaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactcaactctgtttgggcccaacatcttagtgaagaagtgaggagaaggttctacaagaactggtgcaagagcaagaagaaggctttcacaaagtatgctctcaaatatgaaaatgatgctggcaagaaggaaattcagctgcagcttgagaagatgaagaaatatgcttcntgttatccgtgtcattgctcatacccagattaggaagatgaagggtttgaagcagaagaaggctcacctgatggagattcaggtcaatggtggtaccattgctgacaaggtggactatggctacaattctttgagaaaagagtccctgnntgatgctgtcttccagaaggatgagatgattgacatcattgggtgtgaccaggggaaaggnttaccaaggttgtgtcacc

SEQ ID NO: 75644 - DNA, 878 bp, Zea mays
  misc_feature: Ceres CLONE 1560120
  misc_feature: Encodes the peptide sequence at SEQ ID NO. 75645
tggagctccccgcggtggcggccgctctagaactagtggatcccccgggctgcaggaattcgtctcacccctagaaaaagcttcactcgcgtccgcccccgccgccgcctttcgtcccagcccctaaaccattctccattcctctcatcagtttagcacaatggcactggctaataagcttggtggtctgctcaagaaagccacaagttcaaatctgtctgtctaccaagcaatcagatgcatgtcatccaagctctttgttggagggatttcttatcaaactgatgatcacagtctcagggacgagtttgccaaatatgggcaagtcattgaagctaggattatcattgaccgtgaatctgggaggtctagaggttttggctttgtaacttacacgtcttctgaggaggcttcagctgccattactgccttggatggaaagactctcgatggacggagcatacgtgttaatcatgctaacgagaagacaggtggctttcgtggcggcggtggctatggtggcggcggctacgtggtggtgggatatttggggggggggggtggccgtggctattgttggtggtggaggctattggtggtcgtggcggcggcggtggatacggtggcggcgactatggtgggcaccgcaacagggtggtgggtgtgaatatggagttcctccgggggaaaggggaacccccctttcctggctgaaggtagcgccaggcttttcccaaaggaaaattgggtttttgaccaaaactttcggggggaaaaagggcccggggggccttttgaagacaccggcgggttccaaggacaaaaaaaagagtctctttggcccaccccgtaatatacattttgtgtgggaaaccagt

SEQ ID NO: 75645 - protein, 168 aa, Zea mays
  misc_feature: Ceres CLONE 1560120
  misc_feature (32)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MALANKLGGLLKKATSSNLSVYQAIRCMSSKLFVGGISYQTDDHSLRDEFAKYGQVIEARIIIDRESGRSRGFGFVTYTSSEEASAAITALDGKTLDGRSIRVNHANEKTGGFRGGGGYGGGGYVVVGYLGGGGGRGYCWWWRLLVVVAAAVDTVAATMVGTATGWWV

SEQ ID NO: 75646 - DNA, 810 bp, Zea mays
  misc_feature: Ceres CLONE 1560121
  misc_feature: Encodes the peptide sequence at SEQ ID NO. 75647
  misc_feature (598)..(598): n is a, c, t, g, unknown, or other
tggagctccccgcggtggcggccgctctagaactagtggatcccccgggctgcaggaattcgtctcacccctagaaaaaaataacgatctagctacttcctctctcaagtcataggtgttgtagagcaactcaactagcaatggcttccaagagcacaatgcgttcccttgtcctcatcatggggctcctgctgctctcgtgcagcggcatcatcaacgcgaaacggctgctggaagaggtggcgcccaaagatgagtacccgcacactgaaatgccaaatctgcacaagcctgagctcccgcagcaccctacagagccggaactccctaagcctgatgagctaccgacacatccagacgtgccggatctgccataacccgaggtaacagagcaccccgccgtggaggatctgcctaagctcgaacttcatcctcacaccaccgagcctgaactgccaaagcccgaggtgcacgcgcacccctccatgccagagctgcctaagcccaaacttcctcctcacaccatcgtgcctgaccaacaaagtaggaggtgccatgacatcctaaaactgaaggtgcctagatcacccctctctgncagagctgccgaagcccgagcttcatcatcaccacaccgtgactgaactaccaactcccgagctgccagagctaccaaacactgagctgccaaacatgagctggcacctctacatgaaccccagtagccattgtcacgaaagacttatagcactactcggaccaggcatgacaagtcatgatcgactacactaccctgagacggctcgaata

SEQ ID NO: 75647 - protein, 78 aa, Zea mays
  misc_feature: Ceres CLONE 1560121
MASKSTMRSLVLIMGLLLLSCSGIINAKRLLEEVAPKDEYPHTEMPNLHKPELPQHPTEPELPKPDELPTHPDVPDLP

SEQ ID NO: 75648 - DNA, 1749 bp, Zea mays
  misc_feature: Ceres CLONE 1560125
  misc_feature: Encodes the peptide sequence at SEQ ID NO. 75649
aatactccaccactctgctaaagagtaaagacccaagcagacatagatcagtgggtcctcgtcaagcagcacggtgatccacgcttccacgggcgcacagggctttttgccggccattacagaggagaggaggccgacaaaggcgtggcagaggtcccatccatgggagaggaagcggccgcggccacggccacggccaccgtggcggcagggaacgcacctccgcacctgctcctggtatgcttcccggggcagggtcacgtgaacccgatggtccgcctggccaagcgcatcgcggccaagggcccccttgtgaccttctcctcgctctccagcatcggggcgaagctcaccgcgtccgcgggcgtatcggccggcggcgacggcgtgccggtgggccggggccgcgtccggttcgagttcatggacgacgaggaccccgggcctgacctggacgacctcatgcgccacatcgccaaggacggcccgccggcgctggccgagctgctggggcggcagtcacgggccgggcggcccgtggcgtgcgtggtggtgaacccgttcatgccgtgggcggtcgacgtggccgccgacgccgggatcccctcggcggtgctgtgggtgcagtcgtgcgcggtgttctcgctctactaccaccacgtgcacggcctcgtggagttcccgcccgaggacgacctggacgcgcgcttcacgctgccgggcctccccgagatgtccgtcgccgacgtgccgtcgttcctgctcccgtccaacccgtacaagctgctggtggacgcgatcatcgcccagttccacaacatccaccgcgcgtcgtgggtgctcgccaactccttcacggagctggagcccgacgtggcggcggcgctcccgggcgtgacgccgcggccgccggagctcatccccgtgggcccgctcatcgaggtcggcggcgggcgggacgacgacgagggcgcggtgcgcggcgacctgatgaaggccgcggacggctgcgtggagtggctggacgcgcaggccccgcgctccgtggtgtacgcgtcggtgggcagcgtggtgcggctgaacgcggaggaggtgggggagatggcgcacgggctcgcgtccacggggcggcccttcctgtgggtggtccgccccgacacccggccgctgctgccggacgggttcctggactccgtggccgggcgcggcgcggtggtgccttggagcccccaggaccgcgtgctggcgcacccgtccaccgcctgcttcctcacgcactgcgggtggaactccaccctggagaccatcgcggcgggcgtgcccgtggtggccttcccgcagtggggcgaccagtgcacggacgccaagttcctggtggacgagctcgggatgggtgtccgcctccgcgggccgctgcggcgggacgccgtgcgggaggcggtggacgccgcagtggcggggcccgaggccgacgcgatgctcgccagcgccaggaggtggagcgcggcggcgcgggaggccgtggcgcccggcgggtcctcggacgcgcacgtccaggcgttcgtggacgaggtgtcccggcgagcttgtggcgtgcaagtggctaaggtcgtgccgccgtcgtcagaggagcttcaccagtcaccggtcagagtccaaacctgatcagcagtcatcccgtgttggttggtattgttaccgtctgtctgatacgaaccaattttttgcttccaaaaaaaaaaaaaaaaa

SEQ ID NO: 75649 - protein, 500 aa, Zea mays
  misc_feature: Ceres CLONE 1560125
  misc_feature (30)..(475): Pfam Name: UDPGT Pfam Description: UDP-glucoronosyl and UDP-glucosyl transferase
  misc_feature: SWISSPROT Homolog: EC 2.4.1.210 Limonoid glucosyltransferase
MGEEAAAATATATVAAGNAPPHLLLVCFPGQGHVNPMVRLAKRIAAKGPLVTFSSLSSIGAKLTASAGVSAGGDGVPVGRGRVRFEFMDDEDPGPDLDDLMRHIAKDGPPALAELLGRQSRAGRPVACVVVNPFMPWAVDVAADAGIPSAVLWVQSCAVFSLYYHHVHGLVEFPPEDDLDARFTLPGLPEMSVADVPSFLLPSNPYKLLVDAIIAQFHNIHRASWVLANSFTELEPDVAAALPGVTPRPPELIPVGPLIEVGGGRDDDEGAVRGDLMKAADGCVEWLDAQAPRSVVYASVGSVVRLNAEEVGEMAHGLASTGRPFLWVVRPDTRPLLPDGFLDSVAGRGAVVPWSPQDRVLAHPSTACFLTHCGWNSTLETIAAGVPVVAFPQWGDQCTDAKFLVDELGMGVRLRGPLRRDAVREAVDAAVAGPEADAMLASARRWSAAAREAVAPGGSSDAHVQAFVDEVSRRACGVQVAKVVPPSSEELHQSPVRVQT

SEQ ID NO: 75650 - DNA, 899 bp, Zea mays
  misc_feature: Ceres CLONE 1560126
  misc_feature: Encodes the peptide sequence at SEQ ID NO. 75651
  misc_feature (144)..(144): n is a, c, t, g, unknown, or other
  misc_feature (313)..(313): n is a, c, t, g, unknown, or other
  misc_feature (314)..(314): n is a, c, t, g, unknown, or other
tccccgcggtggcggccgctctagaactagtggatcccccgggctgcaggaattcgtctcacccctagaaaaaatctcggtgtcagacgcatacgcacccaggagatacagcgagcgagcgaccaaagccatggggctctccgncaccctggcatcgaagaaggtcctatccttcccgttcggcggcgcgggccggccgttggcggcggcggcgtctgcgaggggggtgacgacggtcacactccccgacctctcctacgacttcggcgcgctggaaccggccatctcgggggagatcatgcgcttgcaccannccaaagcacacgccacctacgtcgccaactacaacaaggcgctgggagcagacttgacactggccgtcttccaagggcaacgccctccccctgtcgtccaagctggcagggcgcccttcaaggtcaaaccggcggcggggcattggaaaaccatttaaatttttttgggaaaaaacctccagcccccctttgcccaaaaggggggcggggaaacccccccccttggggaaaaattggggggggggccccttaaaaaagaattttttgggtttccccttttaggggcctcttttaaaaaaaaaaaaaaaattttcaaaaggggcccttttttttataagaggggcttgggaagggggggggggttaaaccctctttgggaaaaaaagggggccaaaaaagggttttttttttttaaaaaaaacaccctttaattgggggcttccccttgggggggaaaaaaaaggggcggcccccccggtgttcccccccccgtggggggggagaaatatttttgggggaaaaaaaaaaatttttatcctctcctgtgtgaaaaaaaaaaaaatatgggtcggcgcggcctccacc

SEQ ID NO: 75651 - protein, 113 aa, Zea mays
  misc_feature: Ceres CLONE 1560126
  misc_feature (35)..(114): Pfam Name: Sod_Fe_N Pfam Description: Iron/manganese superoxide dismutases, alpha-hairpin domain
  misc_feature: SWISSPROT Homolog: EC 1.15.1.1 Superoxide dismutase
  misc_feature (5)..(5): Xaa is any aa, unknown, or other
  misc_feature (61)..(61): Xaa is any aa, unknown, or other
  misc_feature (62)..(62): Xaa is any aa, unknown, or other
MGLSXTLASKKVLSFPFGGAGRPLAAAASARGVTTVTLPDLSYDFGALEPAISGEIMRLHXXKAHATYVANYNKALGADLTLAVFQGQRPPPVVQAGRAPFKVKPAAGHWKTI

SEQ ID NO: 75652 - DNA, 842 bp, Zea mays
  misc_feature: Ceres CLONE 1560128
  misc_feature (506)..(506): n is a, c, t, g, unknown, or other
  misc_feature (538)..(538): n is a, c, t, g, unknown, or other
ctggagctccccgcggtggcggccgctctagaactagtggatcccccgggctgcaggaattcgtctcacccctagaaaaatttggggaaaaggcaaggaaacaggatctgtcacggaaggcgattcccatttctcagtgatgtcgatgtcctgtactcctgtatatttggattcaacaatatgccattagtatgctgtcaagcgtcctatttgcaagagataaatggcttacgcccgaggggcttattcttccttatcatggtcggtcgtgactttggttatccactgaaaagatatgcttggtggtgctttcttgtgttgaagaacaagtatcccacggaaccacaaccgtttgtattatctggtgatttcctacattattagctggcctaactaaaccatgcgctcagaccctaaaccagctgtaagtctgtaacttaaaagcacagtgcactagcggaatggggttccttgctttttggagcgtttccccagtcagatcggcngcagggcaggtcacgtgaacggggctccttgntgctggaactaaataccctgaagagtttgaagtgagactaaggaaacttttggaggaatttagcaaaatgaagacattattctctttatttgattaagtgccccccctgaatgggagcaagtccagcaaaaatgcattgttgcccccaaccctggatgagtttagggagccttttagagaaaagaatctttctttggaaaggaaggttccaacccgtttaagtttctccaaaactttcttggattaaaccaatacgatctttaaaaggactttccggaaaaaaaattgaacttccttcccaaac

SEQ ID NO: 75653 - DNA, 736 bp, Zea mays
  misc_feature: Ceres CLONE 1560130
  misc_feature (159)..(159): n is a, c, t, g, unknown, or other
  misc_feature (160)..(160): n is a, c, t, g, unknown, or other
  misc_feature (176)..(176): n is a, c, t, g, unknown, or other
  misc_feature (177)..(177): n is a, c, t, g, unknown, or other
  misc_feature (225)..(225): n is a, c, t, g, unknown, or other
  misc_feature (240)..(240): n is a, c, t, g, unknown, or other
  misc_feature (387)..(387): n is a, c, t, g, unknown, or other
  misc_feature (509)..(509): n is a, c, t, g, unknown, or other
  misc_feature (647)..(647): n is a, c, t, g, unknown, or other
  misc_feature (648)..(648): n is a, c, t, g, unknown, or other
ccccgcggtggcggccgctctagaactagtggatcccccgggctgcaggaattcgtctcacccctagaaaaagccaatccagggccatccacccgtagccccgccccgccccgctgccggcaatggcgcggctcgtgctctccgagtgctgcggcctcnngcgccgctgcgcctgnncgcgccggccggggggcgccatttgcgggcgcccgtcgcccccccgcngcttcttccgaaaancggccggggggccggggcccgccccccggggccccggggggccaattccccaccccgggaaaatgggggggggccctcccccggttttttttccccgcggggggggccaccacccccgggcctttttataaccacttttcttccgcnggtttttttttggggggggggggggggggggcccaccccaaagggggggggggggggggccctttctccccccccccccccccccctctctttttttttttgggagaaaaaagaaagggggntttatacacacaaaaacaaaaaacaaaccccccccccctcccttttttggggtgggggggggggcgcggccccccccaccccacgagaggggggggggggccccccccccccccccccccccccttttcaaatattgnngggggggggggaggggagaaaaggaaaaaaatttattttttttatttttaaaacacccccccccccccccccggcggggggggggggg

SEQ ID NO: 75654 - DNA, 837 bp, Zea mays
  misc_feature: Ceres CLONE 1560131
  misc_feature: Translation starting site: 162
  misc_feature (705)..(705): n is a, c, t, g, unknown, or other
  misc_feature (744)..(744): n is a, c, t, g, unknown, or other
  misc_feature (752)..(752): n is a, c, t, g, unknown, or other
  misc_feature (779)..(779): n is a, c, t, g, unknown, or other
  misc_feature (780)..(780): n is a, c, t, g, unknown, or other
agctcaccgcggtggcggccgctctagactagtggatcccccgggctgcaggaattcgtctcacccctagaaaaagccattgttggctcctctgcacgtacatcctcggagctcctcttctggagaagaccctcctctggtgcgcgtgcgcctccggccacatgtcgaagaaaatcctggtgaagctgcacctgcatgacaacaacgacaagcacaacgccatgaaggctgtctcggcgctcaccggcatcgacgagatatccgcggacatggtgtcccacaagatgactcgctggtcggcatggtggaccccgtgagcgtggtgagcaagctgcgcaaggcgtcgtggtcagcgaccatcgagtccgtcggcccggccaaggagtcggagaagaaggacggggaggcggccaagaaggaaggcggctagggcgagaagaaggaaggctgcgagggggagaagaaggaagcaggcgagggggagaagaaagaagcgggcggcgagaaggacaaggacgacaagaaggcggcgccgccgacgccgacgccgacggagcagcatgtccagctggccgagctgttgaaccagtattaccgggcctcctcctactacccgtacccgcccgtgggcacgcactaccacgtcagagcatggaggaagaccccaactcctgcaccgtctgctaaagcgactcatggcatggnagatgatctaccaaggtgaagaaagtagtgtttaaccancatgcagnttcctttccccctcctttattttcccnntctagatcgcgttctgggctggtctggaggaaaacccaccgtgtctgtaatttacaa

SEQ ID NO: 75655 - DNA, 779 bp, Zea mays
  misc_feature: Ceres CLONE 1560132
  misc_feature (420)..(420): n is a, c, t, g, unknown, or other
gagctccccgcggtggcggccgctctagaactagtggatcccccgggctgcaggaattcgtctcacccctagaaaaaagcacactctcactacagaccggaggggattgccacgaataggtgtgtgcagttctactctaccgtacccctgcatcgagccggtgtgcgtccaccagtggccggagttgaaggagagcacgtcggcgtcgcgccacgactcggcgttctcggagatgtcgtccagcatcagcacccgcttcccctggaccacgtcgatgtccaccaggtacggcgcgcggtagaaggataccgtcacctggtactcctgctcgatcgaccaacgtacgtatttagattatattaggcccaatctcttcggccaagcagtctagctggtacatgtgtttacatgacataccangaacttgtaagtgtacaaagggtccgcggagacgagctgcgccggcgactgcggcgccgcggcgtgcagcaggcaaacgagcgactcccacctggttgcgccccagcgagtcccccacgaacatcacggtcttcccctttcatccggttaggaaagtccgccccatcaaaactgcaggggcccccaaaacccgtacaagctaagtaattgggggggggccttccttgccccgggtttccccggggttcaaaaaacaatgggtggggcttcccgggccccctaaattacccctctggaaattccaaaaccgggccggtttttttaaagagtaccccggagagaatttcccgaaactcccc

SEQ ID NO: 75656 - DNA, 1397 bp, Zea mays
  misc_feature: Ceres CLONE 1560133
  misc_feature: Encodes the peptide sequence at SEQ ID NO. 75657
aacctctctgtaagaatcaatacctaccccatggagaagctctcttctcgtcgctattcccggccggcgatgtccctgctgatcatcgtggccatcactatctcctgctccgtcgtccacagttcggaggctccagcccaagaagcagcagtacctcgtctggacggagaccatcagggccaagcgccgccgccaccggatgccggcaaacctcgacagccacagccgccgtgctgtcttcggcacggcgcttaacgtcctaaaatggacagggaggacggaggatacttaagatcaaccaggccgcgacgactataagtttttaaattttattaggactagtttaggaaccctatttttttaatggatttttattttatcaaaaaaaattgggttcccaaactagttcttaacaatacaaacataagagaatccgtacaccattcgtgtcaaattataagtaatataggtcggggtgcataaaaaaaaaaaaggagcaaacaactagaaattccccagcccggttccttttcgtgcggtttgatctcgtcggaggcccggccgcagttccgccatcagccatcgaattcgatggcggccaacttcgggaacaagatccgcaacgccaagctggttcttcttggagatgtaggcgctggcaaatctagcttggttcttcggtttgtcaagggacagtttgttgaattccaggaatcaacaatcggagcagctttcttttcccagaccttagcggtaaatgatgagactgttaagtttgaaatctgggatactgctgggcaggagaggtatcatagcttggcccccatgtattataggggtgcagccgccgccattgttgtctatgacatcacaaatccggcctccttcacccgtgccaagaaatgggttcaagaacttcaagctcaaggaaatccgaatacaatagtggctcttgctggtaacaaggttgatatgctagatgcgaggcacgtggcagtagaggaagcaaagacgtatgcccaggagaacggtctcttcttcatggagacatctgctaaaactgcaatcaatgtgaatgacatattttatgagattgcaaagagattgcttcaagggcaagaggctccaagtccacaggctggaattgttctgaatcagagaccagatgagaggatggtcagcacttcctcgtgctgctcatgaagctgtgtttcaacctcatacatagttccgttatgaaatgtatcagaggagattaagcaaaatatcccatgtggtgtcggtgtcgtccaggctgatgttgtccccttctcctgctgctcgtttcttttcacatgtttgtgatgtaaatgcccatactagaatgtcaccaaagtgttgattatgctcttatcatt

SEQ ID NO: 75657 - protein, 203 aa, Zea mays
  misc_feature: Ceres CLONE 1560133
  misc_feature (13)..(174): Pfam Name: Ras Pfam Description: Ras family
  misc_feature (13)..(127): Pfam Name: Miro Pfam Description: Miro-like protein
  misc_feature: SWISSPROT Homolog: EC 2.7.11.1 Non-specific serine/threonine protein kinase
MAANFGNKIRNAKLVLLGDVGAGKSSLVLRFVKGQFVEFQESTIGAAFFSQTLAVNDETVKFEIWDTAGQERYHSLAPMYYRGAAAAIVVYDITNPASFTRAKKWVQELQAQGNPNTIVALAGNKVDMLDARHVAVEEAKTYAQENGLFFMETSAKTAINVNDIFYEIAKRLLQGQEAPSPQAGIVLNQRPDERMVSTSSCCS

SEQ ID NO: 75658 - DNA, 894 bp, Zea mays
  misc_feature: Ceres CLONE 1560134
  misc_feature: Encodes the peptide sequence at SEQ ID NO. 75659
  misc_feature (332)..(332): n is a, c, t, g, unknown, or other
  misc_feature (335)..(335): n is a, c, t, g, unknown, or other
  misc_feature (869)..(869): n is a, c, t, g, unknown, or other
  misc_feature (872)..(872): n is a, c, t, g, unknown, or other
ggagctccccgcggtggcggccgctctagaactagtggatcccccgggctgcaggaattcgtctcacccctagaaaaactcccctcctccgcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccggggggcgcccggcngcnggggactaactctcggtggaggaagcgcacctgctgtccgtcgcctacaagaacgtcatcggcgcccgcagggcctcgtggccgattcatctcctccatccaacaaaaaggaggaaaggcccgcgggaaacaaagcgcacggccgtattcattcgggggcctaacggtttccaagaatcgagggccaagctttgccccccatttggcgaagggatttctaggggcttcttgtaattccaacctttggtcaaaatctgcccggggggggccgagggccaaggggtcccctccccttaaaaggaaaggggggcactccccaagggacccttttgggagagtcccaaggtggggtggaaaaaaggggaggggggtcccttcggggggaacccctccaaaagagggggaaaaacttcccccgagctcgggtgcgcctgtattttaaggggggcccctggacgggacccccttggggagagggggggcctcaaacacccctctttagaaaaggtgttttcacccacagagaagaaacgngcncgccccccggggggggcggtta

SEQ ID NO: 75659 - protein, 46 aa, Zea mays
  misc_feature: Ceres CLONE 1560134
MSPSEPTREESVYMAKLAEQAERYEEMVEFMERVARYAGGRPAAGD

SEQ ID NO: 75660 - DNA, 862 bp, Zea mays
  misc_feature: Ceres CLONE 1560135
  misc_feature: Encodes the peptide sequence at SEQ ID NO. 75661
ctggagctccccgcggtggcggccgctctagaactagtggatcccccgggctgcaggaattcgtctcacccctagaaaaaacccagcaccgcagagctctcatcctctctctctttctcgcgctcgctttgcttcctcgtcgaggtccaagttcctgcattgatggcgaccgaggtggctgagactcccgcgccgttggcggaggcggtccccgagacccccgcggaggcaccggcggcgcccgccgccgaggcgaagcctaccaaggccaagaaggcctctgcacccaagaagcgtgccaacccgacccacccgccgtacgccgagatgatctcggaggctgtcacgtcgctcaaggagcggacggggtccagccagtacgcgatcgccaagttcgtcgaggacaagcacaaggacaagctcccgcccaacttccgcaagctcctgctcggccagctcaagaagctcgtcgccggcggcaagctcaccaaggtgaagaactcctacaagctgcccgcacgcgccccggccgccgccaagccgaagcccaagtccaagaccgctgtgaagaagcccaaggccggtgccaagaagcccaaggccgccaccaagccccagccgaagctcaagggcaagtccccccgctagggcgaagcctgccgcaaagcccaaggcagcctgcgaagcccgtcgctaagccgaaacccgcagcggccaagcccaaggcggcccgcaaagcccaaggccaaagccagctgccaaaggctaagcccaaaggctgcccccggcccaacccaaaccagcttgcaaagaaggcccggccggccccgccaagggccgcccagaacgttcggccaaggaa

SEQ ID NO: 75661 - protein, 161 aa, Zea mays
  misc_feature: Ceres CLONE 1560135
  misc_feature (49)..(119): Pfam Name: Linker_histone Pfam Description: linker histone H1 and H5 family
MATEVAETPAPLAEAVPETPAEAPAAPAAEAKPTKAKKASAPKKRANPTHPPYAEMISEAVTSLKERTGSSQYAIAKFVEDKHKDKLPPNFRKLLLGQLKKLVAGGKLTKVKNSYKLPARAPAAAKPKPKSKTAVKKPKAGAKKPKAATKPQPKLKGKSPR

SEQ ID NO: 75662 - DNA, 814 bp, Zea mays
  misc_feature: Ceres CLONE 1560137
  misc_feature: Translation starting site: 161
  misc_feature (760)..(760): n is a, c, t, g, unknown, or other
ctggagctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccaaacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggagtgctggagaagtgggtgcgcgtggacttcaaggagcccgtgtggttcaaggcggcgcgcagatcttctcgaagggcgggctggactacctgggcaaccccaacctggtgacgcgcagagcatcctggcgtgctcggcttcaggtcatcctcatgggcctcgtcgagggcttcgcatcacgggcctcgacggcgtcggcgaggcaaccactctaccccggcgcaagtactcgacccgntgggctcgccgaagacccgtcacttcgcgaagtcaggtcaagagatcagaacgg

SEQ ID NO: 75663 - DNA, 808 bp, Zea mays
  misc_feature: Ceres CLONE 1560138
  misc_feature: Encodes the peptide sequence at SEQ ID NO. 75664
  misc_feature (415)..(415): n is a, c, t, g, unknown, or other
  misc_feature (455)..(455): n is a, c, t, g, unknown, or other
ctggagctccccgcggtggcggccgctctagaactagtggatcccccgggctgcaggaattcgtctcacccctagaaaaaagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctccccagcgctttcttcgtgttcatggaggaatttcgcangggagtcaaggagaaggacccctagaaccaagtctgtcgnctgcggtgggggaaaaagctgctgggcaacaggggtggaaaatcccctggagacgagttccgaaaaaaagggctccccttaggtaggccaaagggtaaaaaagctctcagctccgaggtccaaaaggggccttttctggcctataaaaaaggggggaaaacccccttgccctaaaaaaggcccccctccccgggggggaaaaggggggaaaattaaaaagggggttttttaaaaaatccccaattgggggggcttttttccccagggtatttaaaaaaaggggggttttgggggggggttaaaaaaaattttcccccccgggttgtgggccctccccccgaaaaaaaaaaggg

SEQ ID NO: 75664 - protein, 98 aa, Zea mays
  misc_feature: Ceres CLONE 1560138
  misc_feature (57)..(57): Xaa is any aa, unknown, or other
  misc_feature (71)..(71): Xaa is any aa, unknown, or other
MKGAKSKGAAKADAKLAVKSKGAEKPAKGRKGKAGKDPNKPKRAPQRFLRVHGGISXGSQGEGPLEPSLSXAVGEKAAGQQGWKIPWRRVPKKRAPLR

SEQ ID NO: 75665 - DNA, 856 bp, Zea mays
  misc_feature: Ceres CLONE 1560140
  misc_feature: Translation starting site: 223
  misc_feature: Pfam Name: Zip Pfam Description: ZIP Zinc transporter
ctggagctccccgcggtggcggccgctctagaactagtggatcccccgggctgcaggaattcgtctcacccctagaaaaatctccaagccctccggccgcccccgcctcgcctcgcatcgtactcgtaccgagaataaaacccaaatccgccccgcgtccggcgtccccctaccatttcccgggtcacgagtccacggcctcctcgctcgcggtcccgcgccatggcccgcgccaccaacgcccaccaccaccgcctccgcctcctcctctgcctctccctcgcggccgccgcgtgggcgcacggcggaggcggggactccgacgccgacgccgacgcggatgggggcgccgccgccaggccggacctgcgcgcgcgcagcctggtggaggccaagctgtggtgcctggcggtggtgttcgtcggcacgctgctgggcggggtgtccccctacttcatgcgctggaacgaggcgttcctcgcgctgggcacgcagttcgcgggcgggcgtcttcctcggcacggcgctcatgcacttcctcagcgacgccaacgagacgttcggggacctgctccccgacagcgggtaccccctgggcgttcatgctcgcctgcgccggttacgtcgtcaccatgctcgccgacgtcgccatctcctacgtcgtctcacggtcacaggggggcagcaacggcaacgcccgctacggcggttcttatgcagggctggagagggcagatgagaacacaaatggcacgagtctgacccacaccgctgatgcaacggatctgatcatcgccgcatcatctgcaccagacacggactggctccaaagcttgctctcgctcagatgccgaca

SEQ ID NO: 75666 - DNA, 920 bp, Zea mays
  misc_feature: Ceres CLONE 1560141
  misc_feature: Encodes the peptide sequence at SEQ ID NO. 75667
  misc_feature (454)..(454): n is a, c, t, g, unknown, or other
ctggagctccccgcggtggcggccgctctagaactagtggatcccccgggctgcaggaattcgtctcacccctagaaaaagtcaattcatccaccttgtccgtccctccctgagaaccagaaggccacccaccttccaaggcaggggaggggccatggacgaccccgtcgagcgcttgaaggacgggttccacaagttcaagaccgaggtctatgacaagaagccggagctgttcgagcctctcaaggccggccaggcccccaagtggtgttcgcctgctccgactcccgcgtgtgcccgtcggtgaccctgggcctgcagcccggcgaggccttcaccgtccgcaacatcgccgccatggtcccagcctacgacaggaccaagtacaccggcatcggggtcgccatcgagtacgccgtgtgcgcgctcaaggtggaggttctcgtggtcattngccacagctgctgcggtggcatcagggcgctcctctccctccaggaacgcgccacctgacaaattttcacttcggtgaaaactgggttaaagattcggtttccctggccaagaattagggtgaaaaaaaaaccaccccctccggtgcccttttcaaaaaacccaggggccctattttcaaaaaaaaggaggcccttaaaccctttccccttggaaaaaccctaagaccctaccccctttcgttaaagaaaggggttggcccaagggggacccccaaaggggggggggggggcccttaaaatttttgggggctggggggaattcctctcccgtgggaaaaaataaagccccccccggggaaattcttttttatccccccccggggggggggtgtttggttttccggagggggccccccaaacaaaataaataacccggagaccccccggggggtgtgggagaatgtt

SEQ ID NO: 75667 - protein, 51 aa, Zea mays
  misc_feature: Ceres CLONE 1560141
  misc_feature: SWISSPROT Homolog: EC 4.2.1.1 Carbonate dehydratase
  misc_feature (33)..(33): Xaa is any aa, unknown, or other
MVPAYDRTKYTGIGVAIEYAVCALKVEVLVVIXHSCCGGIRALLSLQERAT

SEQ ID NO: 75668 - DNA, 983 bp, Zea mays
  misc_feature: Ceres CLONE 1560142
  misc_feature: Encodes the peptide sequence at SEQ ID NO. 75669
  misc_feature (585)..(585): n is a, c, t, g, unknown, or other
  misc_feature (697)..(697): n is a, c, t, g, unknown, or other
  misc_feature (792)..(792): n is a, c, t, g, unknown, or other
  misc_feature (793)..(793): n is a, c, t, g, unknown, or other
  misc_feature (846)..(846): n is a, c, t, g, unknown, or other
  misc_feature (983)..(983): n is a, c, t, g, unknown, or other
tggagctccccgcggtggcggccgctctagaactagtggatcccccgggctgcaggaattcgtctcacccctagaaaaaaccaacctcagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgaccccttcggtcggggggggcccgtggagtacctgcagttcgagttggactccctggaccagaacctggccaagaatgagggcggcggcatcatcggcacccggttcgagtcctcccaaagtcaagtccaccccctttgccacccctaccgcggagggtgttcggccctccagcgggttccgcggaggggggagctcattcccccgggccgcctggggcaatgttttgnccacccctcggggggccctcctccggtcggaaggggggttaacccggcgtcccccctggcaaggaacccccgcgccaaggtaactttaaaaagaccaacgccttttaagccnttgcggggccggtggatccccttgggagatttcctccccccacatctccctcccaaaaaaaatactaaaaccaacctgtgcgaattatattgggnncgcgccccggactaaccgataaaggtgagacggggggaagggtgtggaaaaangaacccccctccccttggtggccccgccctgtggtttcgcttcctatttgaggcgcgcacggggagagagaggaggggtgcgaacgacgcggactgccaattcttccctccacttctagaccgcacaccgccaaacn

SEQ ID NO: 75669 - protein, 228 aa, Zea mays
  misc_feature: Ceres CLONE 1560142
  misc_feature (155)..(155): Xaa is any aa, unknown, or other
  misc_feature (224)..(224): Xaa is any aa, unknown, or other
MASSVAAAASTFLGTRLADPAPQNGRIVARFGFGLGGKAKPAPKKVAKTSTSSDRPLWFPGAVAPDYLDGSLVGDYGFDPFGRGGPVEYLQFELDSLDQNLAKNEGGGIIGTRFESSQSQVHPLCHPYRGGCSALQRVPRRGELIPPGRLGQCFXHPSGGPPPVGRGVNPASPLARNPRAKVTLKRPTPFKPLRGRWIPLGDFLPPHLPPKKNTKTNLCELYWXRAPD

SEQ ID NO: 75670 - DNA, 905 bp, Zea mays
  misc_feature: Ceres CLONE 1560143
  misc_feature: Encodes the peptide sequence at SEQ ID NO. 75671
aaaagctggagctccccgcggtggcggccgctctagaactagtggatcccccgggctgcaggaattcgtctcacccctagaaaaaatcccccactgctcaccagtgagagagcactcgcgacccacacgggttcgctccgccgacgggtccactccaactttcctatgtccaggaatccgcggatgaggcgcccgcgatgggggctcccatggtcgactccgaatacctgcgccaggtcgagagggagcggctccacctaagggccctcatatccaaaaagggatgcaccgcgatcatgggccgccccgcatcgcatgatgctggaacttatgagctgaaaacgaaaactgatgctgcaaatggttcggtgagaccccaaaaaaagtacgctcacgggcccaatgcaggttaaaagattggtaaagatctccttggagcctacgaaggagagaatccagagaacaccttttgaagacccgcaaacaactatgcctgaacgggttgcagccccaacaagaacggggggggccaacccgtttgaaatttaatccaggggggaaagattaaaaacaggcggggggggggcccccgggaaagggggcccccttccccaaaagccctctagaaagaggggggggccgcaatctcggggggaagaatctttttatttcgccttgggggagtgcatcccccgaaaaaaaaattccaaaacgaccgtctgggcgggggctcaaaacgaaccgggaggaggggcgccccccccaaatagggggcggcaacctccatgagcgggcctcccacgaacatgacccccgttcagcgcaatgatgaacaccaaaaactttcccaaggatttgttaagcacaaccccaacccccggccggtttcctacgcgccccccccg

SEQ ID NO: 75671 - protein, 71 aa, Zea mays
  misc_feature: Ceres CLONE 1560143
  misc_feature: SWISSPROT Homolog: EC 1.11.1.11 L-ascorbate peroxidase
MGAPMVDSEYLRQVERERLHLRALISKKGCTAIMGRPASHDAGTYELKTKTDAANGSVRPQKKYAHGPNAG

SEQ ID NO: 75672 - DNA, 900 bp, Zea mays
  misc_feature: Ceres CLONE 1560144
  misc_feature: Encodes the peptide sequence at SEQ ID NO. 75673
  misc_feature (496)..(496): n is a, c, t, g, unknown, or other
  misc_feature (654)..(654): n is a, c, t, g, unknown, or other
  misc_feature (655)..(655): n is a, c, t, g, unknown, or other
  misc_feature (714)..(714): n is a, c, t, g, unknown, or other
  misc_feature (715)..(715): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (763)..(763): n is a, c, t, g, unknown, or other
  misc_feature (801)..(801): n is a, c, t, g, unknown, or other
  misc_feature (831)..(831): n is a, c, t, g, unknown, or other
  misc_feature (872)..(872): n is a, c, t, g, unknown, or other
  misc_feature (887)..(887): n is a, c, t, g, unknown, or other
acccgcggtggcggccgctctagaactagtggatcccccgggctgcaggaattcgtctcacccctagaaaaaacgccacgctctccaacgccacagcttgcgcccgcaatggcactcgtctccgcctcctcgtcctccaccaccgccgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttcatccctggggccgcggatctgacccggagagcctgcggtggaacgtgcaggcggagctggtgcactgccggtgggcgatgctcggcgcggcgggcatcttcatcccggagttcctgagcaagatcggcgtcctcaacacgcccttctggtacnccgccggcgagcaccagtatttcaccgaaccccacaccctcttcatcatcgagctcatcctcatcgggtggggccgagggccctccctggggtgacataatcaaggccgggaacggtcaaaccgaaccccttctttcccaggaaacgggttacccggnnaccgaatttcggggaccccgggggggcctccgggtttgacccccctcggccggggcaannggtatccccggaaaagaaaaggaaacttggccccnnnnggggatccgnaagggggccgccttgccctggtcccgcgttattggggncccctgtgtccccgccccaaaccacccggngagcgggccccaatctaaaaagcctcctttcggccctccgnggaggaacggtgggntcggccctccctt

SEQ ID NO: 75673 - protein, 160 aa, Zea mays
  misc_feature: Ceres CLONE 1560144
  misc_feature (63)..(161): Pfam Name: Chloroa_b-bind Pfam Description: Chlorophyll A-B binding protein
  misc_feature (130)..(130): Xaa is any aa, unknown, or other
MALVSASSSSTTAVTALPRNGQRASSSFLGGKTLLRQAEAARPSFAVRAAADPNRPIWFPGSTPPPWLDGSLPGDFGFHPWGRGSDPESLRWNVQAELVHCRWAMLGAAGIFIPEFLSKIGVLNTPFWYXAGEHQYFTEPHTLFIIELILIGWGRGPSLG

SEQ ID NO: 75674 - DNA, 821 bp, Zea mays
  misc_feature: Ceres CLONE 1560145
  misc_feature: Encodes the peptide sequence at SEQ ID NO. 75675
  misc_feature (230)..(230): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (693)..(693): n is a, c, t, g, unknown, or other
aaagctggagctccccgcggtggcggccgctctagaactagtggatcccccgggctgcaggaattcgtctcacccctagaaaaagccgcctcctccccactgcctcgtgtggccgtcgtctcccgttcggaacgccaagcccccctccggcgaaatggcccccaagcgaggtggcagggcgccggtgccggccaagaagaagacggataaagtgacgaaccctctgtttngagaagaaaggcctgaaaaagcagttcggcatttcggcgggggcgcgttgcccggcccaaagaaggggacctggcaacccgggttccgttccaaggggggcccccaaaagggggcccgggggggggaatttttcccaaggggggcgggggggcgccctcatttctctctaannnnnnaaaaaaacccccccaaaggggacccccggggggtcaaaacatttttcccccccccccccccaaaaaaaaacccccccaaaaaaccgttttaaaaaaagtttttttaaaaaacccccccccaaaaaaaaaaggggtcccccaaaaaagagaggttttttttttaaaagagggcccccccccaaaaaaaaaaagaaaaaaaaaaatttttttttaaaaaaaaaaaaaaaacttttttgggtggggggggggggggcccccccccccggggggtggtccccccccctcnaattgaaaaaaaaaaaaaaagctctttccttttttttcttccccccccccccccccgggggcccacaaaaaaacaagggaaggaggggggggggggggccccccccccccccccccaacaaaagaaaa

SEQ ID NO: 75675 - protein, 114 aa, Zea mays
  misc_feature: Ceres CLONE 1560145
  misc_feature (26)..(26): Xaa is any aa, unknown, or other
  misc_feature (83)..(83): Xaa is any aa, unknown, or other
  misc_feature (84)..(84): Xaa is any aa, unknown, or other
  misc_feature (85)..(85): Xaa is any aa, unknown, or other
MAPKRGGRAPVPAKKKTDKVTNPLFXEERPEKAVRHFGGGALPGPKKGTWQPGFRSKGGPQKGARGGEFFPRGAGGRPHFSLXXXKNPPKGDPRGVKTFFPPPPPKKNPPKKPF

SEQ ID NO: 75676 - DNA, 869 bp, Zea mays
  misc_feature: Ceres CLONE 1560146
  misc_feature: Encodes the peptide sequence at SEQ ID NO. 75677
  misc_feature (681)..(681): n is a, c, t, g, unknown, or other
  misc_feature (687)..(687): n is a, c, t, g, unknown, or other
  misc_feature (772)..(772): n is a, c, t, g, unknown, or other
  misc_feature (825)..(825): n is a, c, t, g, unknown, or other
  misc_feature (829)..(829): n is a, c, t, g, unknown, or other
aaagctggagctccccgcggtggcggccgctctagaactagtggatcccccgggctgcaggaattcgtctcacccctagaaaaacccgtgccattgccattcacctccagccaggctacggaaccttatcaccaaaatcctcgtcccctacccgaggcgagcatcatggcggccgcgctcttctccagctcgctctcgccccgcttcctcgccctatcctccccgaagccggccgcgcccgcggccacagccttcctccccttcaggctgccgccgcgcgctgtctcggcgccgggtaggcgggtcttcgagcccgtggccgtcgcggtgtcgtcggagtacaagacggagggcgcggagcaggagggggaggatggatccgaggagttctccgaggacctgaagctgttcgtcggcaacctaccgttcagcgtcgacagcgcgcagctcgcagggctcttcgagcaggccggctccgtcgagatggtcgaggttgtatatgacagaatgactggacggatccgaggatttggattcgtgacaatgtcttcggccgaagaagccgaagctgctgtcgagcagttcaacggttatgcatttcaaggaagacagctgagggtgaactgcgggccaccgccacctagagatgaatcacaccaagagcaccaaggggtggtggtnggtggncgcggcggctttgtcgaatcagctaaacaagtctacgtggggaacccttgcgtgggcgttgaacactcaactctggagaacctgntcagtgagcaagggcaagtgcttgatgctaaggtcatctacgacagggatagncgcnggtcaaggggggtttgggtttcgtcacctatggctccgcc

SEQ ID NO: 75677 - protein, 234 aa, Zea mays
  misc_feature: Ceres CLONE 1560146
  misc_feature (81)..(152): Pfam Name: RRM_1 Pfam Description: RNA recognition motif. (a.k.a. RRM, RBD, or RNP domain)
  misc_feature (203)..(203): Xaa is any aa, unknown, or other
  misc_feature (220)..(220): Xaa is any aa, unknown, or other
  misc_feature (222)..(222): Xaa is any aa, unknown, or other
MAAALFSSSLSPRFLALSSPKPAAPAATAFLPFRLPPRAVSAPGRRVFEPVAVAVSSEYKTEGAEQEGEDGSEEFSEDLKLFVGNLPFSVDSAQLAGLFEQAGSVEMVEVVYDRMTGRIRGFGFVTMSSAEEAEAAVEQFNGYAFQGRQLRVNCGPPPPRDESHQEHQGVVVGGRGGFVESAKQVYVGNPCVGVEHSTLENLXSEQGQVLDAKVIYDRDXRXSRGVWVSSPMAP

SEQ ID NO: 75678 - DNA, 828 bp, Zea mays
  misc_feature: Ceres CLONE 1560147
  misc_feature: Encodes the peptide sequence at SEQ ID NO. 75679
  misc_feature (736)..(736): n is a, c, t, g, unknown, or other
tggagctccccgcggtggcggccgctctagaactagtggatcccccgggctgcaggaattcgtctcacccctagaaaaatatgagaagcaatggacagcctgtgtataacttctgtgtgacagttgacgacgctaccatgcaaatatctcatgttatcagagctgaagagcatctaccaaacacattgcgacaagctttaatttacaaagctcttggattcacaatgccttcatttgctcatgtttcgcttattctggctcctgacaggagtaaactgtctaaacggcatggagctacttctgtcgggcagtataaagatatgggctatctacctcaggcaatggtgaattatttagcactactgggctggggtgatggcactgagaatgagttcttcactattgatgacctagtccagaaattcactataaaccgtgtcaataaaagtggagcagtctttgatgcaacaaaattgaaatggatgaatggacaacatctaagatcatttccccatgatgaactcatcaaagcttttgaagatcggtggaaggacacaggcattctccaggaatctgaaagtggttttgctaaggaagctgccgagcttttgaaggatggtatcgatttgataacagatgcggacgcagctctaacgaatctgttgtcatatccccttcatactactctaagcagcgaggaagctaaacctgtggtgcaagacaagatctccgaggntgcttggagtcttatttccgcgtacgacagcggcgaaactcggccagcgctagctgaagggcgtgatggctggcagaagtgggtttaaggtt

SEQ ID NO: 75679 - protein, 247 aa, Zea mays
  misc_feature: Ceres CLONE 1560147
  misc_feature (1)..(134): Pfam Name: tRNA-synt_1c Pfam Description: tRNA synthetases class I (E and Q), catalytic domain
  misc_feature: SWISSPROT Homolog: EC 6.1.1.17 Glutamate--tRNA ligase
  misc_feature (219)..(219): Xaa is any aa, unknown, or other
MRSNGQPVYNFCVTVDDATMQISHVIRAEEHLPNTLRQALIYKALGFTMPSFAHVSLILAPDRSKLSKRHGATSVGQYKDMGYLPQAMVNYLALLGWGDGTENEFFTIDDLVQKFTINRVNKSGAVFDATKLKWMNGQHLRSFPHDELIKAFEDRWKDTGILQESESGFAKEAAELLKDGIDLITDADAALTNLLSYPLHTTLSSEEAKPVVQDKISEXAWSLISAYDSGETRPALAEGRDGWQKWV

SEQ ID NO: 75680 - DNA, 849 bp, Zea mays
  misc_feature: Ceres CLONE 1560148
  misc_feature: Translation starting site: 248
  misc_feature: SWISSPROT Homolog: EC 1.3.1.33 Protochlorophyllide reductase
ctggagctccccgcggtggcggccgctctagaactagtggatcccccgggctgcaggaattcgtctcacccctagaaaaactcccggacgaatgagaactcctgccgcgacctcggcttacctccctacccgacccccacgcgaagaggaagaggaataacccatcccaatcctcagtcctcatgctgctcacagttcgtgctatacactcgggctaccggtggtctgcctgctcggctattcggcaatggcgactccgggcgcgacgtgcttcctcccctcggccctctcggaacgcaaggaggggtctgctgtgaaggactctgcgttcttgggtgtccatctcgcggacgatggcctcgagctggagactgctgctctgggcctacgcagcgagagggtgatcacttccgtggacatccgcgcgcatgcggcagcggtgtcctcactatcactaacccccacgtctccctccggcaagaagacgctccgcaagggcacggcgagcataaccagcacgtcgtgcggtctctgcctgaccacggcgacgcctggcagaaaccggcaactggcacgtcatcatcgtctggcgcgatattctcaaggcgtcgcgcccggtccaaatgcgtcgggatgaaccaggtacagcttcagcggtcgtgcaccttggacctcggactccttaaaccgctttcgggcagtttggtcaagaaactttcgcccacgctggaaatgccccttacaaactggtagggtttggaaaacccccccgggtgtcccgccccaaaggaaaaggggggcgtttcctacacttccccaaagggtttttcaaaataaaaagagatgggc

SEQ ID NO: 75681 - DNA, 884 bp, Zea mays
  misc_feature: Ceres CLONE 1560150
  misc_feature: Encodes the peptide sequence at SEQ ID NO. 75682
  misc_feature (823)..(823): n is a, c, t, g, unknown, or other
ggagctccccgcggtggcggccgctctagaactagtggatcccccgggctgcaggaattcgtctcacccctagaaaaaagcgcccgtcgcctccctttccccttccctccctccctctccgcgcgggccgcctgaggcaatttcgccctctattcgaccccgattcgtccgcccgcgaccgggattccctccgcccagcgcggatctgaacgctgcgctccgtgtcgccgctcgaatccaccatgaagggggccaaatccaagggcgccgcctaggtcgatgccaagctggtggtgaacagcaagggggcggagaagcccgccaagggcaggaaagggaaggccggcaaggaccccaacaagcataagagggctcccagcgctttcttcgtgttcatggaggaatttcgcaaggagttcaaggagaagaaccctaagaacaagtctgtcactgcggtggggaaagctgctggctacaggtggaaatccctgagcgagtctgacaaggctccctatgtagccaaggctaacaagctcaagctcgagtacaacaaggccatcgctgcctacaacaagggcgagagcactgcagctaagaacgctcctgccaaggacgaataggaggaagatgaataggagtctgacaagtccaagtcggacgtcaatgacgacgatgatgaagagggtactgaggaggatgaagatgatgaccagtgatggacctcctcgagagcatggaccgtgctttgtccaacaatgtagcggctacacaacgtccccgtggcgatcacggaaaccgagcctattccatgtactagaattantcagttttccttgacatggtgatgctttatttttacttatggcgagctattacgggaagcg

SEQ ID NO: 75682 - protein, 74 aa, Zea mays
  misc_feature: Ceres CLONE 1560150
  misc_feature (1)..(59): Pfam Name: HMG_box Pfam Description: HMG (high mobility group) box
MEEFRKEFKEKNPKNKSVTAVGKAAGYRWKSLSESDKAPYVAKANKLKLEYNKAIAAYNKGESTAAKNAPAKDE

SEQ ID NO: 75683 - DNA, 866 bp, Zea mays
  misc_feature: Ceres CLONE 1560151
  misc_feature: Encodes the peptide sequence at SEQ ID NO. 75684
  misc_feature (608)..(608): n is a, c, t, g, unknown, or other
tggagctccccgcggtggcggccgctctagaactagtggatcccccgggctgcaggaattcgtctcacccctagaaaaattcccaattcgcaacagcccaaacagatagacccggtccgggtggcggccgtttcaattcgaggcttgtggccggccgccgctgaagcaggaaggagcgtgcgtcggacatggaggacgcacgcgtgctgccggttgtcttcgtcgacggcgagcagagcgtggacttgggcacggtgaccgtgcagccgtcgtttggcggcgtgaagcggcttcaggccgtcgtggcagaccgcgtgggcgccgcgccgcaccagatctcggcgtccctggcgcggccccgccgcgcccgccatgtgcccctcgacgacgccaccgacctcgccgccgccgtcgcgcgggagggttccgggtgctacgtcatcgctgggttccgccgctcccgccggggcggccggtcccgccgcgacaggaagggagtcaacggcgcggccgtggagaagacatcctgaagcgcctctcgccacggatctggcgtctctggtcagccttctccctctccctccccgcggcagatgccggtgcctccncccggggcgcttcgggctctacgacgactacgaagcgcggctgccgggacctgcatcggcagctcgaatggtactttaatgagcacccctgggggcggggtcccggtttcggaacccccgcctactttacccttggtcggggggcgggcggggccttttcggataaaccagggacccccccccttgtgggctcccggagggaaagaacccttttctcctggcccccaaaaatgaaaaagcgggcggggggcgccccta

SEQ ID NO: 75684 - protein, 113 aa, Zea mays
  misc_feature: Ceres CLONE 1560151
MEDARVLPVVFVDGEQSVDLGTVTVQPSFGGVKRLQAVVADRVGAAPHQISASLARPRRARHVPLDDATDLAAAVAREGSGCYVIAGFRRSRRGGRSRRDRKGVNGAAVEKTS

SEQ ID NO: 75685 - DNA, 861 bp, Zea mays
  misc_feature: Ceres CLONE 1560152
  misc_feature: Encodes the peptide sequence at SEQ ID NO. 75686
ggagctccccgcggtggcggccgctctagaactagtggatcccccgggctgcaggaattcgtctcacccctagaaaaagtagcaaagcaaactagcaaatcaaggcaagtctggaacggccccaccgatccgacccaaagcccaaatcggattcccctcgtttctcatcacgccaccgtttacccgccgccgcactggcagcggcgatggcgtcgtcgtcgtcgcggcccctgctctgccgcctcgcggaactggccagcggccgcgtccgagccaactaccgcatgctctcatccgccttttcatccactgcctccaccgagagggtttcgcagtcgccggcggagcccgaggccgtgctcatgacggaaggttgcgtccggagattaaaagaattacatgctaaagaaccatcctctgaaggtaagatgctgcgcttaagcgttgaagctggtggatgttctgggtttcaatattctttcgctcttgatgacaagaaaaactcagatgatagggtttttgagactgatggtgttaaattggtcgtggatgacatctcatatgactttgtaaaaggtgccactgtggattcaggaggaacttatacgttcagcgttcgtggtttcaacaaatcctagtgctgttgggggctgcagctgcaagagttctttcatgatgaaatagcttcaattaccttgaagagatcaatacttggaaatagcattctgtagcgaatcatacgcttttggatctgagtgtacaattgctatttttatggtagttctgaagacgtttcttcttgaggttttgtactgttgcaccatcatcgcagactggtctgtatcatctgtatccctctaa

SEQ ID NO: 75686 - protein, 143 aa, Zea mays
  misc_feature: Ceres CLONE 1560152
  misc_feature (51)..(136): Pfam Name: Fe-S_biosyn Pfam Description: Iron-sulphur cluster biosynthesis
MASSSSRPLLCRLAELASGRVRANYRMLSSAFSSTASTERVSQSPAEPEAVLMTEGCVRRLKELHAKEPSSEGKMLRLSVEAGGCSGFQYSFALDDKKNSDDRVFETDGVKLVVDDISYDFVKGATVDSGGTYTFSVRGFNKS

SEQ ID NO: 75687 - DNA, 818 bp, Zea mays
  misc_feature: Ceres CLONE 1560153
  misc_feature: Encodes the peptide sequence at SEQ ID NO. 75688
  misc_feature (781)..(781): n is a, c, t, g, unknown, or other
tggagctcaccgcggtggcggccgctctagaactagtggatcccccgggctgcaggaattcgtctcacccctagaaaaattgtggctgctcacggttattttggtcgattaatcttccaatatgctagtttcaacaattctcgttctttacacttcttcttggctgcttggcctgtagtagggatctggttcactgctttaggtattagtactatggcattcaacctaaatggtttcaatttcaaccaatctgtagttgatagccaaggtcgcgttattaatacttgggctgatatcatcaaccgtgctaatcttggtatggaggtaatgcacgaacgtaatgctcacaacttccctctagacctagctgctcttgaagttccttaccttaatggataaggtttttctcctaaacatataggaatttttgaaggaaggaaagccggaaatacccaatatcttgttccaacaggatattgggtatttcttaacaagccttctattatctattttctttctagttaatacgtgtgcttgggagtccttgcaatttgaataaaccaagatcttaccatgactgcaattttagagagacgcgaaagtacaagccctgtggggtcgcttctgcaactggataactatcaccgaaaaccgtctttacattggatggttcgggtgttttgatgatccctaccttattgaccgcaacttccgtatttattatcgccttcatcgctgctcctcagtagaatatgatggtattcgtgagccctgttctggntctttactttatggaaaacatatatctctggtgctat

SEQ ID NO: 75688 - protein, 61 aa, Zea mays
  misc_feature: Ceres CLONE 1560153
MAFNLNGFNFNQSVVDSQGRVINTWADIINRANLGMEVMHERNAHNFPLDLAALEVPYLNG

SEQ ID NO: 75689 - DNA, 847 bp, Zea mays
  misc_feature: Ceres CLONE 1560155
  misc_feature: Encodes the peptide sequence at SEQ ID NO. 75690
  misc_feature (731)..(731): n is a, c, t, g, unknown, or other
ggagctccccgcggtggcggccgctctagaactagtggatcccccgggctgcaggaattcgtctcacccctagaaaaaatctatccctccctaaagccatcttcttcttcctccttcagtcacccggcctgtcgtgtcgatctcactctcagggtccggtccggtccggtgcatcatatatacccttggtcgatcgatcgaccagatagatacactagatagctaggattgcattgtgttccaccaaaagccagccacaacacatcgacatgatgcaggacttgttctcggtcccttcgtgtttctcggcgggcgagaagcttccggacgtcccggcgtccgctgcggccaccaccaggtccgggcagagcgcggcgacgctggtctaccgcgcgggaatcgccggccacgaccgcctggtgacggtgacgtggtgcaggaacctgctcacccacgggctgaccgtgtcgatcgaagggtcggcgggcggcggcaaggacaagagcggcggcggcagggagtggggcgacaccgacagtggcgcggcctcgtcctccaacaagggctgcagcaccgcctgcaaggtggagatgcagccgtggcacttttggcgcaagtactggcgcaagcagttccacgtcgacggcagggccgtgggacgtggtctgggaactcaggagcgcgaagtactccgacgagcccgagccgctgtccgactactaacttccccntggtgtcggaaacaaagaaggtggtcctcttcctcggaacttcaaaaaaagaggggtttccgggcgcaccggggtcccccggcgcttccttgcggggaccccccccacctggttgt

SEQ ID NO: 75690 - protein, 192 aa, Zea mays
  misc_feature: Ceres CLONE 1560155
MMQDLFSVPSCFSAGEKLPDVPASAAATTRSGQSAATLVYRAGIAGHDRLVTVTWCRNLLTHGLTVSIEGSAGGGKDKSGGGREWGDTDSGAASSSNKGCSTACKVEMQPWHFWRKYWRKQFHVDGRAVGRGLGTQEREVLRRARAAVRLLTSPWCRKQRRWSSSSELQKKRGFRAHRGPPALPCGDPPHLV

SEQ ID NO: 75691 - DNA, 758 bp, Zea mays
  misc_feature: Ceres CLONE 1560156
  misc_feature: Encodes the peptide sequence at SEQ ID NO. 75692
ctggagctccccgcggtggcggccgctctagaactagtggatcccccgggctgcaggaattcgtctcacccctagaaaaagtggcgcagccacaactaggcgaccgccgccgcccctacgccacgtgctcgagtctagcctcgtcgattgcttccccagtttaattgatctacaagcttcagaacatgttcaagaatacatttcagtctgggttcctgtccattctttatagcctcgggaccaagccattgcagatatgggataaggaagttgtgaatgagcacattaaaacgaccccaagatgaagatatccagatctaatgtactttgaaaattgttgggaacatatgtacaggtcgagtttacatcacgtggccccagctgatccctttcggcctactcttggggaattaaagctttccaattttctggggctaataatggtggaaaaaaaaccctaaagaaaattctttccggcgtttttgaagaattccccaggttccgggaattggaaaagaaaaatggtccccaaaattttttaatttttggaagccaaaccaaaattttttttaaaatctctggtacccaagaggggtggggaggacgccccatttttttttttttcccccaaaaaaaagccccctttgtggaaaaaaccctctcccacaaaaaaaaggggggggggggaaaaaaaaaaccccccccccccccggttttgaaaaaaaaattttttttcccgaaaaaaaaaaacagaggga

SEQ ID NO: 75692 - protein, 39 aa, Zea mays
  misc_feature: Ceres CLONE 1560156
MFKNTFQSGFLSILYSLGTKPLQIWDKEVVNEHIKTTPR

SEQ ID NO: 75693 - DNA, 752 bp, Zea mays
  misc_feature: Ceres CLONE 1560157
  misc_feature: Encodes the peptide sequence at SEQ ID NO. 75694
ctggagctccccgcggtggcggccgctctagaactagtggatcccccgggctgcaggaattcgtctcacccctagaaaaaaacggcggtgggactggcgataagacgaagacgaaggcgacaggagggctcaccggtcgcgaaccctcctcctccagccacgcctcgaaacggcgtcggggcctgcgcggcgagtccatggctgatcgcttcattcccaatgactttcctgacttcgtcgccgaggctgaggcctccgacggcgaggggcaccgccccgcagggcatcagggcctgctctcgcttccgtacaccaggctctccgaccacttcgtccgcgccgcgcgccgcctcaaggacaaggtggttgaggagacatgcgtgaaagccggacggaaggtgacggactacacgctctacacgggctctctcgggacagcgctgctgctgttcaagtccttgcaggtcactggagaccgcggggaactcaccctcgcagctgatatcgtccgcgcgtgcaatgatgcgtcacgggggctgtcccaaagggttcttgacaatcatatgcgggaggggcgggtgcctgccctctttggggcggtggattggccaaccattgggaggaaatcagctttaaggggagcctcggaattttgagaatctccttttgggagaaaaaaaatgttcccccgaaaaaattccccaatgggactttctcttttaagggaaagggggggggctctttttcttttg

SEQ ID NO: 75694 - protein, 217 aa, Zea mays
  misc_feature: Ceres CLONE 1560157
GAPRGGGRSRTSGSPGLQEFVSPLEKNGGGTGDKTKTKATGGLTGREPSSSSHASKRRRGLRGESMADRFIPNDFPDFVAEAEASDGEGHRPAGHQGLLSLPYTRLSDHFVRAARRLKDKVVEETCVKAGRKVTDYTLYTGSLGTALLLFKSLQVTGDRGELTLAADIVRACNDASRGLSQRVLDNHMREGRVPALFGAVDWPTIGRKSALRGASEF

SEQ ID NO: 75695 - DNA, 882 bp, Zea mays
  misc_feature: Ceres CLONE 1560160
  misc_feature: Encodes the peptide sequence at SEQ ID NO. 75696
  misc_feature (776)..(776): n is a, c, t, g, unknown, or other
  misc_feature (797)..(797): n is a, c, t, g, unknown, or other
tggagctccccgcggtggcggccgctctagaactagtggatcccccgggctgcaggaattcgtctcacccctagaaaaaacttccgacctcatctctctccgtttattccctctctcatgcgtgcttggtgtggtgtgtggcgtataaacagttcttgcagatggcactcacatcatgatgagggggtgactccccactctcctccctagagatcctcattgttgtgctgcgtagaacgcacagcatcttcccacctctggcgaggacggtggcgacgtcgccgtcgccgctgctggcggcctgatcacaatgggcaactacctgtggtacatgccggaccgcctcaagtatctggaccccttctccgtccacacgcccttgtacatgatcggggagttccccggcaactacggctgggacaccgccaggctgtccccggacacggaggccttcacccgaaacagggcgctggaggtgatccacgcgccgtgggtgatgctgggtgcgctgggctgcatcacccctgatgtgctggataactgagtgcgcgtggacttcaaggagcccgtgtggttcaaggccggcacgcatatcttctcagagggcaggctggactacctgcgcagcatcaacctggtgcacgcacacagcatcctgaccgtgctcagcttccaggtcatcctcatgggactcatcaagagcttccgcatcaagcgcctcgacggcgtcagagagggcaacaacctctatgcgggtggccagtacttcgaccagntagacctctccgagaccccgntagcttcggctagctcaaggtcaaggagatcagaacggcccctcgccatggatctcatgttcggcatccttcgccaggacagttc

SEQ ID NO: 75696 - protein, 77 aa, Zea mays
  misc_feature: Ceres CLONE 1560160
MGNYLWYMPDRLKYLDPFSVHTPLYMIGEFPGNYGWDTARLSPDTEAFTRNRALEVIHAPWVMLGALGCITPDVLDN

SEQ ID NO: 75697 - DNA, 862 bp, Zea mays
  misc_feature: Ceres CLONE 1560161
  misc_feature: Encodes the peptide sequence at SEQ ID NO. 75698
aaagctggagctccccgcggtggcggccgctctagaactagtggatcccccgggctgcaggaattcgtctcacccctagaaaaatgttgtgcaatagcaaggagtacaatgtgtttgttatatgctccttcatcaccagtttgaaggtaaaaaattgttacgctatggacttgtattaatgtgagatttactgagttattgcaacaaaaattgtggtcattgattgagcattacagagctacacattacatcagggtcgctagcgtaagcaatgtatggttcaagcatctatggttgcttttttctaaactgcactggtcaaactatctgattctttcagttaccctcttatgatgattctattcatttgttatctaaccttgttcccattatcaggtgtccaaggatatcaagtatgctgacaatcaaccagtggtgccttggggaccaagattctcccgatcaacagtgaaggacatgcgcataaatatggcagtatcagcagcatttgtatgtactcctcctaattcataaaaaattacagctattgctaacatgctcattgtgtgaattcatgcttattagaatttgggccagggacagcattttgaccgagttactgacacacttgttttcacacatccatatacttttcatagttcatttcaaaactacaaatatgttaaaataccaaaggcatttatcctttttggaattgtggtgtctattgtactcataaagcgcatagcttgaaatatatgtatttatgttggggaatttaaaaaggggcagtaagtttgttcttttctggtctattcccagatatgctttccccataatccctaatcccctgttggaaaat

SEQ ID NO: 75698 - protein, 31 aa, Zea mays
  misc_feature: Ceres CLONE 1560161
MLCNSKEYNVFVICSFITSLKVKNCYAMDLY

SEQ ID NO: 75699 - DNA, 701 bp, Zea mays
  misc_feature: Ceres CLONE 1560162
  misc_feature: Encodes the peptide sequence at SEQ ID NO. 75700
gctggagctccccgcggtggcggccgctctagaactagtggatcccccgggctgcaggaattcgtctcacccctagaaaaagaagaagaaaaacatctcacgccacgcctgctgcagcacctcgctctccgctccgttggccccatggagtccgtcgcgtccgccgcgatcgccaccacctcccgctctctcccgctccccttctcttctaccccggtccaccgccggcgccgtgccgccttcctccccgttgccgcctccaagcgtcacgacgacgacaaggaggccgcgaaagggtccggctcggaaccacggcgcgagcccaccagcctcgcgccgtacggactctccatctcgccactcttcaaggacgcggccatggggctggctggtgagcgctgccacgaggagcagcttggaccaacggatcggggatggagggtcccgcgaacgccaagcaaagccggttggggcgggcaggaccggaagggtccaacccctaccttggtcccctcctacaggaaaaatcacccccgggcgggccccagaagagggtggcccttcccccttgggaaaaatggtgtgcggggccaggcataaacaaacaagggggccccataaaaattcccctcatgggcccaaaaaaccccccgttggggaaaccccagtgggttttttggttccccaaggggggggggggg

SEQ ID NO: 75700 - protein, 151 aa, Zea mays
  misc_feature: Ceres CLONE 1560162
MESVASAAIATTSRSLPLPFSSTPVHRRRRAAFLPVAASKRHDDDKEAAKGSGSEPRREPTSLAPYGLSISPLFKDAAMGLAGERCHEEQLGPTDRGWRVPRTPSKAGWGGQDRKGPTPTLVPSYRKNHPRAGPRRGWPFPLGKNGVRGQA

SEQ ID NO: 75701 - DNA, 895 bp, Zea mays
  misc_feature: Ceres CLONE 1560169
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (98)..(98): n is a, c, t, g, unknown, or other
  misc_feature (143)..(143): n is a, c, t, g, unknown, or other
  misc_feature (278)..(278): n is a, c, t, g, unknown, or other
  misc_feature (310)..(310): n is a, c, t, g, unknown, or other
  misc_feature (311)..(311): n is a, c, t, g, unknown, or other
  misc_feature (392)..(392): n is a, c, t, g, unknown, or other
  misc_feature (616)..(616): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (666)..(666): n is a, c, t, g, unknown, or other
  misc_feature (669)..(669): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnccaaagctgggactccccncggtggcggccgctctagaatagtggatccccctgggctgcaggnaattcgtctcaccctctagaaaaaatcgccactcctctctctctcgcgctctctctctttcatcgccaccaccgccgtgtaatccgcacgcgtgcttcctgtcgatttttgagctgtgactgtgaccgccatggncgtggaggctgtttccggaaatggcaccgaanngcgtgggcccgcggcgccgggcgaaaaggaggtgaagccctaaggcaggggttctttttccgggggggggggaaaaaaganaaaattctccccgggaaaaaccccggggaagcgaggccttaaggggcttccccaaaattccccccaaaaaaggggcagagaggggggccccctttttttggaaggggggaaaaaattttttttccaacacaaggaaaccccccccggggggaaaaaaaaaaaaaaaaggggggggggcccccccaaaaaaaaaaaaggcggccccccaggacgaaaaaaaaaanagtgggtttggattcccccccccccnnnnncccccccaaaaaaaaaaaanggnagaaagatgtgtggtttttgcacaaaaaagaggaggggccccccccccccccccccccccggaagaaaaaaaaaaaaaaaaaaaaccccttctttcttgtggggggggggggggaaaaaaaaaaaaaaagaaaacccccccccccccccccccggggggggggggagaaaaaaaaaaaaagcccccccccccccctccccgaaaaaaaaaaacccccccggccccc

SEQ ID NO: 75702 - DNA, 1478 bp, Zea mays
  misc_feature: Ceres CLONE 1560172
  misc_feature: Encodes the peptide sequence at SEQ ID NO. 75703
aacgcgcctgcccacgtacgcctcctcccctcccacacccaaccccagcgcacccacaagaggaataggaggaatcaatccgccccatgcccacatccgtcgccacccacgcatccctcctcctcaaagccgcagccgccaagccttgcttctcagcccgcgcggcggcccggatccccgccccttctcaccgtcctcgcccgcccgctggccgtcgcctgccgaccacggcggccgctctcgccgccgcagcccgccggttccggtggccttcggcggccgcgtcggcgcgggggctgtgcgccgcgccgcatttcggcggagaggggatgggatctgatgcgggggcggggggcaggaagaggcgggtgccagcggtgaacgggctcgccaaggacgcgcctgcggtgaacgggatgcgcaaggaggagcccgtggccgcgcctcccaggttgctcacgctgcccactgtgctcaccattggccgcgtcgctgctgtgcctcttctgatcagcactttctacatggagggtccatgggcagctatggccacaacaggcatcttccttgctgccgcagtcactgattggctagatggttatattgctagaaagatgcagctaggaacaccttttggtgcatttcttgatcctgtggccgacaagcttatggtagcggcaacattagttttgctatgcaccaaacctttggaatcatcactgctcaatgatgggccatggcttctaacagtcccttccattgccatcattggaagagagattacaatgtcagctgtgagagagtgggctgcatctcagaatagcaaagttcttgaggctgttgcagttaacaacttagggaagtggaagacagcgacgcagatgacagcattgactctgcttctcgcaagcagagacccaagtctacctgcgcaaggcgctctagttgcccccggtgttgctctactttacgtctccacgggactcgccgtatggtccctagtggtgtacatgagaaagatatggcgtatactgctaaaatagtattagcacaatatatatatagtgtaatagaagaaacaagcaaggcgagcatccgttcgtgatcgtacaacttttggaaggctgtttagttgattgggtggcctgagccctagagctggttgggatcctcattcctctgtaacttgtgcgtcagtttttggtggatttgccgctaaatttgctgaggcatgccaggatcctattagatttttagaaacaagacatggtgtgaccctccgtgcgtaatgagaattcttagaaacaagaagacatggtgtgaccctgcgtgcgtaatgagatataagtctgcggacgcagaagattgtaaccttatacaaacacaacctggaggtttctgcgtgtggagttctaccgttgtactctacacataatatcataatataccaggagcgtacagaaaaaaaaaaaaaaaaa

SEQ ID NO: 75703 - protein, 318 aa, Zea mays
  misc_feature: Ceres CLONE 1560172
  misc_feature (157)..(307): Pfam Name: CDP-OH_P_transf Pfam Description: CDP-alcohol phosphatidyltransferase
  misc_feature: SWISSPROT Homolog: EC 2.7.8.5 CDP-diacylglycerol--glycerol-3-phosphate 3-phosphatidyltransferase
MPTSVATHASLLLKAAAAKPCFSARAAARIPAPSHRPRPPAGRRLPTTAAALAAAARRFRWPSAAASARGLCAAPHFGGEGMGSDAGAGGRKRRVPAVNGLAKDAPAVNGMRKEEPVAAPPRLLTLPTVLTIGRVAAVPLLISTFYMEGPWAAMATTGIFLAAAVTDWLDGYIARKMQLGTPFGAFLDPVADKLMVAATLVLLCTKPLESSLLNDGPWLLTVPSIAIIGREITMSAVREWAASQNSKVLEAVAVNNLGKWKTATQMTALTLLLASRDPSLPAQGALVAPGVALLYVSTGLAVWSLVVYMRKIWRILLK

SEQ ID NO: 75704 - DNA, 846 bp, Zea mays
  misc_feature: Ceres CLONE 1560178
  misc_feature: Translation starting site: 144
  misc_feature (621)..(621): n is a, c, t, g, unknown, or other
  misc_feature (810)..(810): n is a, c, t, g, unknown, or other
ccccgcggtggcggccgctctagaactagtggatcccccgggctgcaggaattcgtctcacccctagaaaaagccgcctcctccccactgcctcgtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatcctcaagcagcgcctcaaggtaccaccggcgctcaaccagttcacccgcaccctcgacaagaacctcgctacgaacctgtttaagatgcttctcaagtaccggcctgaagacaaggctgccaagaaggagaggcttctgaagagggcccaagctgagaatgaaggaaaaaactgttgagtcgaagaaaccaatttgttgtgaagtatgggccttaaccatgtgacttacctcattgagcagaacaggctcagcttgttgtcatcgctcacgacgtggatccgatcgaacttgnttgtgtggcttcccgccctgtgcaggaggatggaggtccctttactgcatggtaaaggaaggcttcgcccttggatcgattgttcacagaagaatgcatccgtctttgtgtctggaccctgtccagaaccagaaaaaccttgagttcagcaaggatctggaagcttttaaggcaactttcacgacaaanttcatgaggtcagaaaaaaatggggaagggggcctt

SEQ ID NO: 75705 - DNA, 862 bp, Zea mays
  misc_feature: Ceres CLONE 1560179
  misc_feature: Encodes the peptide sequence at SEQ ID NO. 75706
  misc_feature (760)..(760): n is a, c, t, g, unknown, or other
agctccccgcggtggcggccgctctagaactagtggatcccccgggctgcaggaattcgtctcacccctagaaaaaattgcctatcaaccgctactcacggcgtactgtctgatcggcaacacctcgtgtacacgtaggcccggagatatggcatcgccggtggccatcggcacggcggtgttccagcgggggccgctccacgtggaggcgaggcacgtccactacaaccaggaccccagcgtgcccaagccgctcatggtggtcgcccccaccgacgccggcgtgtaccccgtggccgtcttcctgcacggctgcaacacggtcaacagctggtatgagagcctcctgtcgcacgtcgcgtcccacgggttcatcggcgtggcgccccagctctactgcgtgacgctcaacatgaaccacttgaaggacatcgacgccacacaggcatgtcaccgcctggatcgcccacaagaagcaaggcctggagcacgtgctcgccaacatcctccagctccacggcgtgaggccggacctctccaggctggcgctggctcggccacagccgcggaggcgacaccgccttcgccgtgtcactcgggctctgacccgccgcctcggacgacgacgacaacaacgcatacgcaggcacatcgcacggcggcgttgccactcaagttctacacgctgatcgtgcgtggacttcgtggcggggctatccaaccatgctgcagtgtgagcctaatgtgctgaacgtacagncctcggtccctcaaccacgtgatgcctgactcatgtacacctgcacggagctcggccaccagcacaggaaacaagtccgccgtgcgcctatccgcgggactt

SEQ ID NO: 75706 - protein, 200 aa, Zea mays
  misc_feature: Ceres CLONE 1560179
  misc_feature (3)..(189): Pfam Name: Chlorophyllase Pfam Description: Chlorophyllase
  misc_feature: SWISSPROT Homolog: EC 3.1.1.14 Chlorophyllase
MASPVAIGTAVFQRGPLHVEARHVHYNQDPSVPKPLMVVAPTDAGVYPVAVFLHGCNTVNSWYESLLSHVASHGFIGVAPQLYCVTLNMNHLKDIDATQACHRLDRPQEARPGARARQHPPAPRREAGPLQAGAGSATAAEATPPSPCHSGSDPPPRTTTTTTHTQAHRTAALPLKFYTLIVRGLRGGAIQPCCSVSLMC

SEQ ID NO: 75707 - DNA, 865 bp, Zea mays
  misc_feature: Ceres CLONE 1560182
  misc_feature: Encodes the peptide sequence at SEQ ID NO. 75708
  misc_feature (641)..(641): n is a, c, t, g, unknown, or other
  misc_feature (800)..(800): n is a, c, t, g, unknown, or other
  misc_feature (833)..(833): n is a, c, t, g, unknown, or other
ctggagctccccgcggtggcggccgctctagaactagtggatcccccgggctgcaggaattcgtctcacccctagaaaaatggaagcagctatgaaagaaatgccccttgaactctttctacaaattgttgggtcagcaaagaagattgataacatgataacgttgtgtaggcttggaaaaacactttcagaaatacctacagaggaatacaatcagatcttggatactcatgccaatggccgactctcacgtttagtaaatattttggacaagctcaagctggttcagcttgcaaaagaattcttagaagatgctggtgtatcgtcaaatgccatgtatacacattcgatggagctcaggccttacatcgaagaacccatgccaagaattcttccatcttcccaactgaacaatcatcggaaaattcggcatgattttgtactttcaaagaaagagtttgttgattcttattgggaaacactagagtgttgttatttaacagctggtttggctgacccgttaagtgccttccctggcagttctgtcccggaggtttctcatcgtcgttcatggtgttcacttagagtcatgactactgaacaacgactggagttgcaacagcgtattatggatgttggtngagaaggggaaaattccttttaaagactgtgttagaatagcaagagaactgaatctttctgtagagcaggtacttcgcctttcatatgaaaggcaatctcggctccatgaacagcccagctttacttctaacaaaagcagcaaagagttggttcttggnatgactcctgtgagaagaaaagagacgtgccgnatgggaccagcctgaagcttctgaaacgtaca

SEQ ID NO: 75708 - protein, 194 aa, Zea mays
  misc_feature: Ceres CLONE 1560182
  misc_feature (188)..(188): Xaa is any aa, unknown, or other
MEAAMKEMPLELFLQIVGSAKKIDNMITLCRLGKTLSEIPTEEYNQILDTHANGRLSRLVNILDKLKLVQLAKEFLEDAGVSSNAMYTHSMELRPYIEEPMPRILPSSQLNNHRKIRHDFVLSKKEFVDSYWETLECCYLTAGLADPLSAFPGSSVPEVSHRRSWCSLRVMTTEQRLELQQRIMDVGXEGENSF

SEQ ID NO: 75709 - DNA, 905 bp, Zea mays
  misc_feature: Ceres CLONE 1560183
  misc_feature: Encodes the peptide sequence at SEQ ID NO. 75710
  misc_feature (417)..(417): n is a, c, t, g, unknown, or other
  misc_feature (568)..(568): n is a, c, t, g, unknown, or other
  misc_feature (576)..(576): n is a, c, t, g, unknown, or other
aagctggagctccccgcggtggcggccgctctagaactagtggatcccccgggctgcaggaattcgtctcacccctagaaaaagctttcccttcacgcacgcacgcacgcacgctcgccaagagcaaaggcggccggacggggggcggcgggggcggggcagagcggagcggagcggtttgtctccacgcctgacgtctccctcttccccgctgtccgcagcttcggtgcttccttctcccgttcaggaccattgtgtttactgaagcagcttagttcatgttcctgtcatgggtatggaacatttcatcagttctgcaaacctttcagcaggtttcacatcgtatggaaatgaagcagcagaggatatgacaaaactacgaggtctaagattggaaacactgatggacacctgccnaaacacagaaagcagagatgtagcgatcaggtgtccaataccatgcaaaagcagcaagcggtatacggaacatgacttgagagctgcacaagatctttctgacttcattgtgaggtaaggcttcacctccctacttttaggggattctcanccacttcnttgcaccaaatcctcttgctcatgatgcccaaattctgggcgtgggaaagggcccccgcttaaattagtccctagggaatttccttaacccccccaaaaagtaccagggtcccatacatggcggggaaaaaatcttttggggaaggcttgaaactcctttttttcaaagatcaagaacccccggggatgcaaaaacctatttccccctttcttcaaagaggttaaaatggttttcaccataaagaggggggggcccccttttgaggggggggggggtgcttttttgggggggttgagagacccccccccccggggggggaaaaattttt

SEQ ID NO: 75710 - protein, 81 aa, Zea mays
  misc_feature: Ceres CLONE 1560183
  misc_feature (43)..(43): Xaa is any aa, unknown, or other
MGMEHFISSANLSAGFTSYGNEAAEDMTKLRGLRLETLMDTCXNTESRDVAIRCPIPCKSSKRYTEHDLRAAQDLSDFIVR

SEQ ID NO: 75711 - DNA, 650 bp, Zea mays
  misc_feature: Ceres CLONE 1560184
  misc_feature: Encodes the peptide sequence at SEQ ID NO. 75712
  misc_feature (311)..(311): n is a, c, t, g, unknown, or other
ctggagctccccgcggtggcggccgctctagaactagtggatcccccgggctgcaggaattcgtctcacccctagaaaaaagctcaccgccacctccacgctcgaagctcctcccgaaccggccgcatcgtcgccatggcagccgccgcttctgcaagctccgtgaaggaagtgctgccgtctcccctgacctccgcctccgagccccctccccttttcgatggcaccaccaggttgtacgtggcctatctttgcccgttcgcgcagcgcgccttggattgctagaaaactaccagggtctgcagacagantagatgtgccatcattcgtgacaggccactgtacaggggaagttatccgaaacaggggcttcctaggaccaaaccgggtaaaggaaagctggaattggtaagaccttgacgaactttaaggggcttctttccccccagaatctggaaaaaaaatttccttagaaagagcccgggaacccggggggtttcaaaaagatttttcccccgtttccccccgggaaaaatttttttagaaaacccttttttctttttaaaaaaaaaaaacccccccgggaaaaataaaaaagggggccttttttttttgggggaaaaaaaagggggggggtttcttttttaacc

SEQ ID NO: 75712 - protein, 49 aa, Zea mays
  misc_feature: Ceres CLONE 1560184
MAAAASASSVKEVLPSPLTSASEPPPLFDGTTRLYVAYLCPFAQRALDC

SEQ ID NO: 75713 - DNA, 859 bp, Zea mays
  misc_feature: Ceres CLONE 1560185
  misc_feature: Encodes the peptide sequence at SEQ ID NO. 75714
  misc_feature (554)..(554): n is a, c, t, g, unknown, or other
  misc_feature (829)..(829): n is a, c, t, g, unknown, or other
  misc_feature (832)..(832): n is a, c, t, g, unknown, or other
aaagctggagctccccgcggtggcggccgctctagaactagtggatcccccgggctgcaggaattcgtctcacccctagaaaaaacagcaaatgcccaccagaaagcaagccatgggcaggaggatcaccaccaccacgctcctcgccgtggccgcttccgcgctctgcttctcatcctgctgcggcgtcgacgtcaacggcgcggcggacaccgtggccggctcgtgcgacgcgatccgcgacttcgtcgacgtggccttctgcgcgtcgcggctggggtccgtgccgggcgccgcctccgcggacctgcacggccacctcctgatggcggcggacctggcggccgcgagcggggtctcggcgcgtgacgccgcggcggggatggcgcggcgcgagggcgacggcgggcacccggccgcgcgggacgcgctggaggcgtgcggcatcctgtacggcgcggcgtccgtgcccgcgctgcgcctcatgcgcggctacgcggcggcgcgcgcctggggcgccgcgcgcgcgctgctgccgctcacgggccaggccngggatcgggtgcgacgccgcgctcacggggctccgcgccggccaaggccccggatgggccgcgccaaaccgcgagttcgacccagctctccaccatggccacggcgctcctcaataagctcgactagatccggcgccgcgctatggcactcctgcgcccctccgtggcatactggcatgcgtactgcggtgacgatcatgtgggaactgatgtttcttgtgtcgggtcatagtgcatcaccactgatttcttgtttggggtgggtttggttgcgnccntagtaagctgtacaatgacaaatgccg

SEQ ID NO: 75714 - protein, 240 aa, Zea mays
  misc_feature: Ceres CLONE 1560185
  misc_feature (148)..(148): Xaa is any aa, unknown, or other
MGRRITTTTLLAVAASALCFSSCCGVDVNGAADTVAGSCDAIRDFVDVAFCASRLGSVPGAASADLHGHLLMAADLAAASGVSARDAAAGMARREGDGGHPAARDALEACGILYGAASVPALRLMRGYAAARAWGAARALLPLTGQAXDRVRRRAHGAPRRPRPRMGRAKPRVRPSSPPWPRRSSISSTRSGAALWHSCAPPWHTGMRTAVTIMWELMFLVSGHSASPLISCLGWVWLRP

SEQ ID NO: 75715 - DNA, 871 bp, Zea mays
  misc_feature: Ceres CLONE 1560186
  misc_feature: Encodes the peptide sequence at SEQ ID NO. 75716
  misc_feature (718)..(718): n is a, c, t, g, unknown, or other
  misc_feature (779)..(779): n is a, c, t, g, unknown, or other
  misc_feature (871)..(871): n is a, c, t, g, unknown, or other
caaagctggagctccccgcggtggcggccgctctagaactagtggatcccccgggctgcaggaattcgtctcacccctagaaaaagtcgtgttcgtcctgcccaactgcccgctgaaaaacaaactcacccaacaaagtgacctgaaactgggagcaagcaaccgagggcgagagccatggcgaagcctcgcggcggcggcggcctcctggacttagaggggcactacgccttctacggcgcctaccacagcaaccccgtcaacgtgggcatccacgagctcttcgtctggcccatcttcctcaccgcgctcatgctcctccacctcaccgccccctccacgcacgccgccggcatcagcgccgcggtctacgcggcctactacttcctcctcgaccgccgcgcgggcgcgctcgccgccctcttctgctacctctgctgggccgccagcggcgccctctctgcccgcctcggtttctctgttggatggaaggtaagggccgggggaaacggcggtctttcgcatcgagccttgacctagctcgtcgtgatggcttatatgatgtcttctgtgcttggatttctatgtatttgtatcatgttcgtatgatcggctacagttggtaatttggtatcgtttctcgagtacctgtgtcttagattttggtatccacgacccacgggggaaaattgttagtccatctgatgaagcgaagatnacaaaatttcagatgagcttcatcccttagttggtatatttagtgatgcttatcaggtggntacatatttctagtcgccccgtaagtacaatttgggattaccacgcttttattggtgcaatagggatttcaggaacagaccagtgcagccgn

SEQ ID NO: 75716 - protein, 120 aa, Zea mays
  misc_feature: Ceres CLONE 1560186
  misc_feature (10)..(119): Pfam Name: DUF962 Pfam Description: Protein of unknown function (DUF962)
MAKPRGGGGLLDLEGHYAFYGAYHSNPVNVGIHELFVWPIFLTALMLLHLTAPSTHAAGISAAVYAAYYFLLDRRAGALAALFCYLCWAASGALSARLGFSVGWKVRAGGNGGLSHRALT

SEQ ID NO: 75717 - DNA, 856 bp, Zea mays
  misc_feature: Ceres CLONE 1560187
  misc_feature: Encodes the peptide sequence at SEQ ID NO. 75718
  misc_feature (663)..(663): n is a, c, t, g, unknown, or other
  misc_feature (756)..(756): n is a, c, t, g, unknown, or other
  misc_feature (774)..(774): n is a, c, t, g, unknown, or other
ctggagctccccgcggtggcggccgctctagaactagtggatcccccgggctgcaggaattcgtctcacccctagaaaaaaagagctaagagggaagaacaatcgagctactaataaggtcgtatacatatcttctatatactcctctgaaagttgtgaactccggtcgagcttaaaaacagcagcaatggcgaagctttggacattgctgctggctgcagtggtggtcctctcactcctagtgagccccattgcttgcacccgaaagctcaacaaacccaagccgaagccgggcagctacaggcggccggtcaagccgaagccaaaaccggtcacgggcagctacaagccggcgcctgtggccgccagaagaaaccacacagctacacccacgccatcgccgactgtctacggccccggtggctggctgtcaggcgccggcgccacgtactacggcgcgaccaacggcgacgggagcgacggcggcgcgtgcggctaccagacggccgtcggaaagaagccattcgactcgatgatcgccgccgggagcacgccactgtacaggggaggcgagggctgcggcgcctgctacgaggtgaaatgcacgaacaacgccgcgtgctccggccagcccgtgaccatcgtaatcaccgaccagtcccntggcgggctgttccccggcgaggtcgagcactttgacatgagcggcaccgccatgggcgccatggcccggcccggcatggccgacaagctcgncgctgggcgcgtgctcangatcttgtacaggagggtgccgtgcaagtacaccgcgttcacatcggtttcaggtggatcaggcgcggaccgttactactcc

SEQ ID NO: 75718 - protein, 223 aa, Zea mays
  misc_feature: Ceres CLONE 1560187
  misc_feature (117)..(199): Pfam Name: DPBB_1 Pfam Description: Rare lipoprotein A (RlpA)-like double-psi beta-barrel
  misc_feature (159)..(159): Xaa is any aa, unknown, or other
  misc_feature (190)..(190): Xaa is any aa, unknown, or other
  misc_feature (196)..(196): Xaa is any aa, unknown, or other
MAKLWTLLLAAVVVLSLLVSPIACTRKLNKPKPKPGSYRRPVKPKPKPVTGSYKPAPVAARRNHTATPTPSPTVYGPGGWLSGAGATYYGATNGDGSDGGACGYQTAVGKKPFDSMIAAGSTPLYRGGEGCGACYEVKCTNNAACSGQPVTIVITDQSXGGLFPGEVEHFDMSGTAMGAMARPGMADKLXAGRVLXILYRRVPCKYTAFTSVSGGSGADRYYS

SEQ ID NO: 75719 - DNA, 869 bp, Zea mays
  misc_feature: Ceres CLONE 1560188
  misc_feature: Encodes the peptide sequence at SEQ ID NO. 75720
  misc_feature (541)..(541): n is a, c, t, g, unknown, or other
aaagctggagctccccgcggtggcggccgctctagaactagtggatcccccgggctgcaggaattcgtctcacccctagaaaaaagaaccgtctccaatggcgctactccgagcgctccggcgagcccttccggcgctctcctcgccggcggcggttctcccccgtcgcgccccgcacccactacctcctccgcccgctcctcgtcggttcctggacccgatcgggctccgctccttctccgccgccgccgccaccgcgtcgcaggcgccgcccatgggggccaccctgttcggcgggctcatggacacccggttcccgaagcgccggccgggcttcgccaaccgccggaagagggctagcttgcgccccaaaggtccgtactactgggtgaagtgcaagcctgacgagcccataccagttagtcagccgaaccaagggagcgtacgagggaggaaggagaagaagcggatcaagcagcgcaaggactttatcatggctgagaagaagaagcgcagagctcagtattctgctgctgttaanagaaaggagcagaacgaacagaaaggaagatggctgctgtggcaagagagcgggcatgggcagcagggtgatagagctaaaacagattgaggaaagagttaaagctgtaatgccataagggcctgctcctgaaaaaatgcaaggcgtcaaacccggttctgggggcccaatttccccctcctttggtccaaccaagtttaagatgggcacaatttctttgggaaggaaatggaaaacacccttcccctttctttaaaaagaaaaatatcaaaagcccgaaaacgttttttttaaaaccaaactctccataaaaccccgtttggggatt

SEQ ID NO: 75720 - protein, 177 aa, Zea mays
  misc_feature: Ceres CLONE 1560188
  misc_feature (148)..(148): Xaa is any aa, unknown, or other
MALLRALRRALPALSSPAAVLPRRAPHPLPPPPAPRRFLDPIGLRSFSAAAATASQAPPMGATLFGGLMDTRFPKRRPGFANRRKRASLRPKGPYYWVKCKPDEPIPVSQPNQGSVRGRKEKKRIKQRKDFIMAEKKKRRAQYSAAVXRKEQNEQKGRWLLWQESGHGQQGDRAKTD

SEQ ID NO: 75721 - DNA, 807 bp, Zea mays
  misc_feature: Ceres CLONE 1560189
  misc_feature (20)..(20): n is a, c, t, g, unknown, or other
  misc_feature (24)..(24): n is a, c, t, g, unknown, or other
  misc_feature (27)..(27): n is a, c, t, g, unknown, or other
  misc_feature (28)..(28): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (52)..(52): n is a, c, t, g, unknown, or other
  misc_feature (198)..(198): n is a, c, t, g, unknown, or other
  misc_feature (204)..(204): n is a, c, t, g, unknown, or other
  misc_feature (216)..(216): n is a, c, t, g, unknown, or other
  misc_feature (221)..(221): n is a, c, t, g, unknown, or other
  misc_feature (224)..(224): n is a, c, t, g, unknown, or other
  misc_feature (663)..(663): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (765)..(765): n is a, c, t, g, unknown, or other
aaagctgggagctccaccgncggntgnngcggccgncnntctagaaactagntgggaaatcccccgggctgcaggaattcgtctcacccctagaaaaactcacctcgacgcgcctccaaaagttcggagccgccggcccgtccgcctccctctccgccctccgtccccaaggccaatagtttttcagtggcaatggcngaccangctaaccaaccnactgntcntcataagctcggtggccagttccacctgcgctcgatcatctcttaaaggtgacggggcccgtaactttggcccatctgtcctcatcttaggaaaggaaattgcccccaggaaattcctggacccaaaacctttttgggcccttccaatttctttttaacggggggaaacaaatttccccccgggatggggaaacccccccccttctggaaaaacccccccccaaaaaaaagggggcaaaaaacccctcagggaaaattttttggagggggggggggttttacaccccggttttttaaaaaaaaattgtttgttctctcccccagagggggggggggagggttttttttttttaaaaccccccgtggggggaatttttttttttgggggggggggggtttaaaaaaccccccccaagggggggggttttttttccccctncccctttaaaaaccccttttttgagggaggggggggggggtttttctttcccctctggggggggggggggggaaccccccccccccnnnntttttttttttnccccccccccccccccccgcccgccgtgagaaaatattattt

SEQ ID NO: 75722 - DNA, 877 bp, Zea mays
  misc_feature: Ceres CLONE 1560193
  misc_feature: Encodes the peptide sequence at SEQ ID NO. 75723
  misc_feature (437)..(437): n is a, c, t, g, unknown, or other
  misc_feature (461)..(461): n is a, c, t, g, unknown, or other
tggagctccccgcggtggcggccgctctagaactagtggatcccccgggctgcaggaattcgtctcacccctagaaaaaaccacggccaccaccgaggtcgggaccacagtgaccgcagccacctccgagatggaggccaccgcgaccgcagccacctccgagctggaggccaccgcgaccgcagccgccatcgggccgccttcagccatccccgataaatatatgcataaaaaccggttgcagtcatttgctgaacgaacatataagagaacgccaatctacaaggttgagtctgaaggccagtctcatcagcctaagttcacatgcacagtggaagtgggtgatcaacagttctcatcaactggtagttttagtcgtaagacggaagcagagcaggacgctgcgagagttgctaatgagatcttgacaccagttnagtgagagtgacgcttaagaggcnatttgagctaattgatcgggatgccgtttttctgcaaatcaatctcccatgaattttgctgtcaaaaaaaagaccactttggcccccttaccctggaaattgggggttggcctcaaaaaagcctttgaccccgtgtcccccccaattgggggggtttaaaggaaaagccattctctgggggaaactcgcccccccccaaaaaaaaaccccaaaaaaaagtggcccctcggggtttggaaaaaaagcctttttttccccaaccgggacccttttttgtgggggaaaaattttttttatcccaaaaaaaccctttatatggggggttggaaaattttttgggaaaaccccccccccctttttttttcccctccaaagagttttccccggcggctttttttattcccccacattgagga

SEQ ID NO: 75723 - protein, 102 aa, Zea mays
  misc_feature: Ceres CLONE 1560193
  misc_feature (33)..(99): Pfam Name: dsrm Pfam Description: Double-stranded RNA binding motif
  misc_feature: SWISSPROT Homolog: EC 3.1.26.3 Ribonuclease III
MEATATAATSELEATATAAAIGPPSAIPDKYMHKNRLQSFAERTYKRTPIYKVESEGQSHQPKFTCTVEVGDQQFSSTGSFSRKTEAEQDAARVANEILTPV

SEQ ID NO: 75724 - DNA, 850 bp, Zea mays
  misc_feature: Ceres CLONE 1560194
  misc_feature: Encodes the peptide sequence at SEQ ID NO. 75725
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (448)..(448): n is a, c, t, g, unknown, or other
  misc_feature (499)..(499): n is a, c, t, g, unknown, or other
  misc_feature (683)..(683): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaactggagctccccgcggtggcggccgctctagaactagtggatcccccgggctgcaggaattcgtctcacccctagaaaaagcatccatgcgacgatgatccatccatctcaaagcaagcagagacatggagtcgtcgtcgccgctgttgcagctgccggcggcacgcgtggaggctctgagcctcagcggcctctccgccatcccgcctgagtacgtccgccccgccgacgagcgagccggcctcggggacgccttcgacctggcgcgcacccatgccaacgaccacaacgcgccgaggnatccccgtcgtcgacatctcccccttcctcgacagcaagcagcccagcagncaatcccggtaaccaagtgccttgaaggccgtgcaacgcctcccgcctgactgggggcggtcaatgcacattcgacccggcccacggggattcccttggcccgaggttcatggggacggcctggggaggccccttcccccgtccaaggaaaaaggaagggctttattccaaaggaaaccccccnccggccggggccctcctgaaaggggttatcggggaaacccccctcttcggttggggcaaaaaagccctttaaggggaaaaacccccaaagggggggaaaaagaaaaaaccctctttttttcccaccccctggggggcgccccccccccccccacgggggtttcctcc

SEQ ID NO: 75725 - protein, 91 aa, Zea mays
  misc_feature: Ceres CLONE 1560194
  misc_feature: SWISSPROT Homolog: EC 1.14.11.19 Leucocyanidin oxygenase
  misc_feature (59)..(59): Xaa is any aa, unknown, or other
  misc_feature (76)..(76): Xaa is any aa, unknown, or other
MESSSPLLQLPAARVEALSLSGLSAIPPEYVRPADERAGLGDAFDLARTHANDHNAPRXPRRRHLPLPRQQAAQQXIPVTKCLEGRATPPA

SEQ ID NO: 75726 - DNA, 864 bp, Zea mays
  misc_feature: Ceres CLONE 1560195
  misc_feature: Encodes the peptide sequence at SEQ ID NO. 75727
  misc_feature (622)..(622): n is a, c, t, g, unknown, or other
ccccgcggtggcggccgctctagaactagtggatcccccgggctgcaggaattcgtctcacccctagaaaaaacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctaccgccagctcttccatcctgagcagctcatcagtggcaaggaggatgcagccaacaacttcgctcgtggtcactacaccattggccaagggagatgttgacctgtggcctgaccgcatcaggaaggcttgcaaataattgcactggtctccaggggcttcttcgtctttcaacgctgnttggtggaagaacggcctctgggcttggttcttcttctcttggaacgccctgtctggtgactattgccaagaagtccagcctcggtttccccgggaacccaatccccccggggtcccaatccgggggttgaaccaaaaaacagggtcctggcccacccatttcttcctgaaaaaaccttaattttcttgccctgtcccaaaaaagggcactttaaaaaaatccgcccccctcccttgaaatt

SEQ ID NO: 75727 - protein, 115 aa, Zea mays
  misc_feature: Ceres CLONE 1560195
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGQGRC

SEQ ID NO: 75728 - DNA, 860 bp, Zea mays
  misc_feature: Ceres CLONE 1560197
  misc_feature: Encodes the peptide sequence at SEQ ID NO. 75729
  misc_feature (745)..(745): n is a, c, t, g, unknown, or other
tggagctccccgcggtggcggccgctctagaactagtggatcccccgggctgcaggaattcgtctcacccctagaaaaagcgccgccacttccctcccgacccactatcccaaaaccgtagcgccctcgcctgctcgccgccgccgtcgttgcgagctccccatcttcctccgtcaaccatggcgacccagatcagcaagaagaagaagttcgtcagcgacggcgtgttctacgccgagctcaatgagatgctgacgcgggagctcgcggaggacggctactccggcgtggaggtgcgcgtcacaccgatgcgcacggagatcatcatccgcgccacgcgcacgcagaacgtgctcggcgagaagggccgcaggatcagggagctcacgtctgtcgtccagaagaggttcaacttccccgagaacggcgtcgagctctacgccgagaaggtcgtcaaccgcggtctctgcgccatcgcgcaggctgagtccctccgctacaagctcctcggaggccttgccgtccggagggcctgctatgggtgtcttcgctttgttatggagagtggtgctaggggtgtgaggtcattgtgagtggaagctcagggctcaagagcaaagtcatggaattcaggatggctacctgatctcatctggccagccaggggatgagtacatcactcacctgtgagaacgttcttccccaacggggggttctgggtttaaggggaaaattgtgctttggnccccccccagagggggaaggggtggcccaaatcccccctttttcggacgggggggacctcctttcccccaaaggagggagaaaaatttcccccctccgtttttggggacgagaag

SEQ ID NO: 75729 - protein, 137 aa, Zea mays
  misc_feature: Ceres CLONE 1560197
  misc_feature (45)..(102): Pfam Name: KH_2 Pfam Description: KH domain
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGCLRFVMESGARGVRSL

SEQ ID NO: 75730 - DNA, 868 bp, Zea mays
  misc_feature: Ceres CLONE 1560198
  misc_feature (738)..(738): n is a, c, t, g, unknown, or other
  misc_feature (748)..(748): n is a, c, t, g, unknown, or other
ctccccgcggtggcggccgctctagaactagtggatcccccgggctgcaggaattcgtctcacccctagaaaaagatccagccgcttcgggatctccctcctcatcaggcgctcgatagctcccacgaccgcacctccctccacagaccagcactaccatccaggatcgcagcaggagcgcgcgagacaggggtgagcaggtcaggccagatgagggagatcctgcacatccagggcggacagtggggtaaccagattggcgcccagttctgggaggtgatctgaggtcagcactgagtagactccacgggccgctactcggggacctactcgcagcaacacgagcacgagcggattcacctctactacaaccaggcaggaggaggaccctatgtaccccgcgccctgctcgtggaccgggagccccgcacagtggaatgactccgcgcccgcccctatcggggcatcttccgccacgacaactttgtctacaggcattcccgcgccgggaacaactgggtccatgtccactacaccgagggagccgagctcatgcgactccgtccattgacatcgtgcgcaatgaagcccagatctgctactgccttccaggggatctagaatgcgactccctgggtggcggcaactgatactggtatgagacgcgtactgattacgagatgtcgagaggataaacgggaacgctagaagctttgccttcctccggatacccacccncccaggggtnacgacacccttctagaagccttataacaaccagcctgttcgggtcccaatttgtggaaaatgccaaacaatttcaggtccttggaacacagagacctcatgggaaattgcttaaccaccc

SEQ ID NO: 75731 - DNA, 850 bp, Zea mays
  misc_feature: Ceres CLONE 1560199
  misc_feature: Translation starting site: 407
ctggagctccccgcggtggcggccgctctagaactagtggatcccccgggctgcaggaattcgtctcacccctctagaaaaagccaaacaccgagtgaaccacgccaccacaggcagtgagcgagcgcccaaagaaacgacgtagcagccaccaccaccaccaaccgcttcctccctttcccactccgccgcccgcctctttacgagaaccctcacctgaccgccgataagtacctagctccgaccgtcgctcctcgactccgtcttctctattcttcgatttagcggagatcctagaacctaggggcagccagccagggggaacgggccgcgatgggaggaaggggcgcgatgcatcgctgtggcgttggtggttcttgcggaggttggcgccacggcggaatccatggaggcggcagccaaggggaggtaccacgcgctcttaaactttggggactcgctaaccgacgctggcaacctcatccagaacggcaccgcggagatcctggtcaccgggagcctgcactacggcgagacctacttcggaagaggccacccgccgctgctccgacggacatctcgtcatcaaccacgtcgagcaagagttcggcctgccgctgctgccgccgtccaaggccaagaacgccagcttcgcgtacggcggcaagttactcatcgccggagccaccgcggtcgacacgccctacttcgaggccatgggctcggtgccgtcatctggcactccggagcgctaatgatccaaatccagtggttgcgtgatctcagactgttcttctgaagacacggcagcatgacataaatctttgcgactgcgctatactcgggagat

SEQ ID NO: 75732 - DNA, 856 bp, Zea mays
  misc_feature: Ceres CLONE 1560205
  misc_feature: Encodes the peptide sequence at SEQ ID NO. 75733
  misc_feature (800)..(800): n is a, c, t, g, unknown, or other
gagctccccgcggtggcggccgctctagaactagtggatcccccgggctgcaggaattcgtctcacccctagaaaaaacagccatcacacgcatactgcatacacaacgcagagcatcagaagcagctgcgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggcgagttccccggcgactacgggtgggacaccgcggggctgtcggcggacccggagaccttcgccaagaaccgcgagctggaggtgatccactgccgctgggccatgctcggcgcgctcgggtgcgtgttcccggagctgctcgcccgcaacggcgtcaagttcggcgaggcggtgtggttcaaggcgggctcccagatcttcagcgagggcgggctggactacctcggcaacccgagcctggtccacgcgcagagcatcctggccatctgggcgtgccaggtggtgctcatgggcgccgtcgagggggtacctgcgtcgccggcggcctgcttcggggaggtgggtcgacccgctgtaccctggcggcagcttcgaccctgctcgggctcgccgacgaacccgggaggcgttcgccgagctcaagggtgagggagatcaagaacggccngcctcgcccatgttctcatggttcggcttcttcgtgcaggctatcgtcaaccggca

SEQ ID NO: 75733 - protein, 212 aa, Zea mays
  misc_feature: Ceres CLONE 1560205
  misc_feature (63)..(189): Pfam Name: Chloroa_b-bind Pfam Description: Chlorophyll A-B binding protein
MAAATMAITSRALVGKPAAGTRDVFGEGRITMRKTAAKPKPAASGSPWYGADRVLYLGPLSGSPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGVPASPAACFGEVGRPAVPWRQLRPCSGSPTNPGGVRRAQG

SEQ ID NO: 75734 - DNA, 846 bp, Zea mays
  misc_feature: Ceres CLONE 1560206
  misc_feature: Encodes the peptide sequence at SEQ ID NO. 75735
  misc_feature (536)..(536): n is a, c, t, g, unknown, or other
ctccccgcggtggcggccgctctagaactagtggatcccccgggctgcaggaattcgtctcacccctagaaaaagcagcgggcggcaggtaagccaaccgaaaccgatggcgtcgggctccggcagcgggagcgacttctccgtggtcgtggtgggatccgacttcgcggtcgacgccggcgccgcgctcctcgcccccgccgaccacgaggtgtggcacgactgcctccccgtcctcgctgaggcggacgcctgcttctccgacctcgaggagcgccaggtcgtgcgcatccagggcacggatagggcaggccgaaccatcgtccgcgtcgtcggcaagtttttcccggctccagtaattgatggtgaacgtctgaagaagtatgtgttctacaaactgcgcaccgaattgcctgtgggtccattctgcattttgtacatccacagcaccgtacagtctgatgataacaaccctgggatgtcgatcttgaggcacatttatgaggagcttccaccgtgatacagggaaaggcttncagttttctacttcttgcatcctgggcttcgctccagactgggcaatcgcacacttggcaggctattttaaggtggagggttgtattgggaaatcaggtaatttagtcgacgggagttactctgggggggatttaaaaagagggagggtgaaattcccgaattttgttattgaactggaaaggggtctggggccccggcccccggactggattgggggataaaaaccaaacccccaacactttgggggaagttccggcggggggggaaccccccttggaaaaattggagaataagggccctcccaaaatt

SEQ ID NO: 75735 - protein, 137 aa, Zea mays
  misc_feature: Ceres CLONE 1560206
MASGSGSGSDFSVVVVGSDFAVDAGAALLAPADHEVWHDCLPVLAEADACFSDLEERQVVRIQGTDRAGRTIVRVVGKFFPAPVIDGERLKKYVFYKLRTELPVGPFCILYIHSTVQSDDNNPGMSILRHIYEELPP

SEQ ID NO: 75736 - DNA, 918 bp, Zea mays
  misc_feature: Ceres CLONE 1560207
  misc_feature: Translation starting site: 546
  misc_feature (834)..(834): n is a, c, t, g, unknown, or other
  misc_feature (895)..(895): n is a, c, t, g, unknown, or other
ctggagctccccgcggtggcggccgctctagaactagtggatcccccgggctgcaggaattcgtctcacccctagaaaaactcccggcaactccgcaccccagaggccacaactgccaacaagccaatggctctcgtccgccagcgccgccagctgccgcaccttaccatcccgctggacaacttcgccctgcgcttgccaccgcagcctacaacccaccgccgcgccatccacctccacgtccgacgcccgcctcatccgactactagaggctctccgtactcggccacggcaacgcgcggcaccgtgtacaaggcgcggcaccgccagtccgcgcagccggtcgcactcaagctattctcggacagggacacctcagcggctcacgaggccgagatactgatgctcgccgcggacgcgccccacgtcgtgcgcctacacgcggtgatttcctcggccgccggggaggctcccgcggcgctggcgctggagctcatgcccgaggggctccctgtagggcctgctgcaccagctggaccggccgcatgggggagcgcctcatcgctcccgtggtgcggcaggcactcctcaggctcgccgctgtccaggcactccgcgtcgtgcaccgcgacctgaagatcacgtacctgctcgtctgcgcctatcgctgaggtgaatatcaccgacttacggcgctgacaagctgatgctgcgactgcatggatccatgctcgtccaacagtcggcacggcagtgtacatggtcccccgagcagatccgactccgacgcgctacatgggcatactagtacccctactcccgtcggacgattgnaagcatcagtggtagtccatcaatgtagctgggacctgggagccacttccctgcttcaaanccttctggtccaagcctcaagaa

SEQ ID NO: 75737 - DNA, 752 bp, Zea mays
  misc_feature: Ceres CLONE 1560208
  misc_feature: Encodes the peptide sequence at SEQ ID NO. 75738
tggagctccccgcggtggcggccgctctagaactagtggatcccccgggctgcaggaattcgtctcacccctagaaaaaatccccctcgcacacgtttccgcctcccgatccataggcggcgtgagccgccgccgacatagctcctccctctcgcagctctccagctctcggaggcccgcggctcatcaacccgcgcttcttcattctcgacatctcacccgggggagcggacgcgcagtgcacatcacgagccgcacggcacagccgctcttgttttccttcgtgggttgcggttcgacgcggccacgggatggcggcgagcgctcgggacagcgctgatgcggaggagcgagtcgtggatgaccaccacggctgggcgtccgacggccagatgggcatgcagatggatgtggaaggcgagttccacgaccgcgatgccgaccggagggatggcggcatggatgggtgatgatgagtatttgctgctcactaggataagggacacatcagcagctgaagccagggcaggaaaagatatacaaggtaaaccctggggaaaaggatacaacatagcccgggcaaggactacccaaaaagctaaggttggaaccaattttacgaactttttgcaaaaattttccccccaaatcaggggagaagcctctgggggggaaaaaaagttgttggccccaaaacaaaaggggggaaaaaaaaaaaaaccccccgggggttttttttcggaaatgttttc

SEQ ID NO: 75738 - protein, 52 aa, Zea mays
  misc_feature: Ceres CLONE 1560208
MAASARDSADAEERVVDDHHGWASDGQMGMQMDVEGEFHDRDADRRDGGMDG

SEQ ID NO: 75739 - DNA, 865 bp, Zea mays
  misc_feature: Ceres CLONE 1560209
  misc_feature: Encodes the peptide sequence at SEQ ID NO. 75740
  misc_feature (688)..(688): n is a, c, t, g, unknown, or other
  misc_feature (689)..(689): n is a, c, t, g, unknown, or other
gctggagctccccgcggtggcggccgctctagaactagtggatcccccgggctgcaggaattcgtctcacccctagaaaaactcttcttcgcgtcggcgccgccctcctcccttctcttctgctgctgatggaactggatcctcgcctctacgagaacgtctctgtcagcgacaacgatgtccgaaacatagttctatcttatcttatgcacaactgttttaaagggacggcagaggcattcctatctagcactgggttgaatttacctgtcgactatagtgtggatgtggataagcgtaaagcaatttttaattttgtgctagaagggaatgcccttaaagccatagagctgacagaagaaatggcacctaacttgctagagaatgatatggatctacattttgatcttcttagtctccacttcattgagctagttcgctcaaaaaaattcacagaagctcttgactttggccagaaaaaattgacatcatttcagaaggttaccaagtatattgagaaactagaggactttatggccctcctggcttatgaagagcctgagaagtcacctatgtttcatctactaagcccagagcacaggcagaatgttgcagagggcttgaatcgggctgtccttgcacatgctaatcttccagcatattcatcgttgggagagggtggtccagnncagcgactgtggttagacaatacctacagcaggaagttggcaaggattcttaccccacatttttcttttgaggcctttctgaggcagtaaatgtgcaaatggtcacttctttcagaacagggtaccacctctccaggccatcatgtacatgtaacccttgtgtagtgcatacccca

SEQ ID NO: 75740 - protein, 216 aa, Zea mays
  misc_feature: Ceres CLONE 1560209
  misc_feature (187)..(187): Xaa is any aa, unknown, or other
MELDPRLYENVSVSDNDVRNIVLSYLMHNCFKGTAEAFLSSTGLNLPVDYSVDVDKRKAIFNFVLEGNALKAIELTEEMAPNLLENDMDLHFDLLSLHFIELVRSKKFTEALDFGQKKLTSFQKVTKYIEKLEDFMALLAYEEPEKSPMFHLLSPEHRQNVAEGLNRAVLAHANLPAYSSLGEGGPXQRLWLDNTYSRKLARILTPHFSFEAFLRQ

SEQ ID NO: 75741 - DNA, 860 bp, Zea mays
  misc_feature: Ceres CLONE 1560212
  misc_feature: Encodes the peptide sequence at SEQ ID NO. 75742
  misc_feature (216)..(216): n is a, c, t, g, unknown, or other
agctccccgcggtggcggccgctctagaactagtggatcccccgggctgcaggaattcgtctcacccctagaaaaaatccgcaagcctgtggacgcgagtgagtgaacaccagccgtattgtcccgaccccgaccgatcctcgcctgctgcagccatggcgacctccgcggcgctctctaccgccgccaatcccacccagctctgccggtcccgcngcttcgctgggcaagccggtgaaggggcttggcctgagcatgggccgcgagcgccccagcggagcattgtgtgcaggcggcgagcagcatctccgccgaccgcgccccgacatggagaagcggaagctgatgaacctcctcctcctcggcgccatctcgttgcccaccgtcggcatggtcgtcccctacggcgcccttcttcgtccctgccggctccagggaacgcccggcggcgggacctacgcgaaagacaagctggggcacgacatcacggtggaagcgtggcttcaacacgcaaggttcccaaacgacggcacgcttcgtgcagggggctcaagggttgacccccacgtaacctgggtggtggaacaggaacaagaccctgggccactaacggggatccaccccctgggggcatccccacttggggttgcgctcggtgccctgggaaaccgcgccccaaaaaaaaagttttattctggccctttcccccgggtaccccaaattaaaaaaaaccaggggaaaagggggtgtccccggggaacccgggccccctttttttccctggggcccccgggttttcccgccccaaaaattttaaaaaaaggggggggggggcctcctttttttccccccccgggggg

SEQ ID NO: 75742 - protein, 201 aa, Zea mays
  misc_feature: Ceres CLONE 1560212
  misc_feature (22)..(58): Pfam Name: CytB6-F_Fe-S Pfam Description: Cytochrome B6-F complex Fe-S subunit
  misc_feature: SWISSPROT Homolog: EC 1.10.99.1 Plastoquinol--plastocyanin reductase
MGRERPSGALCAGGEQHLRRPRPDMEKRKLMNLLLLGAISLPTVGMVVPYGALLRPCRLQGTPGGGTYAKDKLGHDITVEAWLQHARFPNDGTLRAGGSRVDPHVTWVVEQEQDPGPLTGIHPLGASPLGVALGALGNRAPKKKFYSGPFPRVPQIKKNQGKRGCPRGTRAPFFSLGPPGFPAPKILKKGGGGPPFFPPPG

SEQ ID NO: 75743 - DNA, 876 bp, Zea mays
  misc_feature: Ceres CLONE 1560213
aaagctggagctccccgcggtggcggccgctctagaactagtggatcccccgggctgcaggaattcgtctcacccctagaaaaatccactcgctcgctgaccccgatgactgaacgcctcccttctgctcccgtgcctgacggatccttgcgggctgccccaaagcgctcgttcgctgggttgtttcccgcggccagagacaaccccttataccatgccggaccttctctctgacgaccgagtcagcgacttggacggagccttgggcctcatcgatcaggacggagactgtttgcttcacgcccgaggacacttgtaactgtcatgcgttcactgagatagagccccgcagacgctgaacatctccgtactgatcgatgatgctgatggcgaccggaatgccacgatgtacttcacggagtattttaacgtcatggctcgctcgagtgacgacagcgactccaagtacgagcatcgaggagcgtggtcaagacgttccacaaggaccagagggtcttcatctctgccgcggagatccgccacgtgatgaccaagctaaaggatgacctgacctacgagaaggtcgacgaggacatccgctagtccaactttgatagcgatggccagatcaactacgaggagttcgtcgaggtcatgatcggcaactgagtacagcctgcctgcacggactactatcccactccgaggaggagaccgtgcggtccatataactaagcactgcctgcagcctggtttgcttcatttcgaaacagccggctgctgtatctgctgacgtagacgacttcagtgcgcccttactccgtggacgctgacgtcatgctacccgtgtgatctgtcggattttgggtctgaaag

SEQ ID NO: 75744 - DNA, 858 bp, Zea mays
  misc_feature: Ceres CLONE 1560214
  misc_feature: Encodes the peptide sequence at SEQ ID NO. 75745
  misc_feature (695)..(695): n is a, c, t, g, unknown, or other
  misc_feature (699)..(699): n is a, c, t, g, unknown, or other
ctggagctccccgcggtggcggccgctctagaactagtggatcccccgggctgcaggaattcgtctcacccctagaaaaagaaaaagccgcggcaccggcactacgagtgcttcgctaccagccagccagcacactctacgagtcgccatcttccactccaccgaggcagctccaagccatggccatggagaaggccgcctccttcctctcctccctcttaggcggcggcggcggggagccggcggcgactgtgaaatctatcttcatataccctatcaagtcctgcaggggtcttgccgtgtcacaggcgcccatcacctccactgggttccggtgggatcggcagtgggtggtggtgaacgccaaagggcgagcatacacccagagggtggagcccaagcttgctctggtccaggtggagttgccgccggaggccttcgctgagaactggcagcccacgcccgacgaccacctggttatcagagcacccggaatggacacactgaagatacctctaataacggaacacaccacaatcgatgatgtctctgtctgggagtggtctggctctgcgtatgatgaaggggctgaagcgtctgaatggttctccacttactttgggaagccaagtcgactagtgcgcttcaaagaagcatcggaaactaggccaaccgatccagattatgcccaaggntatnaaatcatgttcaccgagtgcttcccatttctgatagctcctcaggggtcctggatgcactaatgagattctaaagacctgtaccaatgaccgcttcaaccaataattttaggggatggatgccaccattactacaaggacctgtggaaaaccataaaaa

SEQ ID NO: 75745 - protein, 191 aa, Zea mays
  misc_feature: Ceres CLONE 1560214
  misc_feature (20)..(148): Pfam Name: MOSC_N Pfam Description: MOSC N-terminal beta barrel domain
  misc_feature (172)..(172): Xaa is any aa, unknown, or other
MEKAASFLSSLLGGGGGEPAATVKSIFIYPIKSCRGLAVSQAPITSTGFRWDRQWVVVNAKGRAYTQRVEPKLALVQVELPPEAFAENWQPTPDDHLVIRAPGMDTLKIPLITEHTTIDDVSVWEWSGSAYDEGAEASEWFSTYFGKPSRLVRFKEASETRPTDPDYAQGYXIMFTECFPFLIAPQGSWMH

SEQ ID NO: 75746 - DNA, 842 bp, Zea mays
  misc_feature: Ceres CLONE 1560216
  misc_feature: Translation starting site: 603
ggagctccccgcggtggcggccgctctagaactagtggatcccccgggctgcaggaattcgtctcacccctagaaaaaagcgctcagctctagcaatggctgcctccaccattggcgatctcctcaacagcgatggccggaacccccatcaaggtgggctccttcggtgagggtcgcatcaccatgcgcaagaccgtgggcaagcccaaagtggcagcgtccggcagcccctggtacggccccgaccgcgttaagtacctcggccccttctccggcgagcccccgagctacctcaccggcgagttccccggcgactacggctgggacaccggctggctgtccgccgaccccgagaccttcgccaagaaccgcgagctggaggtgatccactcccgctgggccatgctcgagcgcgctctgctgcgtcttccccgagctgctctcccgcaacggcgtcaagttcggcgaggacgtctggttcaaggccggctcccagatcttcagcgagggcgggctggactaccttggcaaccccagcctgatccacgcgcagagcatcctcgccatctgggcctgccaggtcgtgctcatgggcgccgtccatggctaccgtattgccggcgggtcgcttcggcgaggtcatcgacccgctgtaccctggctgcagcttcgaccccctcggcctggccgacgacgtcgaggacttcttcgagctcaagctgaaggagctcaagaacggctgcctccactgttttccatgttcagctacatgtgcatgtcatcgtcacacgcaggagccggtcgagaactcgctgacacatgggttatccatcacatcacga

SEQ ID NO: 75747 - DNA, 850 bp, Zea mays
  misc_feature: Ceres CLONE 1560217
  misc_feature: Encodes the peptide sequence at SEQ ID NO. 75748
  misc_feature (583)..(583): n is a, c, t, g, unknown, or other
  misc_feature (634)..(634): n is a, c, t, g, unknown, or other
  misc_feature (747)..(747): n is a, c, t, g, unknown, or other
ctggagctccccgcggtggcggccgctctagaactagtggatcccccgggctgcaggaattcgtctcacccctagaaaaaacggtcaccaagtcctctccggatggcaaggtcttgtgaccttccgccggggcggcaagcataggctcttctcctggcaagcgcgcttgctctgctcgaggtgcagctgccgccatgcacagcccactagtagcaccggcctccgtcgccgggatactaccccagcggcatgttcaggccgctgagcttatccgaggcctaccgcaccctgtggggcgcgcaacaccagatgctgtcgccggacggcaagtccctgacgctctggatggacagcagctcgggcagcaggttcaagtctgcgcgggcgtaccggaacggctacttcggcgcgtccgtcagggagcagacggggtacaccgccggcgtcaacaccaccttctacctgtcgaacagcgaggagtacccagggcaccacgacgagatcgacatggagctgctggcgacggtgccgtgcgagccgtacacgctgcagaccaacgtgtacgtgcacggcagctgcgacngcaccatcgacggctgggagatgcggttccacctctggttcgaccccacgntcgacttcaccactacggcatcatctggaacccgacaagatcttgggttccggggggaccacttgcccgtcagggcgtacgagaggagggcggaaggcacgttccctgacggnaaaatttgcgctacggctcccatctgaaacgcctccaatgggccacccaaggggggccgttaccgggcccactaccggaaccaaccggtttcgttttcccgtt

SEQ ID NO: 75748 - protein, 174 aa, Zea mays
  misc_feature: Ceres CLONE 1560217
  misc_feature (7)..(175): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature (112)..(112): Xaa is any aa, unknown, or other
  misc_feature (129)..(129): Xaa is any aa, unknown, or other
MFRPLSLSEAYRTLWGAQHQMLSPDGKSLTLWMDSSSGSRFKSARAYRNGYFGASVREQTGYTAGVNTTFYLSNSEEYPGHHDEIDMELLATVPCEPYTLQTNVYVHGSCDXTIDGWEMRFHLWFDPTXDFTTTASSGTRQDLGFRGDHLPVRAYERRAEGTFPDGKICATAPI

SEQ ID NO: 75749 - DNA, 791 bp, Zea mays
  misc_feature: Ceres CLONE 1560218
  misc_feature: Encodes the peptide sequence at SEQ ID NO. 75750
  misc_feature (673)..(673): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
ggagctccccgcggtggcggccgctctagaactagtggatcccccgggctgcaggaattcgtctcacccctagaaaaaagcagccagctcccactcgcaccgcccgtccgcccagaactatctcgctcgtccgcgttcagctcagctactccaatttcgcaacaagttgcaagcaataaccgaccaaggacgacgaacgggtcgatggccacgctctcctcctgcagccgcctgagtagcggcaccggcgccgcggccatccaccggcagccggcccgtgctggagccgtcctcgtcgtcacctgcaggcggagctcctccgcgaccgtccgcgccgcagccgctgccacggcggcggcgccggctgccgtagagctgcagaacaagggggtgtcgctgccgacgtgggcggagttcgagctcgggcgggcgccggtctactggaagaacagcagcggcctcccgccctcgccgggcgaggggctgaccctggtctacaacccggcggccaccaagaatgcccccgaccgaggggttccgggtggcgtttaacgggggggtttcacaccacccccataatgttgggggggggaaaaccccaggggaaattaaacccctcttagaggggggggggaaaaaaaaaaacccccccccccttttttccccacttttnaaaaaaaaaggggggggggggnnncccccccccccccaaaagagggattttttttttccctcccacacaaaaagggaaaaaaaggggggaggcggggcgccccccccaaaaaaaaaaa

SEQ ID NO: 75750 - protein, 115 aa, Zea mays
  misc_feature: Ceres CLONE 1560218
MATLSSCSRLSSGTGAAAIHRQPARAGAVLVVTCRRSSSATVRAAAAATAAAPAAVELQNKGVSLPTWAEFELGRAPVYWKNSSGLPPSPGEGLTLVYNPAATKNAPDRGVPGGV

SEQ ID NO: 75751 - DNA, 867 bp, Zea mays
  misc_feature: Ceres CLONE 1560220
  misc_feature: Translation starting site: 197
  misc_feature: SWISSPROT Homolog: EC 2.4.1.207 Xyloglucan:xyloglucosyl transferase
  misc_feature (780)..(780): n is a, c, t, g, unknown, or other
  misc_feature (794)..(794): n is a, c, t, g, unknown, or other
aagctggagctccccgcggtggcggccgctctagaactagtggatcccccgggctgcaggaattcgtctcacccctagaaaaaatcccaacccactcacagtctcacgctactatcgctatctagagctccggccgtcacagacacgagctagagctagagctgcagggaagaagaagaaggaggaggaggagaagatgagggcgtccgcgctggtctgcttcgtggcggtgtcggcgtgcatagcgtgcatcgcgcatggcggcaacttctaccaggacacggagatgacctgggggcaggggcgcggcaaggtggtggacggcgggcgcgggctggacctgagcctggacagggcctccgggtccgggttccagtccaaggacgagtacctgttcggcaagatcgagatgcagatgaagctggtgcctggcaactcggcgggcaccgtgacgaccttgtacctgtcgtcgcagggcgacgcgcacgacgagatcgacctggagttcctgggcaacgtgtcgggcgagccctacacgctgcacacgaacgtgttcacgcgcgggcgggggcagcgggagcagcagttccgcctctggttcgaccccaccgccgacttccacacctactccgtggtgtggaacccgcggcacgtcatcttcgcggtggacggcacgccggtgagggacttcgccaacgcgaggccgcggggggtgcgttcccgcggacgcgccccatgcgggtgtacgccagcctctggaacgccaacaactgggccacncaggggcggccgcntcaggccgactgggcccggggcgcctttcctccccctctttccgcgggtttaacgcccaacccctggtttggg

SEQ ID NO: 75752 - DNA, 846 bp, Zea mays
  misc_feature: Ceres CLONE 1560222
  misc_feature: Encodes the peptide sequence at SEQ ID NO. 75753
  misc_feature (799)..(799): n is a, c, t, g, unknown, or other
tccccgcggtggcggccgctctagaactagtggatcccccgggctgcaggaattcgtctcacccctagaaaaatccaaccgccgagccagaggcacccggagcagcgcacagcaacagagcacacgccgcacaccgccgccgcctccgcagcagcagcagcaatggcgcgcgccggcgctctctgcctggtgctgctctgcctcgtggccgtgcactcagccacggcgcagaagtccacgacagccccggccgccgcgccggccgccgccaccaccccgccggcgaccccgaccaagaagtcgcccgcgcccgccgccgcgccgcccaccaccccggccaccctggccccggccgccgcgccgcccaccacgccggccacccccgcgcccgccgctgcgccgcccactacccctgccaccctggcacccgccgcggcgccgcccaagtccgcccccaaggcgtcccctcccgccccgtcgcccaaggccaaggccaccccgccggtggccgagctgccgcccgccgcctcgcctcccgcccccgcccccgcctcccctcccacaagcccgccgaggtccccgcgcccgcgcccgtcaagaagaagaagaggccctcctcgtcctccagaacaagaagaagaagtccaaggccccggcttccgccccccgcgccgaagcacccaccaggcaccaagcgctcccaggctaagggaccttcggccaaggaagccgacgcaccccgccctggcggggaatggcttggccccccaaacccccgggtggctagaaggaaccctgncaggcataatcattgggggccccccctgggcctcttgggcccctgcc

SEQ ID NO: 75753 - protein, 228 aa, Zea mays
  misc_feature: Ceres CLONE 1560222
  misc_feature (213)..(213): Xaa is any aa, unknown, or other
MARAGALCLVLLCLVAVHSATAQKSTTAPAAAPAAATTPPATPTKKSPAPAAAPPTTPATLAPAAAPPTTPATPAPAAAPPTTPATLAPAAAPPKSAPKASPPAPSPKAKATPPVAELPPAASPPAPAPASPPTSPPRSPRPRPSRRRRGPPRPPEQEEEVQGPGFRPPRRSTHQAPSAPRLRDLRPRKPTHPALAGNGLAPQTPGWLEGTLXGIIIGGPPWASWAPA

SEQ ID NO: 75754 - DNA, 849 bp, Zea mays
  misc_feature: Ceres CLONE 1560223
  misc_feature: Translation starting site: 150
  misc_feature (594)..(594): n is a, c, t, g, unknown, or other
  misc_feature (595)..(595): n is a, c, t, g, unknown, or other
  misc_feature (713)..(713): n is a, c, t, g, unknown, or other
  misc_feature (803)..(803): n is a, c, t, g, unknown, or other
tacccgcggtggcggccgctctagaactagtggatcccccgggctgcaggaattcgtctcacccctagaaaaaacttctgtacccaaccagaagagcggcggcgcgggcggacaaggagcaggcggaggaggagttgtgccaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaaccctgctgcaaagaaggataatgctgagggacaagaggttgaggcagcagctgaggaaacgannaagagctaccatgtcacgaggaagcttgagaagcgcaaggagggacgtacccttgacgcacacattgaggagcaatttggcagtggacggttgctggcatgcatttctcccgccttgnacagtgtggccgagctgatgggtacatctttgaggtaaagagcttgagttctcatgaagagcttcggagaagaagggcaaagcgctttanctagagcttctcatggaattgcctgcccccaattgggggtctgaaa

SEQ ID NO: 75755 - DNA, 786 bp, Zea mays
  misc_feature: Ceres CLONE 1560224
  misc_feature: Translation starting site: 174
  misc_feature (41)..(41): n is a, c, t, g, unknown, or other
  misc_feature (50)..(50): n is a, c, t, g, unknown, or other
  misc_feature (51)..(51): n is a, c, t, g, unknown, or other
  misc_feature (570)..(570): n is a, c, t, g, unknown, or other
tacccgcggtggcggccgctctagaactagtggatcccccngggctgcannggaattcgtctcacccctagaaaaactccaaagtttcgtccaccatttggctcccgcaagcaccgatttgtttactgctctctccgacgcgcggcggcggagctccctacgacaactgaaccatgtgcggcggcgcgatccttgccaaccttcgcgagccggcgccgcgccggctcacagagcgggacatctggcagcagaagaagaagctcaagaggggcggcggcggcgggaggcgctcgttcgcggcggaggacgatgaggacttcgaggccgactttgaggtcttcgaggcagactccagtgattcagatttggagctcagggaggggactgacgacgacgtcgtcgagatcaagcccttcactgccaagaggactttctccagcgatggcttaagcaccatgactagtgctgtagcaaggtcagccaagaggaagagaaagaatctatacaggggtatccgccagaagcctttgggggcagtgggctgctgagatcagagatcttcagaagggntgtccgtgtttggctgggtacttttcatagtccttgaggaagctggcagagcttatgatgcttgagcgcgcaggaatcctgggcagaagggcaaagggtaacttttctggatgcaccaaaaagttggtcagaaaccgcctttcctgggtcagccttccgctaaaggattccaagccaagtttttggacaaaaccccatttggccaagaaacctttg

SEQ ID NO: 75756 - DNA, 847 bp, Zea mays
  misc_feature: Ceres CLONE 1560227
  misc_feature: Encodes the peptide sequence at SEQ ID NO. 75757
  misc_feature (462)..(462): n is a, c, t, g, unknown, or other
  misc_feature (503)..(503): n is a, c, t, g, unknown, or other
agctccccgcggtggcggccgctctagaactagtggatcccccgggctgcaggaattcgtctcacccctagaaaaaatcttgtcttgatcctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgccatcaacgacaccggaagcgtcaagcaggcgtcccacctgctcaagtacgactccacgctncgcatcttcgatgccgacgtcaagcccgtcggcgacaacgncctctccgtcgacggcaaagtcattcaaggtgttgtcgaccccaccccagtaaacttgcctggggggaagcttggattctaacctgttattggggggccccggggtttttcttcaacccaaaaggggcccgggaaacccatttccgggcgggggccaaaaaaaggggctttaaccggggccccgggaaggggcaaatcccccccctaattttttggggggtttaatgcccaaccaataaaaaacccccaaaaaacccctcttttgaaaacccctcccgtgaacaaccaaatggctttcgcccattttttaaaaggcctctcccaaaaaatttggggcctcccca

SEQ ID NO: 75757 - protein, 159 aa, Zea mays
  misc_feature: Ceres CLONE 1560227
  misc_feature (68)..(156): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
  misc_feature (133)..(133): Xaa is any aa, unknown, or other
MASSMLSATTVPLQQGGGLSEFSGLRSSASLPMRRNATSDDFMSAVSFRTHAVGTSGGPRRAPTEAKLKVAINGFGRIGRNFLRCWHGRGDASPLDVIAINDTGSVKQASHLLKYDSTLRIFDADVKPVGDNXLSVDGKVIQGVVDPTPVNLPGGKLGF

SEQ ID NO: 75758 - DNA, 851 bp, Zea mays
  misc_feature: Ceres CLONE 1560229
  misc_feature: Translation starting site: 343
  misc_feature (565)..(565): n is a, c, t, g, unknown, or other
ctccccgcggtggcggccgctctagaactagtggatcccccgggctgcaggaattcgtctcacccctagaaaaaatcgtacctccggcgcctccgactccggtcctccggcctgcgcaggctagctagctctatttaggtcccaccgtgcccccgccccgcatgcaggggagatccaacggtccgagcagaaggtcgccggcggctagccagccagccagctaaagcgatccatatatacatatatactatcaagcaacacgtgaggaacgaaggaataaagaagccaagcccaccacggccagggaagagagcatatctaacgaaggaaggaaggaacatgatgaccaatgaggcagtggtgaacgccttcctgggctgcttcatgcacgtggggctggcgctggtgctcaccgtctacctccccgtggactttgtgtgcggtctcctccacggcctccacgtccgccctatggctaggggctgaggacgtccgtcggcaggtcatactcgtcaccgacgcgtcttccggcatcggcgagcacctggtgtacgagtacgcgagncacaggccgtgcatggcgctggtgcgcacacgaaagtcgcgctgcaccccatggccaaggcggctcgcgactgggcagcccaaacgtgactggtctgcccggcgacttcccaaagatgaggaccccaagcgcccctcgagggaaccgtacccccctttcggcaactgaatttctttggtcgccaacccccggaatttgggtccactgcctcttttgaaaaagttccccgcaaacccccttcccaaaaagtaagaaactcccccttttggggggccccggtcaaccc

SEQ ID NO: 75759 - DNA, 698 bp, Zea mays
  misc_feature: Ceres CLONE 1560231
  misc_feature (382)..(382): n is a, c, t, g, unknown, or other
  misc_feature (473)..(473): n is a, c, t, g, unknown, or other
  misc_feature (602)..(602): n is a, c, t, g, unknown, or other
tgggctccccgcggtggcggccgctctagaatagtggatcccccgggctgcaggaattcgtctcacccctagaaaaactctttccccatccgtccatcaaccgggctgctctgctgcctctccggcgccattgacgagcaagataatcctcatcctccgacacctgagtccgtcgcggtgccgtgcccacccgctaaggccagggcgccccgactcgagctcaccgcgtcgaactcgaaccgctgctgtatcctcgggcggcagggatacgtcgaggaatggcctggagcactcagagaacgcggcggcggacctgatgggcaacatcatggagacattgcggagaacctccgaggcagaagtccgtgcgggttcgacgacngccgacgggctcccttccatcttccgaagcaggccccaaggaagcttgtttcgggccgggccggcgaaaaaaccccgggaaaaaaaaaaancccggggccccccccacccgtgggctttggggggcggggggggggaaaaaataccccccccaaaaatttgttttttttttttgtgggggggaaaaaaacaaaaaaaaaaatttttttttttccacaaanttttttttttgggggggggctggggggacaaaaaaaccccctttgggttttttggggggggggtttttttttcctttcccccagaaggggaggggt

SEQ ID NO: 75760 - DNA, 871 bp, Zea mays
  misc_feature: Ceres CLONE 1560232
  misc_feature: Encodes the peptide sequence at SEQ ID NO. 75761
  misc_feature (779)..(779): n is a, c, t, g, unknown, or other
  misc_feature (804)..(804): n is a, c, t, g, unknown, or other
gctggagctccccgcggtggcggccgctctagaactagtggatcccccgggctgcaggaattcgtctcacccctagaaaaagcgcaggaacaaccaccaggcacagccaacaagcttgctagtgtgtggtttctctcatcaggtcaggaggagcatggccgaccataaggaggagcagtctgtgatggacaagatctccgagaagttccacggcggggactcctcgtcgtcgtctgactcggacgacgagaagaagaaggggtcttcttcggcgtcggcgacggaggccatgaaagccaagatctaccgtctcttcggccgcgagaggcccgtccactctgtcctcggcggcggcaagcccgccgatcttgtcctatggaggaacaagaagatctcaggcggggtactcgctggtgccacggccatctggctcctgttcgaggttatggagtaccatctcctcaccttggtgtgccactgtctcatcgtctcgctggccatcctgttcctgtggtccaacgcctccagtttcatcaacaagtccccaccaaacattcctgaggtgaaatccctgaggatgtgtctgttaatgttgcactgacactgagatacgagatcaacaggggctttgctacctttgagggagattggacatggacacgatctaaagaaattcctaattgttatcgcaggtctctggctcttttcagttcttgggagctgttgcaacttcctgacactgttctatattggtctttgtggcactgtacactataccntgttctgtatgagaatatgaggacnagggtgatgctttttgtgaagaaggctatgatcgactgaagaaatatattgcatccttccatgagaa

SEQ ID NO: 75761 - protein, 148 aa, Zea mays
  misc_feature: Ceres CLONE 1560232
  misc_feature (69)..(149): Pfam Name: Reticulon Pfam Description: Reticulon
MADHKEEQSVMDKISEKFHGGDSSSSSDSDDEKKKGSSSASATEAMKAKIYRLFGRERPVHSVLGGGKPADLVLWRNKKISGGVLAGATAIWLLFEVMEYHLLTLVCHCLIVSLAILFLWSNASSFINKSPPNIPEVKSLRMCLLMLH

SEQ ID NO: 75762 - DNA, 872 bp, Zea mays
  misc_feature: Ceres CLONE 1560233
  misc_feature: Encodes the peptide sequence at SEQ ID NO. 75763
  misc_feature (283)..(283): n is a, c, t, g, unknown, or other
  misc_feature (525)..(525): n is a, c, t, g, unknown, or other
  misc_feature (849)..(849): n is a, c, t, g, unknown, or other
  misc_feature (850)..(850): n is a, c, t, g, unknown, or other
ctggagctccccgcggtggcggccgctctagaactagtggatcccccgggctgcaggaattcgtctcaccccctagaaaaagaacgctcgcttctccaaatccccccttcgccttgcgagggggcggaggggaggtggtagtggtagggtatacaggagtgctctgcccatggagaaggcggggcaacaacgccatgttatcggcggcggcggcaagaaggcgcccgcgctggggctgcagaagcagaactcgtggtcgccggacatcgagcgcgacaggcgntgagagcgccggcgcaggggcatgcgccgcgggggcacggcgctgcgccgcgcccgcagcgtcacggacgacgacctcgacgagctccgcggctgcatcgacctgggcttcggcttcgagccggcgcctgccgccgcgtgcgcctgcgcctgcgcctgacgctgggagaaccccgctctggagacgctgccggcgctcaacctctactacgccgtcccacgcgggcccggcggaagggcccncccgtgctcctgccggcgccccctccggaggccgtcctcgtccgaagaaatccccgctcggcagcccccctgtccatccctctccccggcaaaccccccgaaaaacggggaaaaatccccccttaaccaaggggcccccaagtgggttcccccttcccaaagaataccccccccttaaaccttccggggccccgggcccccccaacctttgggaaatttgggaaaaaaaaaaaaaaaaccttctttaggtcccccccccccccaaaaggaagagaacccccgcggggtgccccccctttggaaaaaaaggcagaaaaaaataannctccccgggggggtttgcccca

SEQ ID NO: 75763 - protein, 45 aa, Zea mays
  misc_feature: Ceres CLONE 1560233
MRRGGTALRRARSVTDDDLDELRGCIDLGFGFEPAPAAACACACA

SEQ ID NO: 75764 - DNA, 790 bp, Zea mays
  misc_feature: Ceres CLONE 1560234
  misc_feature: Encodes the peptide sequence at SEQ ID NO. 75765
  misc_feature (349)..(349): n is a, c, t, g, unknown, or other
  misc_feature (350)..(350): n is a, c, t, g, unknown, or other
ctggagctccaccgcggtggcggccgctctagaactagtggatcccccgggctgcaggaattcgtctcacccctagaaaaagaaaccaagcaacccaatccaaaccagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggcnnacctgcgcgcgcgcgccggcaccagctgctgggacccgtcgggcgagcacggcgtcacctaggttctccgacttcacgcccggcagaagttccggccggaccttcccttcggccttcggaaagtccccggcgcgcttctccctcaaaagaactctggggaggtccgggccaccaagggcgccccggtgctcccccccccgaatgggtctcccccgaacaattttcaactgggaggggaccccggggggcccctttgggccccccgtaaaaaaaaccaagggttttctggcgcggggcccggggctggggcctttcaccaccccccctctgggagacccctttgaagggggggccccccctttcccttttaaaaaattgggaaaaaatttgggggagggggtcttttttgaggaaagacaacaattttttttgcccacaag

SEQ ID NO: 75765 - protein, 94 aa, Zea mays
  misc_feature: Ceres CLONE 1560234
  misc_feature (75)..(75): Xaa is any aa, unknown, or other
MAHRVLLLLSLASAAAVAAAVDAEDPLIRQVVPGGDDNDLELNAESHFLSFVQRFGKSYKDADEHAYRLSVFKAXLRARAGTSCWDPSGEHGVT

SEQ ID NO: 75766 - DNA, 846 bp, Zea mays
  misc_feature: Ceres CLONE 1560235
  misc_feature: Encodes the peptide sequence at SEQ ID NO. 75767
  misc_feature (524)..(524): n is a, c, t, g, unknown, or other
  misc_feature (534)..(534): n is a, c, t, g, unknown, or other
  misc_feature (625)..(625): n is a, c, t, g, unknown, or other
ctggagctccccgcggtggcggccgctctagaactagtggatcccccgggctgcaggaattcgtctcacccctagaaaaaccgtctggccacccatccgatcccacccggcagcggcgctgcgcaatggccacccacgcagctctcgccgcctcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgcagaggcgaagctgaaggtggcgatcaacggcttcggccgcatcggccggaacttcctccggtgctggcacggccgcgaggactcgccgatcgacgtcgtcgtcgtgaacgacagcggaggcgtcaggaacgcgtcccacctccctcagtacgactcgatgctncgcaccttcnaggccgacgtcaagatcgtggacgaccgaccatcagcgtcgacgggcagtctatcacggtcgtctccagcagggacccgctcaagctcctnatgggtgagcttcgcattgacatcgtcatcgaggggcaccggagtcttcgtcgaccgcccccgcgccgggaaagcaaatcagggcgggggcgaaaaaaggtgatcctcacggctccccgccaagggcccaaaactcccgaacctatatgcctcgggttcaaccaggggaaaatacaaccccgggttcccccaaattattaaaaaaacccttccttgacaac

SEQ ID NO: 75767 - protein, 200 aa, Zea mays
  misc_feature: Ceres CLONE 1560235
  misc_feature (83)..(200): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
  misc_feature (137)..(137): Xaa is any aa, unknown, or other
  misc_feature (167)..(167): Xaa is any aa, unknown, or other
MATHAALAASRIPAGARLHSRAPASSRHGVQRLDFADFSGLRPGSCSVSAAAREASFSDVLGAQLVAKATGENAVRAPAEAKLKVAINGFGRIGRNFLRCWHGREDSPIDVVVVNDSGGVRNASHLPQYDSMLRTFXADVKIVDDRPSASTGSLSRSSPAGTRSSSXWVSFALTSSSRGTGVFVDRPRAGKANQGGGEKR

SEQ ID NO: 75768 - DNA, 845 bp, Zea mays
  misc_feature: Ceres CLONE 1560237
ctggagctccccgcggtggcggccgctctagaactagtggatcccccgggctgcaggaattcgtctcacccctagaaaaaaaccgagacgggacgagaccagcagccggccaccagcccatccgaaccctgctgctcccctctccgggttcgcgtgaggctgtgtgctgctgggaggagggggaagcggcggcggggcgccatggaggccgagaagaaggcgccggcgggtcagacgtgggcgcgtgggcgatgaacgtcgtcagctccgtcagcctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtaccgctctgggagctcgtctggttctctctcgtcgccaacacctccatcaccgggatgaacctcagcctcatgctcaactccgtcggcttctaccagatctccaaactgagcatgattccggtggtctgcctcatggaatgggtgctgaacagcaagcactacaccaccaaggtcatctcggcagtggttgtcgtggccgccggtgtcgggatttgcacggtcacggatgtcgaggtcaatgcccaggggttcatctgcgctttgcgtgccagtgttctgcacgtcgcttcaacagatacaattgggttcttttcaaaagaagtacaacattggggtcatttgagctgctgagcaaaactggcacaattccaggcattttcctcattaaactgggccccctttggggactactatcttaaatggacg

SEQ ID NO: 75769 - DNA, 862 bp, Zea mays
  misc_feature: Ceres CLONE 1560239
  misc_feature: Encodes the peptide sequence at SEQ ID NO. 75770
  misc_feature (532)..(532): n is a, c, t, g, unknown, or other
  misc_feature (612)..(612): n is a, c, t, g, unknown, or other
  misc_feature (613)..(613): n is a, c, t, g, unknown, or other
  misc_feature (616)..(616): n is a, c, t, g, unknown, or other
  misc_feature (617)..(617): n is a, c, t, g, unknown, or other
  misc_feature (624)..(624): n is a, c, t, g, unknown, or other
  misc_feature (646)..(646): n is a, c, t, g, unknown, or other
  misc_feature (670)..(670): n is a, c, t, g, unknown, or other
  misc_feature (715)..(715): n is a, c, t, g, unknown, or other
cagagctggagctccccgcggtggcggccgctctagaactagtggatcccccgggctgcaggaattcgtctcacccctagaaaaaccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtggggaaagctgctggcgacaggtggaaatccctgagcgagtcggacaaggctccctatgtagccaaggctaancagctcaagctcgagtacaacaaggccatcgctgccctacacaagggcgagagcactgcagctaagaaggctcctgccannganngagagangaagatgaagaagagtctgacnagtccaagtcggaggtcaatgacnaggatgatgaaaagggtattgggggaggattaaaaatgatgaccnaattgatgggacctcctgaaaacaatggaccgtggcttcatccaacaaatggaacgggttacacaagggcccccggggcgatcccaaaaaaaggggccccaatcccctggtccctagaaattttttccgtttccccccccccaatcc

SEQ ID NO: 75770 - protein, 152 aa, Zea mays
  misc_feature: Ceres CLONE 1560239
  misc_feature (41)..(110): Pfam Name: HMG_box Pfam Description: HMG (high mobility group) box
  misc_feature (96)..(96): Xaa is any aa, unknown, or other
  misc_feature (123)..(123): Xaa is any aa, unknown, or other
  misc_feature (124)..(124): Xaa is any aa, unknown, or other
  misc_feature (125)..(125): Xaa is any aa, unknown, or other
  misc_feature (127)..(127): Xaa is any aa, unknown, or other
MKGAKSKGAAKADAKLAVKSKGAEKPAKGRKGKAGKDPNKPKRAPSAFFVFMEEFRKEFKEKNPKNKSVAAVGKAAGDRWKSLSESDKAPYVAKAXQLKLEYNKAIAALHKGESTAAKKAPAXXXEXKMKKSLTSPSRRSMTRMMKRVLGED

SEQ ID NO: 75771 - DNA, 863 bp, Zea mays
  misc_feature: Ceres CLONE 1560244
  misc_feature: Encodes the peptide sequence at SEQ ID NO. 75772
aagctggagctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcactgggctgcatcaccccggaggtgctggagaagtgggtgcccgtggactatcaggagcccgtgtggttcaggccggcgcgcagatcttctcggagggcgggctggactacctgggcaacccccaactggtggcagcgcagagcatcctagggcgtgctcggctttcaggtcatcctcatgggccctcctcgagggccttccccatcaacggccttcaacggggttcggggaagggaaacaacttttacccccgggggggaagaaaattgggaccccgtgggggccccacccaaaaaaccccttcacccttttcccgaaggtttaaggggccacgggaaataaaaaaacggggcccccc

SEQ ID NO: 75772 - protein, 163 aa, Zea mays
  misc_feature: Ceres CLONE 1560244
  misc_feature (69)..(164): Pfam Name: Chloroa_b-bind Pfam Description: Chlorophyll A-B binding protein
MASTIMAATSRIVAAKTPFLGQGRAAAAAANASPLRDVAAAAAGGRITMGNDLWYGPDRVKYLGPFSAQTPSYLTGEFPGDYGWDTAGLSADPEAFARNRALEVIHGRWAMLGALGCITPEVLEKWVPVDYQEPVWFRPARRSSRRAGWTTWATPNWWQRRAS

SEQ ID NO: 75773 - DNA, 868 bp, Zea mays
  misc_feature: Ceres CLONE 1560246
  misc_feature: Translation starting site: 110
  misc_feature (764)..(764): n is a, c, t, g, unknown, or other
ggagctccccgcggtggcggccgctctagaactagtggatcccccgggctgcaggaattcgtctcacccctagaaaaatcccaatcgccgagaaggggaagccaaatcgatggcggcggcggcggccggcggcaagaacagcggcgcgggcgcgggcgcgggcgagggcgagttctacctgcggtactacgtggggcacaagggcaagttcgggcacgagttcctcgagttcgagttccgccccgacggcaagctccgctacgccaacaactccaactacaagaacgacaccatgatccgcaaggaggtcttcgtctccccctccgtcctccgcgaggccaggaggatcatccaggagtccgatatcatgaaggaggacgacagcaactggcctgagcccgaccgcatcggccgacaggagctcgagatcgtcatgggcaacgaacacatttcattcaccagcttccaagatcggctccctcgtcgatgtccagtccagcaaggacccggagggactccggatcttctactacctcgtccaggatctgaagtgcttcgtgttttcactcatcaacctccacttcaagatcaagccaatccagtcttgagctccatctcaagccttcatgcgactgtatttggagtgttttacgagagaaccttgtaccatgttaagatgatgttgagcttgtgacgatgcgcacggtagcagtggcaccatttttttttttatgcggatggattgtgcaaactgcgaacagaantgaagtgtgggatatttgatgctttcagttatcggggtgggggtaggaggggttcttgtcgtttggccacgccacacctagaatcccttcccggttgatccggc

SEQ ID NO: 75774 - DNA, 878 bp, Zea mays
  misc_feature: Ceres CLONE 1560247
  misc_feature: Encodes the peptide sequence at SEQ ID NO. 75775
  misc_feature (809)..(809): n is a, c, t, g, unknown, or other
  misc_feature (848)..(848): n is a, c, t, g, unknown, or other
  misc_feature (862)..(862): n is a, c, t, g, unknown, or other
ggagctccccgcggtggcggccgctctagaactagtggatcccccgggctgcaggaattcgtctcacccctagaaaaaacccaatcaccaaaaaagaaagccggcgtcgcgtttccaacaggccagtcccctcccactcccagtcccatctcgacgacatggccgcagccgcagggccatcaagctctgtgaaggagacgctcccgccggccctcggctccacctcccagccacctcccgtcttcgatggcaccaccaggctgtacatctgctacttctgcccgttcgctcagcgcgcctgggtcaccaggaacttgaagggtttgcaggacaagatggagctggtggccatcgatctgcaggacaaaccggcttggtacaaggacaaggtttacgcacagggcacggtgccttccctggagcacgacagcgaggtcaggggcgagagcttggacctgatcaggtacatcgacagcaactttgacggccccgcgctgctcccagaggatgctgcgaagaggcagtttgctgacgaactgttcgcgtctgccaacgcgttcaccaaagccctctactcgccgttgctgtcccacgcggccgtgtcagacgaagttgttgcggctctggataaactcgaagctgacctatccaagttcgacgacgggcccttcttcctaggccaattcagcttggcggatgtagcgtacgttacgattctggaaagggttcagatatactattcccagtctaggaactacgacatcgcccaaggcaggtctagcctcgaggaatcatcgacgagatgaacnagatcgaagcgtatgcgcagaccaagaacgatcctctgnttcttgcttgatcntgccgagaaccatcta

SEQ ID NO: 75775 - protein, 215 aa, Zea mays
  misc_feature: Ceres CLONE 1560247
  misc_feature: SWISSPROT Homolog: EC 2.5.1.18 Glutathione transferase
MAAAAGPSSSVKETLPPALGSTSQPPPVFDGTTRLYICYFCPFAQRAWVTRNLKGLQDKMELVAIDLQDKPAWYKDKVYAQGTVPSLEHDSEVRGESLDLIRYIDSNFDGPALLPEDAAKRQFADELFASANAFTKALYSPLLSHAAVSDEVVAALDKLEADLSKFDDGPFFLGQFSLADVAYVTILERVQIYYSQSRNYDIAQGRSSLEESSTR

SEQ ID NO: 75776 - DNA, 797 bp, Zea mays
  misc_feature: Ceres CLONE 1560248
  misc_feature: Encodes the peptide sequence at SEQ ID NO. 75777
  misc_feature (710)..(710): n is a, c, t, g, unknown, or other
  misc_feature (769)..(769): n is a, c, t, g, unknown, or other
ccgcggtggcggccgctctagaactagtggatcccccgggctgcaggaattcgtctcacccctagaaaaaacacaaagctagcttatttcccttcccttcacgcggcaagcggcggccggccttccgccgccatggccaccaccaccgcgcccgtcctcctcgtcttcctcgttgccattgccacgtccgtcgccccctcattccccatcctgacgatggcggcggacgcggacaacggcaccacccacctgagcttcttcatgcacgacatcacgtcgggcgccagcccgaccgcggtgaaggtgatcaaggggcccggcgcggggtccaccccgacggcgccggcgctgggcatgacgttcggcgacaccatggtgatcgacgacccgctgacggaggaggcgtcgcccgcgtccgccgcgctgggccgcttgcagggcttctacatgctggcgtcccagaccaggtcggcgctttatggggtgcgccaacctgctgctcacatcggggggccacaacggggagcaccctcgccggtgctggggccgccacaacaccgggcaaggacgttccggaaaaaacccccgtttttaagggggcacccgggaaaattttccgaaagggcccccgggaaaacctcccctgtgggaaaaaaaccccccgaaagggggaaaaaaaagggggccccaaaaacccccccccgtgttcngaggggggggagaggttcttcctcgaaaaacccccccccggggaggggggggataaaangggccctctccccgaagagaaagaggaa

SEQ ID NO: 75777 - protein, 221 aa, Zea mays
  misc_feature: Ceres CLONE 1560248
  misc_feature (12)..(150): Pfam Name: Dirigent Pfam Description: Dirigent-like protein
  misc_feature (193)..(193): Xaa is any aa, unknown, or other
  misc_feature (213)..(213): Xaa is any aa, unknown, or other
MATTTAPVLLVFLVAIATSVAPSFPILTMAADADNGTTHLSFFMHDITSGASPTAVKVIKGPGAGSTPTAPALGMTFGDTMVIDDPLTEEASPASAALGRLQGFYMLASQTRSALYGVRQPAAHIGGPQRGAPSPVLGPPQHRARTFRKKPPFLRGHPGKFSERAPGKTSPVGKKPPERGKKKGAPKTPPRVXRGGRGSSSKNPPPGRGGIKXALSPKRKR

SEQ ID NO: 75778 - DNA, 887 bp, Zea mays
  misc_feature: Ceres CLONE 1560249
  misc_feature: Encodes the peptide sequence at SEQ ID NO. 75779
ggagctccccgcggtggcggccgctctagaactagtggatcccccgggctgcaggaattcgtctcacccctagaaaaagagtccgctctccgctccaatgccgttgcctctctcctccacctgcttcttctcataaacgcttccggcctcccggagtcccggacacaaaccctagcattcaaccacgccgagctcgccggaacaagcccaacccgagcccaatcccgctcgggccccagccgatccgacggctcctcaccagcacaatccggggtaccccgcggatgctagcctgatcgggtccccacggtcgatgggttcgcccgggtccgccaatggcagacgcggcgactatgtgaggatcccggaggaggcggaggtggcgtccaagggggagggagatagcccgcaggcggccgtcaaggcggccgcggctgcggagtgccctagggtgctgcggtgcagcgcgatccagtggtgggccaaggacgccgtgctcgggatcgtccttgctggggccggagctgccgcggagcgacttctcggcccgctccttatcaagaagattgttgtacctattcttacatgggcatcaacaacgttcagcaggacatctatagctctactatgtatcggcacagtcgcattctgcgcaagtgtcatgttaccttcttcgcccttcatgtggctgtcgaggatgacttttggatatccttatggtcgtataataatcacagtgagtatgagcgtaggcctgtccttgcaggattttgtacgttctgcattccactgagggacacattcatcgctggagaaagtggccaaggaaagcactttttgtcaggcttgctggccacggaaaattgcccccatcaattaaaggcgtt

SEQ ID NO: 75779 - protein, 159 aa, Zea mays
  misc_feature: Ceres CLONE 1560249
MGSPGSANGRRGDYVRIPEEAEVASKGEGDSPQAAVKAAAAAECPRVLRCSAIQWWAKDAVLGIVLAGAGAAAERLLGPLLIKKIVVPILTWASTTFSRTSIALLCIGTVAFCASVMLPSSPFMWLSRMTFGYPYGRIIITVSMSVGLSLQDFVRSAFH

SEQ ID NO: 75780 - DNA, 855 bp, Zea mays
  misc_feature: Ceres CLONE 1560251
  misc_feature: Encodes the peptide sequence at SEQ ID NO. 75781
  misc_feature (712)..(712): n is a, c, t, g, unknown, or other
  misc_feature (715)..(715): n is a, c, t, g, unknown, or other
  misc_feature (731)..(731): n is a, c, t, g, unknown, or other
  misc_feature (736)..(736): n is a, c, t, g, unknown, or other
  misc_feature (764)..(764): n is a, c, t, g, unknown, or other
ggagctccccgcggtggcggccgctctagaactagtggatcccccgggctgcaggaattcgtctcacccctagaaaaaacggaccatagcccagaaaggaccaaggtggaagaaacaaaacgaaaggcggtgtcagctgctcctccacttcccgtgtttctaactccggtggctccaccactagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccagagaattgctataccaacaccagcataacaaaaggatgagctgccctgccatggcacagctcctctccaataccctgtactacaagcgcttcttcccatattacgccttcaatgtgctcggtgggcttgaagcgaggggaaaaaggtgtgtttcacctatgatgcagtaagtcctatgagagaactggttatagtgctcggggagcggaactactttgattatgccagtcctggcaaacaaccacaatacccaggtcctctattgtccctntgncaggatgccgtccccnccatnttgcggagtcagaaagcctcgccactanttttaagatgtgttttcatctgccactgagagagaatctcacctggagacaagttggaaattgtagtcatcaacaagtccggaactaaacc

SEQ ID NO: 75781 - protein, 130 aa, Zea mays
  misc_feature: Ceres CLONE 1560251
  misc_feature (10)..(130): Pfam Name: Proteasome Pfam Description: Proteasome A-type and B-type
  misc_feature: SWISSPROT Homolog: EC 3.4.25.1 Proteasome endopeptidase complex
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLEARGKRCVSPMMQ

SEQ ID NO: 75782 - DNA, 879 bp, Zea mays
  misc_feature: Ceres CLONE 1560253
  misc_feature: Encodes the peptide sequence at SEQ ID NO. 75783
  misc_feature (754)..(754): n is a, c, t, g, unknown, or other
  misc_feature (809)..(809): n is a, c, t, g, unknown, or other
ctggagctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgcaacggcgtcaagttcggcgaggccgtgtggttcaaggccggctcccagatcttcagcgagggcgggctggactacctcgggaacccgagcctcatccacgcgcagagcatccttgctatctgggcctgccaggtcgtgctcatgggcgccgacgagggctaccgcatcgccagcggcccgctcggcgaggtcgtcgacccgctctacccccgcggcagcttcgaaccgttcggcctacactacnaacaccaaggccttcagcgagctcatggtcagcgagctcagaacggccgccctcncatgattctcatgttcggattcttcgtgcgaggcatccgaccacgggaagggcccgctcgaggacctcgc

SEQ ID NO: 75783 - protein, 244 aa, Zea mays
  misc_feature: Ceres CLONE 1560253
  misc_feature (65)..(233): Pfam Name: Chloroa_b-bind Pfam Description: Chlorophyll A-B binding protein
  misc_feature (203)..(203): Xaa is any aa, unknown, or other
  misc_feature (221)..(221): Xaa is any aa, unknown, or other
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGADEGYRIASGPLGEVVDPLYPRGSFEPFGLHYXHQGLQRAHGQRAQNGRPXMILMFGFFVRGIRPREGPARGPR

SEQ ID NO: 75784 - DNA, 857 bp, Zea mays
  misc_feature: Ceres CLONE 1560256
  misc_feature: Translation starting site: 356
  misc_feature (534)..(534): n is a, c, t, g, unknown, or other
aagctggagctccccgcggtggcggccgctctagaactagtggatcccccgggctgcaggaattcgtctcacccctagaaaagatggggtcacgttcgaggatttgatcatctccaaagcaacatatggaaggggaactcgtgatgaggtcgatgaattcatttatcaactatgtgatgtcacaggagatggcgccttaacaaggtctgatttggaatcagtcttggcgtctgttcatgaaactgtatttgcaataaagaaggaagttgtcgaagtttccaacaatagaccattcgaagaattcctcaactctgcagtgttttcaaaggatgttgaaggggtctcagggaagtctatgtcattgtcagactttaggaactggtgcactctcttgccatcattgaggaaatttcttggaaatttgttgatgccccctgattcaggtagaccaggatttgaagtaccactgcttcatcatcctgaaaacatctgcactgatacgctgcttctaaacaaagagtatgcctggcatanttggaggaggtttctcccaacatgaggtgcaagagtggaagcttttatatcatagttctcttcatggacaaagcttcaacactttcttgggcaaagtaacgaatggagatgctcagactgttctgattgttaagatacagaggatccatttatgggtggatatgcttccagccttggggaaaggcacagtgatttttatggtgacatgaagacattcctcttaaaatgctatcctccagcatccattttttcgtcctactgagcaaacagaatttgccaaggtgtgctggaaacttcagctctgagaactaaccaattgtgtt

SEQ ID NO: 75785 - DNA, 887 bp, Zea mays
  misc_feature: Ceres CLONE 1560257
  misc_feature: Translation starting site: 506
  misc_feature: SWISSPROT Homolog: EC 3.2.1.51 Alpha-L-fucosidase
  misc_feature (726)..(726): n is a, c, t, g, unknown, or other
  misc_feature (784)..(784): n is a, c, t, g, unknown, or other
aaagctggagctcaccgcggtggcggccgctctagaactagtggatcccccgggctgcaggaattcgtctcacccctagaaaaagtcgttccatccagctctcccagcgcgctgctcgactcgactcgacttcctctgcaacgcgtgtccggtgtaggctgagagagtgagtgagaggcgagatgaggagcgggcggctggcggtggcggtggcggtggctctggcgtgggcgttcgcggcgtctgcggcggcggcggcgcagaaatacaatgccatcttcaacttcagcgactccatcaccgacaccgggaacctctgcaccaacgggaggccgtcgcagatcaccttcacgcagccgccctacggcgagacctacttctgcacgccgacgtgccgctgctgcgacggccgcgtcatcccggacttcctctgctccaggttcggcctagccgttcctgccgccgtccaagtccacgactgccgactctctagaagggcgccaacatggccatcaccggcgccacggccatggacgcgccctacttccgctcgctcgggctctccgacaagatctggaactacgggcccatcagcttccagctgcagtggttccagcatgtcaccatccaccgagtgaggccagtactgcaacagctacctgggcaactcgactgttcgtgcttcagcgagttcgggagctactactacaacgccatgctgggtcngcaactacaacgcgaaccatgacagcatgtaaacacccgagatcgtgagcggcatccncggccggtctggaaaaaactagagacatggggcccccgggaggtggggggtgccggggggtggaccccatcgggatgcttccccttcttcggaagcgagaagc

SEQ ID NO: 75786 - DNA, 870 bp, Zea mays
  misc_feature: Ceres CLONE 1560259
  misc_feature: Encodes the peptide sequence at SEQ ID NO. 75787
aaagctggagctccccgcggtggcggccgctctagaactagtggatcccccgggctgcaggaattcgtctcacccctagaaaaaagttcttccctcgcgttcactccccagcgtgggaaaatcccagaattttcttgtttgtccactggttttcttgcgccaaaaccaggtttctccccgttgccgtggcagaactctgctcttgcccagtctagaagatctgcaccgttccaaccaccgactccggccgccaagcatatagccagcgcggcgaagaattcccaacgcgaaagccaaaacctcttcacttcacttcacgtcgacacgtgcggggagaatatgcgcgcgacaatcccagccctgtcgctcctggtgacgccgcggctcccctcgctcgccgtgccgctggctggaggccgcctccgcgtgggcggtcgtcctcggacctgcctccgcgtggcggcgccgacgtccgtcccaggggaagctgctgagcagggcgagccagcacgtcggcgccccagtcggggaagaagtctcgtgaaaggatcactgtacccggtctcctcgtcgaggacctgaccccagccgcccaacccgtttcaggctctcaccggggacttcgtattttggaaggacccaaatccggcaaaggggttccgttgaaaaaccctgccccccccgccttggccccttttcggagggcaggatcattaaaacggggggctttggaggtcctctaataccggaaggggcattcaaggggttccgggccctggaacaaaaaccccccaagccatgccccgaggggcctttaagccccgggggggggggctaccaaaaggggggccccaaaaaatttcccccccc

SEQ ID NO: 75787 - protein, 80 aa, Zea mays
  misc_feature: Ceres CLONE 1560259
MRATIPALSLLVTPRLPSLAVPLAGGRLRVGGRPRTCLRVAAPTSVPGEAAEQGEPARRRPSRGRSLVKGSLYPVSSSRT

SEQ ID NO: 75788 - DNA, 896 bp, Zea mays
  misc_feature: Ceres CLONE 1560261
  misc_feature: Encodes the peptide sequence at SEQ ID NO. 75789
  misc_feature (503)..(503): n is a, c, t, g, unknown, or other
  misc_feature (642)..(642): n is a, c, t, g, unknown, or other
aagctggagctccccgcggtggcggccgctctagaactagtggatcccccgggctgcaggaattcgtctcacccctagaaaaaagtccgccacaagcacacgcgcacacaggggccaagcgcctacacctacagaggagagacaaggtctgccgtccgcgcgtgcgcggaagaggggacggaggaagaaggctgccagcaatcagagatggaggtggggttcttgggtctgggcatcatgggcaaggcaatggcgaccaacctcctccgccacggcttccgcgtcaccgtctggaacaggaccctcgccaagtgccaagagctcgccgcgctcggcgccaccgtcggggagacgcctgcctccgtcgtctccaagtgcagatacaccatcgccatgctctccgaccccagcgccgccctatcagtcgtcttcgacaaggatggcgtgctcgagcagatcggtagcgggaagggctatgtggacatgtccactgttgacgctgncacttcgacctagattagcgaggcagttaaacaaaaagggggagctttcctttgagctccagtttcagggagctagaagccagctgaagatggccatttggtcattctggctgcaagggacaagccattgtatgatggntatgattcctgcaattagatgactgggggaagagttcattctttctggaaaagattggaaatgggggcaaaaatgaaactttggggccaactggccctgggaaagtagaatgaattcctttgcccaaggggaactcttttggccccaaaaaggggggctgagcccccaaaactttttttgggtccggggaccttggggccctctcaaacccaagttttaaggtgaagggggctctaaaggggtcgaggggactc

SEQ ID NO: 75789 - protein, 102 aa, Zea mays
  misc_feature: Ceres CLONE 1560261
  misc_feature (1)..(103): Pfam Name: NAD_binding_2 Pfam Description: NAD binding domain of 6-phosphogluconate dehydrogenase
  misc_feature: SWISSPROT Homolog: EC 1.1.1.31 3-hydroxyisobutyrate dehydrogenase
  misc_feature (99)..(99): Xaa is any aa, unknown, or other
MEVGFLGLGIMGKAMATNLLRHGFRVTVWNRTLAKCQELAALGATVGETPASVVSKCRYTIAMLSDPSAALSVVFDKDGVLEQIGSGKGYVDMSTVDAXTST

SEQ ID NO: 75790 - DNA, 846 bp, Zea mays
  misc_feature: Ceres CLONE 1560262
  misc_feature: Encodes the peptide sequence at SEQ ID NO. 75791
  misc_feature (586)..(586): n is a, c, t, g, unknown, or other
agctccccgcggtggcggccgctctagaactagtggatcccccgggctgcaggaattcgtctcacccctagaaaaactcttccgttccgtctcattctcatccccgacccccgcaccgcagcgtaaaccctagtccccggcggcgaccttgcggcctccgctgcgctctgactggtgcgcgtttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcagcgcattgatgagaggttatctgcccttggcaattgcatagcctgctatgaccatgttgcacttacgcaccctgaccttgacnaggagactgaggagttcattgcagatgtgcttggggtcgaggtgtttaggcacactattgctgaaaatatctttgtggggagttactgcgccttcctctacaaggggtggtttgggttcatccccctacctccggttgaagaacttggacgagctccccaagcctccttccaagtttccccttggtcccgggaacttgtaaaacagaggaacccaaggtccttttttctcaaggttttaaagtttaaccccccgggcccc

SEQ ID NO: 75791 - protein, 209 aa, Zea mays
  misc_feature: Ceres CLONE 1560262
  misc_feature (3)..(189): Pfam Name: eIF-6 Pfam Description: eIF-6 family
  misc_feature (123)..(123): Xaa is any aa, unknown, or other
MATRIQFENNCEIGVFSKLTNAYCLVAIGGSENFYSAFEAELADAIPVVKTSIGGTRIIGRLCVGNKNGLLLPHTTTDQELQHLRNCLPDQVVVQRIDERLSALGNCIACYDHVALTHPDLDXETEEFIADVLGVEVFRHTIAENIFVGSYCAFLYKGWFGFIPLPPVEELGRAPQASFQVSPWSRELVKQRNPRSFFLKVLKFNPPGP

SEQ ID NO: 75792 - DNA, 872 bp, Zea mays
  misc_feature: Ceres CLONE 1560263
  misc_feature: Translation starting site: 178
  misc_feature: Pfam Name: HlyIII Pfam Description: Haemolysin-III related
  misc_feature (1)..(1): n is a, c, t, g, unknown, or other
  misc_feature (814)..(814): n is a, c, t, g, unknown, or other
naaagctggagctcaccgcggtggcggccgctctagaactagtggatcccccgggctgcaggaattcgtctcacccctagaaaaagcaaggctacaaccaagaggtgtgctggaattatacatctccaaaagctagctagaagaccttggtgggtggtgagcttggaggaggagctcatggctgcttcttcgtcctgcatagcttgcaataatggcagtaccgatgagaaggaggagaagcggaagtgtgagctcgtcgggtatgaaggactgcctgagtggctcaaggacaacgagttcatccatggctactaccggtgcgagtggccgatgaaggagaccgtcctcagcatcttctccatccacaacgagaccctcaatgtttggtcgcatttgctagggttcctgctgttcctgtgcctggcaatctttacagcaatggtgatcccaaggaatggcagcagcaggagcagtaacagcgctgcataccagctgggagatcttggtggagatggccaacatgacggtagcgctgaggcacgaggcacttgcagcgtgtttcctgctgccaccatctgctgctgctttgtctgaagatggtcagcacatcccaaccagctgtccacccaacacttcctcctcccatcatcatgccatccagatccagagcagcactggtacggcggccaccgtggacgccggcaccgccgccgaccccatcacgcggtggccgctgatcgcgtcctggtcgggcgcgatggtgtgcctgcggacaagcagcgtgtgtcacctgatcctgtgccactcgaagcgncacgcgtacgtgacgctccggctcgactacgccggcttcgcccgcgctgatcgtcacc

SEQ ID NO: 75793 - DNA, 776 bp, Zea mays
  misc_feature: Ceres CLONE 1560264
  misc_feature: Encodes the peptide sequence at SEQ ID NO. 75794
  misc_feature (430)..(430): n is a, c, t, g, unknown, or other
ctggagctcaccgcggtggcggccgctctagaactagtggatcccccgggctgcaggaattcgtctcacccctagaaaaaagttccggatcactctctcggctgccactggtccgctccccgcgtctgcggcttccactctccgctcttcgctcctcctcccgccaagatatttccggagactctgagagccccctcctggtcatgtcgctgctcgccgtcgcctcctccactcgcgccgcggcagtgcggccgctgtgcgcctcggcggcctcggacgaggcggtgccggcgcctgctgtggcggataccgcagggcggaggccggtgaaggtgatcctaccaaagaagaaaccgcagaagtggtcgacggggatggcaccgggtgagtacggcggcgggccggccaccatcaagccgcgcaagtactnggtgggggaaggaggaccgcgaccccgtggggaacaccgacgacttcatctggaacaaggacttcctcccccacatggaacgcgtcatcgccaacggcggcgccgatgcagaacccaccatcacccgccttgcgccggtggatgaagggagggggagtcccgggtttctgagcatcaaccgcgcaatgagccttgacagcgtgggaggttgatctgagccaggagcttcaggcaccgaccaggccaatcttgcaaacccaggttgaggctgcctggagaggacgggcaattggtgctgaggctgtggatggagccagcgctcctaaatggaggctagtccctacta

SEQ ID NO: 75794 - protein, 123 aa, Zea mays
  misc_feature: Ceres CLONE 1560264
  misc_feature (76)..(76): Xaa is any aa, unknown, or other
MSLLAVASSTRAAAVRPLCASAASDEAVPAPAVADTAGRRPVKVILPKKKPQKWSTGMAPGEYGGGPATIKPRKYXVGEGGPRPRGEHRRLHLEQGLPPPHGTRHRQRRRRCRTHHHPPCAGG

SEQ ID NO: 75795 - DNA, 785 bp, Zea mays
  misc_feature: Ceres CLONE 1560265
ctcaccgcggtggcggccgctctagaatagtggatcccccgggctgcaggaattcgtctcacccctagaaaaaaaccgccgagccagaggcacccggagcagcgcacagcaacagagcacacgccgcacaccgccgccgcctccgcagcagcagcagcaatggcgcgcgccggcgctctctgcctggtgctgctctgcctcgtggccgtgcactcagccacggcgcagaagtccacgacagccccggccgccgcgccggccgccgccaccaccccgccggcgaccccgaccaagaagtcgcccgcgcccgccgccgcgccgcccaccaccccggccaccctggccccggccgccgcgccgcccaccacgccggccacccccgcgcccgccgctgcgccgcccactacccctgccaccctggcacccgccgcggcgccgcccaagtccgcccccaaggcgtcccctcccgccccgtcgcccaaggccaaggccaccccgccggtggccgagctgccgcccgccgcctcatctccagcccccgcccccgcctcttctcccactaagaccagcaaggtccccccgcccgcgccgtccaagaagaagaagaaagccctcctcgtcgtccaagaacaagaagaagaagtccaatggccgcggctccaggcccccgtcgtccaaggcacccacgaacaccaagcggcttcaaaggctaaagcacctttcgggccagcgaagaccgaagcaccccggccccgtcagggaagtggagttggccgcccaacacg

SEQ ID NO: 75796 - DNA, 855 bp, Zea mays
  misc_feature: Ceres CLONE 1560271
ctccccgcggtggcggccgctctagaactagtggatcccccgggctgcaggaattcgtctcacccctagaaaaaaaaatcccctcgccttcgcgggggcagagcccctgcgcggccgcgcggccgcagcgccggcagggacactccatgcgcaccatccgctccgcgctgctgcagccggactcctccccggagtcgtccccggtaccgggggatggcggcgccgacgcgggcgactcggacattgagaacctcacagactccgtcatcgacttccgcctccgcgagctcgccgccaccgcggggcccacgcacccggcggccgtcgccaagtcgtcctccgccatcaacgccgccgccacggagctgctcgacctgtcgcgggacttctccgactactccagcttcaactccgacatctccggggagctcgagcgcctcgccgccgccgcagtcgtcgatctgaacgacctcgagtccatggacctgtcggcgcacgcggcgccgctggagcgcctggagccgttcgtgcgggcgtgcgtgcgggcgctggggcccggcgccggcccggacgcgcggcgcgcggccgcggccaggatacgcctgctggcgaagcaccggtcggacgtccgcgagctgatcggcgtgtcgggcgccatcccggcgctcgtgccgctgctgcggagcaccgaccccgtggcgcaggagagcgcgggcaccgcgctgctcaaactctcgctcgaggaccgaaacgctccggcatcacggcggcgggcgccataaaggcgctcgtctacgcgctgcgcaccgggaccgctcccgccaagcagaaacgcgcgtgggcgctgctcaacct

SEQ ID NO: 75797 - DNA, 834 bp, Zea mays
  misc_feature: Ceres CLONE 1560276
  misc_feature: Encodes the peptide sequence at SEQ ID NO. 75798
  misc_feature (772)..(772): n is a, c, t, g, unknown, or other
  misc_feature (773)..(773): n is a, c, t, g, unknown, or other
  misc_feature (825)..(825): n is a, c, t, g, unknown, or other
tccccgcggtggcggccgctctagaactagtggatcccccgggctgcaggaattcgtctcacccctagaaaaaaaaaaaaaaaagcgggcgctgtggtgcgccttttttttaccatcgagacaacacgacgaggccagccacgcgcaaaccgaatccaccaacgtcaaacgaccgcaccaaccaatccacttcgccggcgatccgtctcatctcgtcgcgtctccggcgccggcagacacgggtaacgcggctccgagatcggcgggcaggatgatgatgctgatcgattgctcggggtgccgtaccccgttgcagctgccgcacggggcgccctgcatccgatgcgccatctgtggggccgtcacgcacatcgcccccgcccctcccgccgagcccaaccgcggcgccgtacaaccggcgccggggtgggcgccgccgccgccgccggtgcacggacggaagcgcgccgtggtgtgcgggatttcgtatcggtactcgcggcatgagctgaagggctgcatcaacgacgccaagtgcatgcgccacctgctcatgacgcgcttcaacttccccgacgactccatcatcatgctcaacgaagaacaaacggacccctacaaaatcccaacaaagcataacataaggatggccatgtattggcttgtgcaaggttgtcaacctggagattcattggtgttccattattctgggcatggatcacaacaaagaaattacagtggagatgaggtttgatgggttcgatgaaacccnntctgccgttggattttgagacacaagggatgatttttggatgatgagataantacagcatt

SEQ ID NO: 75798 - protein, 160 aa, Zea mays
  misc_feature: Ceres CLONE 1560276
  misc_feature (7)..(31): Pfam Name: zf-LSD1 Pfam Description: LSD1 zinc finger
MMMLIDCSGCRTPLQLPHGAPCIRCAICGAVTHIAPAPPAEPNRGAVQPAPGWAPPPPPVHGRKRAVVCGISYRYSRHELKGCINDAKCMRHLLMTRFNFPDDSIIMLNEEQTDPYKIPTKHNIRMAMYWLVQGCQPGDSLVFHYSGHGSQQRNYSGDEV

SEQ ID NO: 75799 - DNA, 860 bp, Zea mays
  misc_feature: Ceres CLONE 1560277
  misc_feature: Encodes the peptide sequence at SEQ ID NO. 75800
gagctccccgcggtggcggccgctctagaactagtggatcccccgggctgcaggaattcgtctcacccctagaaaaagtccaaacgcagccgaagaggaaaggagagagagaggcggcgaggatggggcggaagcggaaggagctgctgtcgtcggctccatggaggacgggggaggcggcggaggacgaggacgcggcaaggatgagccgcgaggggaaggtcagcgtctccagcaaccccggggagacgcccaccatgagcatgccccggagcaagcgccaggacctcgacctcaccgtcgacgacttcgaggaggacgagatcgaccctgagctgcgctactccttccagcggaacagcaggtttctgaagagagtttttggcgtggacacacttgtcaagcctctccctcctgtaatggcatacagcgtatcccgcgatataaacttcttcttccggatcttcacacagttttgggatgaagaaggaattgccaatgcccagaagtcccttggactggggaacgaggacagctcccgccgaatgcgctgatcgtggtcaaaccaagttttctgtaccgggttcagaactcttttgccctagacactggagacgtgttatacgcctcgaaagacatggcatgagacatttttagggaaatttggatgcatacccataaacgatcgccactttggatgcatacgattactatatcacgtacgatgtggttccacatgagtcaatgacatgtgcgggctgcatgggatatagtctaaaggttgggatctttctaatggtatagagtcaatttgttccccattgttcaggcttggcttacaatttggatgtacccgagtg

SEQ ID NO: 75800 - protein, 143 aa, Zea mays
  misc_feature: Ceres CLONE 1560277
MGRKRKELLSSAPWRTGEAAEDEDAARMSREGKVSVSSNPGETPTMSMPRSKRQDLDLTVDDFEEDEIDPELRYSFQRNSRFLKRVFGVDTLVKPLPPVMAYSVSRDINFFFRIFTQFWDEEGIANAQKSLGLGNEDSSRRMR

SEQ ID NO: 75801 - DNA, 811 bp, Zea mays
  misc_feature: Ceres CLONE 1560279
  misc_feature (736)..(736): n is a, c, t, g, unknown, or other
ctccccgcggtggcggccgctctagaactagtggatcccccgggctgcaggaattcgtctcacccctagaaaaaagcccgcagcccgcagccggtcagtccttccttctcctgttcgcgtccacgatcctgccgccgccgctcgcacctccacgatcctgcccagcgccgtgcgcctccacccccgccccgtccgccgcccgcccggctggccggcggcgccaccccgggacccgcgcgcgtggagccccggcctctaccagccgcacgtcgcaaccggcgaggacgcgcgcgcctgcagctcctgcccggtcccggctggccggccgccggcactccggctgcccctcagcggctcagcccctgaaagcttgtctgcttgactggcttcaggtgccgggtgcaagcacaaggcgggcaagtggcccccccctgggtcaagggccccaagcccgcccttaaaccaaccgggcgttaaaaaacggtggtggaaattttttttttccccccccccgttttttttttttgggggaaaaacatggggggggaaaaaaaaaaaaaaaggcggtgggggatttaacgcgggaggggggggggggggggggaacccccccccgggcttttgaaataaaaaaaaaaaaaaaaaaccttgtgggtgggggggttctcctcccccctccattgtaaataataaaatataaagagggtgagtgcggagggaatttgttctctgtttntttcttatatttatggttgggttgtggtttttctgtcacaaaaaaaaaacaagggggtgtggtgggcgggggcga

SEQ ID NO: 75802 - DNA, 844 bp, Zea mays
  misc_feature: Ceres CLONE 1560280
  misc_feature: Encodes the peptide sequence at SEQ ID NO. 75803
  misc_feature (603)..(603): n is a, c, t, g, unknown, or other
  misc_feature (605)..(605): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (649)..(649): n is a, c, t, g, unknown, or other
  misc_feature (650)..(650): n is a, c, t, g, unknown, or other
  misc_feature (761)..(761): n is a, c, t, g, unknown, or other
  misc_feature (762)..(762): n is a, c, t, g, unknown, or other
  misc_feature (811)..(811): n is a, c, t, g, unknown, or other
ctccccgcggtggcggccgctctagaactagtggatcccccgggctgcaggaattcgtctcacccctagaaaaaagggttctacttctagcccgggccgactccactccaatccaatcctggggcgagcgactgcctccttccctcgatctattccccatcttgtcctccctttgctaaaaataacgaggcagaggcatcttcgatttgacgtgcgcttcctcttcctcgctcgctctcggtcgcagtgatggctgatgtcgacgagtaccgttgcttcattgggaacctgtcctggtcaacgactgatgaaagcctcaaggatgcgttcagcaaattcggcaacctcactgaggcaaaggtggttcttgacaaattttcaggacgttctcgtggtttcggctttgtaacttttgatgagaagcaagccatggaggatgctattgagggaatgaatggactggacttggacgggaggaacatcactgttgataaagctcagccacaaggacctggtagagaccgtaatggtgaccgtgattatgaccgcgagcgtggatctcgttatgaacgtggtcgtgactatggtggtgggcgtgcaccncnagtgtgtggtggnnnnnnnnnnnnnnnnnnnnnnnnactgcttnnagttgtgggaaacctggtcattttgctagagagtgcccatctggggatggtgggaaaaggggacaatattgggtgggaaaaatgaagggattggtgggggtgggtgttggnngttttttatggtttggaagggggggggggaagatttctttgggcgttanccaaaaggggggagctaaggggggggggcaaag

SEQ ID NO: 75803 - protein, 161 aa, Zea mays
  misc_feature: Ceres CLONE 1560280
  misc_feature (9)..(80): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (119)..(119): Xaa is any aa, unknown, or other
  misc_feature (124)..(124): Xaa is any aa, unknown, or other
  misc_feature (125)..(125): Xaa is any aa, unknown, or other
  misc_feature (126)..(126): Xaa is any aa, unknown, or other
  misc_feature (127)..(127): Xaa is any aa, unknown, or other
  misc_feature (128)..(128): Xaa is any aa, unknown, or other
  misc_feature (129)..(129): Xaa is any aa, unknown, or other
  misc_feature (130)..(130): Xaa is any aa, unknown, or other
  misc_feature (131)..(131): Xaa is any aa, unknown, or other
  misc_feature (134)..(134): Xaa is any aa, unknown, or other
MADVDEYRCFIGNLSWSTTDESLKDAFSKFGNLTEAKVVLDKFSGRSRGFGFVTFDEKQAMEDAIEGMNGLDLDGRNITVDKAQPQGPGRDRNGDRDYDRERGSRYERGRDYGGGRAPXVCGGXXXXXXXXLLXVVGNLVILLESAHLGMVGKGDNIGWEK

SEQ ID NO: 75804 - DNA, 906 bp, Zea mays
  misc_feature: Ceres CLONE 1560281
  misc_feature: Encodes the peptide sequence at SEQ ID NO. 75805
acccgcggtggcggccgctctagaactagtggatcccccgggctgcaggaattcgtctcacccctagaaaaaatcgctcatcacagataaatcttttttcccctccatttcatttcagcgtcgcgaaaaatggtagtcgttgatccgaaagccgtcgcctcggcgcaccagttcaccgtggtaatcgacggcgtcgagacgaccgtccacgagggcgtgctccggcgcaacggcggcacggtggccgtggtcggcccgggcgtcctcgaggtgagccgtctccagcacgtggtggtgcgcggcgggggcgggggcgacgtgcgcttctcccggtgcctgtacgcggccgccgaggactgcggcgcggcgtcgttccaccggtgcgacgcggtgcgccctggagggcgcccgcgccgtggccgtgcgccgctgccgctcggccgacgtggagcgcgcgggcgccgtggccatccgccgctgcaagggcgccgcgcgcgtccgcggcgccggggagctgcgcgtgggccggtgccgggaggccgacctccgagcgtgcgccgacgtctccgtggcccggtgacgcaccgcgcgcgcctaatggtggcgggcgcttcccctcgggaggtggggttccccccaatttagccgcttccggcaccgtggggcgtccaccggtgccggcgacgccatctttgcccgggggcgggaccctccagccgttggctgcgggtgagggtatcatgggggggaaaatgggacaaccgaatagtcgagtggaattttcggggagcaaactcctcttggtgcttaatcgggggggagaatgatgatttccatgtaccgcagatgggaactctattgcataaacgagaaacaggacggaattacacttataatttgttccgc

SEQ ID NO: 75805 - protein, 171 aa, Zea mays
  misc_feature: Ceres CLONE 1560281
MVVVDPKAVASAHQFTVVIDGVETTVHEGVLRRNGGTVAVVGPGVLEVSRLQHVVVRGGGGGDVRFSRCLYAAAEDCGAASFHRCDAVRPGGRPRRGRAPLPLGRRGARGRRGHPPLQGRRARPRRRGAARGPVPGGRPPSVRRRLRGPVTHRARLMVAGASPREVGFPPI

SEQ ID NO: 75806 - DNA, 849 bp, Zea mays
  misc_feature: Ceres CLONE 1560282
  misc_feature: Encodes the peptide sequence at SEQ ID NO. 75807
ctccccgcggtggcggccgctctagaactagtggatcccccgggctgcaggaattcgtctcacccctagaaaaaagctccgcctgcttttcctgccttcctcgtcctagtggctcccccggggttcgctcccgtaggcgcagccccccgaggctccattcctttcgccaggaggcgtgtgatgcccggcgatttgctattacagccccttgggactagggcaacaaagccaacgagtgatgcctaccgacggcatgagacaccaacaaatcaacggcgtcctcggcctctccctccagaatctccaggagatacagggaccagctctacaatgtacaatgacgaagctagtgactaggttatggaggtggagcacaaatacaatgagattcgcatacctccctctctcaagagggctgacattatcacgaccatcccggacttttggctcacgccctttatgagccatcctctctgaagtgagcttctgactgatcaggaccttaggatattcaagtacttatactcccttgatgtggatgattctcatgtttaggcacgatactcctttcatcttaacttctctgagaacccgtactttgaggactcaaagcttgcacagacctatctctttgctgatgatggaacaaccacgatactcgcttccgacattaactgcaatgaagagacgtgacctgcagatggaattgggattaactacgatgggtagttaccgggccatatttagacgaaagttttgttagctggtttgccgatacagagctacacagtcttgcttatggtgtgcaagatgacgggggctgagatcacaacagaagacttggtggct

SEQ ID NO: 75807 - protein, 38 aa, Zea mays
  misc_feature: Ceres CLONE 1560282
MEVEHKYNEIRIPPSLKRADIITTIPDFWLTPFMSHPL

SEQ ID NO: 75808 - DNA, 818 bp, Zea mays
  misc_feature: Ceres CLONE 1560284
  misc_feature: Translation starting site: 168
  misc_feature (499)..(499): n is a, c, t, g, unknown, or other
  misc_feature (507)..(507): n is a, c, t, g, unknown, or other
ggagctccccgcggtggcggccgctctagaactagtggatcccccgggctgcaggaattcgtctcacccctagaaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagccgtccgcggcgaagaagccggcggcgcaccctccctacgctgagatgattgtagaggcgatcgctgccctcaaggagaggaaggggtcgagctcggtggccatcagcaagtacgtcgaggggaagcacggcggcaagctccccaccaacttccgcaagcagctcaccgtgcagctgaagaagctcgctgccgcccngcagctgnacgaggtgaagaactcccttcagctgccgggcaccgacgtcaagccaaaggcgccaagcccaaggaatcaaagccgcgcccaaccccagccttcgccaagggcaaaggccaaacccccttcgaaatctcagggggctttcccccaaccccaagggcaaggcaagggccaaggccaaccctggtccttcttgcgccccggttgcccaaacccccgggggggccctcccaagggctccccaaaaccttccccccagggccctccccccccaaggggaacccaaaaaagggggttgtctcccttcccaaaagag

SEQ ID NO: 75809 - DNA, 846 bp, Zea mays
  misc_feature: Ceres CLONE 1560287
  misc_feature: Encodes the peptide sequence at SEQ ID NO. 75810
  misc_feature (374)..(374): n is a, c, t, g, unknown, or other
aaagctggagctccccgcggtggcggccgctctagaactagtggatcccccgggctgcaggaattcgtctcacccctagaaaaaacagcccaggctcgagactacaacgttacagcacaacacactgctgcacgtacatacgcagatagagaccagcagcaagctcgatcgagactcgagaggcatggggagtgtaccggaggagaaggcccagctgggcttcggcggcctggtgggcgacctgagggaggtgtacgagagcggcaggacgcagggcctggagtggcggcagtcgcagctcaggggcctcgtcaggcctcctggagcgagaaggaggaaagagaatctgtcgacgtgcgtccacgaaggaaccntgggggaagcacctgcgggcgaaggccctttcagaagacggagggtttgggggttcctgaaaaaaagttcccgtcggttcgaacaaaccctgccaaaaaaccctccaaaagaaaccggggggccgggcctttcccggaaaaaaaagggtttaaaaaaaggcccgggttttgggtttggcccttttcccccggggggaaaaaggggggccccttgtggtgggggggggcccccaaaaaaaaaccccccccctctctcggggggggggggccccccggggggcccccccccccccctttttttttttctcccaagggggggggggggggggagaaaaacacccccccccccccccacaaaaaaaaagggggggggcccgccaaaaaatattttctctttttgggaagagaaaaaaaaaacacaactttttttttttttttttgtgtggggaggggaaacaaacatcctcctccc

SEQ ID NO: 75810 - protein, 220 aa, Zea mays
  misc_feature: Ceres CLONE 1560287
  misc_feature (64)..(64): Xaa is any aa, unknown, or other
MGSVPEEKAQLGFGGLVGDLREVYESGRTQGLEWRQSQLRGLVRPPGARRRKENLSTCVHEGTXGEAPAGEGPFRRRRVWGFLKKSSRRFEQTLPKNPPKETGGPGLSRKKKGLKKGPGFGFGPFPPGGKRGAPCGGGGPPKKNPPPLSGGGGPPGGPPPPLFFFLPRGGGGGRKTPPPPPTKKKGGGPPKNIFSFWEEKKKTQLFFFFFVWGGETNILL

SEQ ID NO: 75811 - DNA, 799 bp, Zea mays
  misc_feature: Ceres CLONE 1560293
  misc_feature: Encodes the peptide sequence at SEQ ID NO. 75812
aaaagctggagctcaccgcggtggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgcccgcaacggcgtcaagttcggcgaggccgtgtggttcaaggccgggtcccagatcttcagcgagggcgggcttgactacctcggcaacccgagcctgatccacgcgcagagcatcctggccatctgggcgtgccaggtggtgctcatgggcgccgtcgaggggtaccgcatcgccggtggccgcctcccggggaggtggttcgacccgctgtaccccggcggcagcctcaaccccgctcgggctcgccgaccaccccggaagcgttcgcggagctcaaggtcaaggaaa

SEQ ID NO: 75812 - protein, 209 aa, Zea mays
  misc_feature: Ceres CLONE 1560293
  misc_feature (58)..(196): Pfam Name: Chloroa_b-bind Pfam Description: Chlorophyll A-B binding protein
MALTSRALVGKPATSTRDVFGEGRITMRKTAGKPKPAASGSPWYGADRVLYLGPLSGQPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVVLMGAVEGYRIAGGRLPGRWFDPLYPGGSLNPARARRPPRKRSRSSRSRK

SEQ ID NO: 75813 - DNA, 862 bp, Zea mays
  misc_feature: Ceres CLONE 1560294
  misc_feature: Encodes the peptide sequence at SEQ ID NO. 75814
tccccgcggtggcggccgctctagaactagtggatcccccgggctgcaggaattcgtctcacccctagaaaaaggataagccccttcctcagccgctcgttgcttctcagtccgacagaacagcacgtgaaagcccaggcctccctccctccctctccccacctgctggaatccgcggccgctgcctgcaagggtgaccttgcttgagcccgtcttccttcttcctcagctaggcacccgtgcccatcttcagtccacctagccatgcctacgacgatggcggcggcggcggcagcgtctgctccaagctcgctccgcgtttcgcgccaggggacgatcgggggaggccatgtcctctacagcaggtctcagagggctgccactgtctccgccagagcttccatgaacataacgtgctgcgcgaaccagacgcagacggcgcagcgcaagtcgtattcggggacgacctctccgccgtcaggttcagtgaaagagaaggtgaagccgaggctcgacgacgggggcgtcgggtttccgccgttccggttcgggggaggcggaggaggaggcggcggcggcggcagcagctcgtccggcgggttcatcctcttcgtggtcgtcctgctcctggattacctcagggagtcgagaggaccctgcagaacggccacggaggaagcggcggtggctacaacgaacgggctggcgcccacagtaagattcctctcttctttccccgtggggtgggtttgaattttttgaagaagaaccgggggcttacaactcttaccccaaccatgtgttttgcaagaaaatgcttccggtgggttccgttgggggtgtgattctcttctcctcttct

SEQ ID NO: 75814 - protein, 158 aa, Zea mays
  misc_feature: Ceres CLONE 1560294
MAAAAAASAPSSLRVSRQGTIGGGHVLYSRSQRAATVSARASMNITCCANQTQTAQRKSYSGTTSPPSGSVKEKVKPRLDDGGVGFPPFRFGGGGGGGGGGGSSSSGGFILFVVVLLLDYLRESRGPCRTATEEAAVATTNGLAPTVRFLSSFPVGWV

SEQ ID NO: 75815 - DNA, 851 bp, Zea mays
  misc_feature: Ceres CLONE 1560296
  misc_feature: Encodes the peptide sequence at SEQ ID NO. 75816
acccgcggtggcggccgctctagaactagtggatcccccgggctgcaggaattcgtctcacccctagaaaaagaccaacccagtgcaccacacaaggcattgtcagcggcggcggcggcggcgggccggcggagactcccaggccaggagcagtctgccgattggaaggggagatgaaggccacgctcaagggccgctacgagggcgacaaggccacggccgccaccaccctcgccgcccccgccggcgacctccgcctcaaggcctccgccaccgaggccgccttcaccaacggtccttccctgcgaggcctcaccctcaccctcgagaagcccggcgccttcctcgttgacctcaagccccacaaccaggatgtgcgctttcagttcatgaactccgcgctcgtgctcgacaagcgcgtcagcctcacctacactcactccactagcctcgccgcggcccccgccgccgcgccgccctcccgcaccgcgctcgactgcaccgtcactttcgaccccgccaacaaggtcagcctctcccactcgctaggctccggcggctgccgcctcaagtacacctacgcgcacggggtcgaccgcctcaccaccatcgagcccctcttcgacccaacaagaacgcatgggagttcgccatcaccaggaagttcgccggaggggacgccgtcaagggcacctaccaggcctccatcaagctgctcggcctcgaggggagcagggaatctctcggcggcggctcccttcaggttgccgacaacattccattttgtcggaccaagccaagcccccaaaccttatagctaaaaggccccgggaacttccgtaattttgaaa

SEQ ID NO: 75816 - protein, 215 aa, Zea mays
  misc_feature: Ceres CLONE 1560296
MKATLKGRYEGDKATAATTLAAPAGDLRLKASATEAAFTNGPSLRGLTLTLEKPGAFLVDLKPHNQDVRFQFMNSALVLDKRVSLTYTHSTSLAAAPAAAPPSRTALDCTVTFDPANKVSLSHSLGSGGCRLKYTYAHGVDRLTTIEPLFDPTRTHGSSPSPGSSPEGTPSRAPTRPPSSCSASRGAGNLSAAAPFRLPTTFHFVGPSQAPKPYS

SEQ ID NO: 75817 - DNA, 861 bp, Zea mays
  misc_feature: Ceres CLONE 1560297
  misc_feature: Encodes the peptide sequence at SEQ ID NO. 75818
  misc_feature (76)..(76): n is a, c, t, g, unknown, or other
  misc_feature (346)..(346): n is a, c, t, g, unknown, or other
ctccccgcggtggcggccgctctagaactagtggatcccccgggctgcaggaattcgtctcacccctagaaaaaanaaacccacagcagccgctagccgtacgatggcggacaccggtgacgtcgccgccgccgccgaggcctcggcgcgaccggcgggcagcagcagcacccagccgctggcggggcgcgtggcgatcgtgacgggcgcgtcgcggggcatcggccgcgccatcgccacgcacctgtcctccctcggcgcgagcctggtgctgggctacgcggcgcgcgccgacaaggcgggcgcgctggcggcgtcgctcccgcgcgcggtggccgtgcgggcngacgtctcggaccaggccggcgcgcggtcgctctttgacgcggcggacggagggcttcgggggggcgccacatcctggtggccaacgcccgggggtgctggacaaaacctaacccccggccggggcccgggaccgccccaccgaggggctttaaacccgggtggttccccggtgaaaccttgggcggggggggtttccctgtgggcctcccggggaggggggggaaaaaacgcctcttcgccccggggggggggggggggggggccactttttcccccgggaagtcccttctcccgggggggggggggccccccccccccgcgggtttctgggggggctcacaacgggggttccaaagggggggggggtgaaagagccttttttgtgggaaaactttgtgccaaaaagaaatttggggggggaccccccttttttgaggaaaaaatatagtttttttcccccccgggggggcgccccccccccaaaaatatttttttttttctgtggggaggaag

SEQ ID NO: 75818 - protein, 230 aa, Zea mays
  misc_feature: Ceres CLONE 1560297
  misc_feature: SWISSPROT Homolog: EC 1.1.1.100 3-oxoacyl-[acyl-carrier-protein] reductase
MADTGDVAAAAEASARPAGSSSTQPLAGRVAIVTGASRGIGRAIATHLSSLGASLVLGYAARADKAGALAASLPRAVAVRADVSDQAGARSLFDAADGGLRGGATSWWPTPGGAGQNLTPGRGPGPPHRGALNPGGSPVKPWAGGVSLWASRGGGGKNASSPRGGGGGGPLFPPGSPFSRGGGGPPPPRVSGGAHNGGSKGGGGERAFFVGKLCAKKKFGGGPPFFEEKI

SEQ ID NO: 75819 - DNA, 1020 bp, Zea mays
  misc_feature: Ceres CLONE 1560298
  misc_feature: Encodes the peptide sequence at SEQ ID NO. 75820
acccgcggtggcggccgctctagaactagtggatcccccgggctgcaggaattcgtctcacccctagaaaaaaacacaaagccaaagcgcagcgcagccagagtaagcagagagttgcacttggggaaaaaattaccgtgcttcttcagttcttcttcctagcatgcactcgcttgtgaggcgtggcaatggctacggctacggctatggtggttacggcagcagcaatccccatatgaactaccaccgccaaaacaccgagtccgtgaccaccgtcgtcacggagatgaaccgaatggccgtcgacgacaagccctgctacggcggcggcgtgcaaaagcaggcctgcaaggtggaggcgttccaggagcacgacgaagcgtacaaggccccccctggtggtgcaaaaaaagcattcttcctattatcgaggagaatgatgatagcgtgctcccccagccgcacgccgaaggagatagttcgcgccgtagaaccggatatgcgaggaatacggcggtttatgtcgttacagctctgcaggatcatcgacgatgccgtagtagtaacccatgtgaatggacagtagcacccacttccagtgctatcgctatgcgaggtcttcatttgtgctctcatacgcagaataaattcacacgtagatgaacacccaccctacaatatgatgacgttaagtaagacaccttccaacggggcaccatatagaaaaactcagctaaaaatgacaaactatccgatattggaactgcgatgtacatatataaatctacgacaagcaaccgctgtattttcgagtctctatagtcaagggataacctattccacttggtaacgacaaatccacaatcatactagtagtggagcgtcaatgaaacttgtccctactaatctaaacgggaagtgctcgaacagaaatacccactattgcgccctactcgttcctgacattatgctatcaatcagtcaaccacctgtatcatacaacatatcaataccgatcaa

SEQ ID NO: 75820 - protein, 140 aa, Zea mays
  misc_feature: Ceres CLONE 1560298
MHSLVRRGNGYGYGYGGYGSSNPHMNYHRQNTESVTTVVTEMNRMAVDDKPCYGGGVQKQACKVEAFQEHDEAYKAPPGGAKKAFFLLSRRMMIACSPSRTPKEIVRAVEPDMRGIRRFMSLQLCRIIDDAVVVTHVNGQ

SEQ ID NO: 75821 - DNA, 618 bp, Zea mays
  misc_feature: Ceres CLONE 1560299
  misc_feature (222)..(222): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
tcccgcggtggcggccgctctagaactagtggatcccccgggctgcaggaattcgtctccccctagaaaaagtcctattcgcaaccgccgtcgccttcgcccggtcggcccacccaatcccgtccctatcgctctccatcgtctctcccatcagcacgcagctgtacccgtacgcaactgcgacaggtccacatcgcggcggcccactcacccccccagcgnccccagcgactggccgactggctgttcccatgggcggacggcgaacgggccccgggcgggccaaagggggaaaaccttccccgggaaaccttccccccaagcgggggcgtttccaaaaaaaaaggggggcctcccccccccaaagagaaaggggggggccaaaaggggggcttttttctttttttttttggggggggaaaaggggaaaaaaaccttttttttaaaaaaacacccccccggggaaaaaaaaaaaaaaaaaatttttccccccccccccccttttggggggggtttgggggcccaaaaaaaaaacccccctattttttccccccacaaaaaaaaaaaaannngggggtgtgttttgtgttgtgggagggcccccccccccttggtttg

SEQ ID NO: 75822 - DNA, 840 bp, Zea mays
  misc_feature: Ceres CLONE 1560302
  misc_feature: Encodes the peptide sequence at SEQ ID NO. 75823
  misc_feature (664)..(664): n is a, c, t, g, unknown, or other
  misc_feature (689)..(689): n is a, c, t, g, unknown, or other
ctccccgcggtggcggccgctctagaactagtggatcccccgggctgcaggaattcgtctcacccctagaaaaaacttcacttacgagtattctctatcagcgcgattcgatgatggccccaccgatatccgccgatgacttggtggaggctgcctcggccgtccccgcgtacccagccttcgcgcctaacagaatgctttgcaaggacgcgccggcgccggtcatctctgtcgtctccaagcacacggtccggcccgccggagcgtcagcggcgggcggcagtggagacctcaggctctccgtgtccgacatgccgatgctatccgtgccagtacatctggaaggggatgttcttctcgacgcctcctcccggcgtgatgacggccacactcgtgtcgtctctcgtggcggcgctctcccgcacgctcggcgtcttctgcgtgctcggcggccgactcttcacgctccggtactacagcatcctgatacgatgcagcggccacaacgccaccatcgagttctaccagactgtggcgccttctctgtcgctctgttacttcctggtgccggcgcccacgtgccgaccgattgacgacggcctgttctccatagaccggaggtgagctaggaggccatcgtcgacagctcaggctgtccacctcncgtgctctgcacggcaccgtgttcnacggcttcaatctcaaccccaccgtcgaggacgggaactacgtactggactacgtaagacggggtggggggcttttcccgggctttcctgatccggaaaacgtacttccggcaggagcttctttgacaaattcctgcaccatcttacttat

SEQ ID NO: 75823 - protein, 162 aa, Zea mays
  misc_feature: Ceres CLONE 1560302
MTWWRLPRPSPRTQPSRLTECFARTRRRRSSLSSPSTRSGPPERQRRAAVETSGSPCPTCRCYPCQYIWKGMFFSTPPPGVMTATLVSSLVAALSRTLGVFCVLGGRLFTLRYYSILIRCSGHNATIEFYQTVAPSLSLCYFLVPAPTCRPIDDGLFSIDRR

SEQ ID NO: 75824 - DNA, 850 bp, Zea mays
  misc_feature: Ceres CLONE 1560303
  misc_feature: Encodes the peptide sequence at SEQ ID NO. 75825
ggagctcaccgcggtggcggccgctctagaactagtggatcccccgggctgcaggaattcgtctcacccctagaaaaagacgtccttggcgttgtgtcctcgtcctcgtgcccatctctgtcccaatcaaactgattgatccgtcgcccgcagggccacagcagccgcggcgaggtcgtccgtcggattcggaagctcagttattactgaaaagataatacagtacctatggcttctctggacgccgtgcgaggagacctcgccctgctgattctgtacctgaacaaggccgaggcgcgggacaagatctgccgagcgatccagtacgggtccaagttcatcagcaacggcgagccagggcctgcgcagaacgtcaacaagtccaccagccctgcccccgaaaggtgttccggctctgtaaagttggtaaaccatctgccccccttctaataaacccctcctggcgagggggaacccccctccccgctgaatcctacttggggaaagtccaaaaaacccgatggctggcgaattttccctcctccctggaaccaaatctgggggggccgggggaggacccccccccccccccaaaaacagggggggggggggggaaggtttctcccggggaggaaaagacgttttctaccgtgtgttccctcgggggtcccaaaaacacttgacggtgggagcccccccacccccccccatgcccccaaacggttggcgacggggggtttgtcccactcggtcctaaataaaacaaaaaaactctgtgagagaaggggttgctttatacgcactcacccctgaagagttgttgttttactaataaaaacggaagggtagg

SEQ ID NO: 75825 - protein, 73 aa, Zea mays
  misc_feature: Ceres CLONE 1560303
MASLDAVRGDLALLILYLNKAEARDKICRAIQYGSKFISNGEPGPAQNVNKSTSPAPERCSGSVKLVNHLPPF

SEQ ID NO: 75826 - DNA, 911 bp, Zea mays
  misc_feature: Ceres CLONE 1560305
  misc_feature: Encodes the peptide sequence at SEQ ID NO. 75827
ctccccgcggtggcggccgctctagaactagtggatcccccgggctgcaggaattcgtctcacccctagaaaaactgttgtctctttcacttgctccgcgccggcatcctccccccttcgccgccaccgcgatcttgttctcagttctacggcggcgatacccccctccactccccaccctgtcacccccacaaaataagttctgcggcggcgatggcgctctcctcctcccggccgaagcacctcctgcgccccatcctgcggggtttccacgcctcagcgcgggccctggcgcgggtggagccgcacgagttctccaagcccagcgagtacctgggcagctgggagcccgcggcggagcctcgggaggcgtgggcgcggctggaccggctgctccccccgtacgcgagcgaggtgcgggagctgcggcggcagtacgcctacgaggtgcagctgttgcaggccgagcggcagcggaaggccgacgccagagccgaggccgcccgcgccgccaaccaggagcgcaaggccgccaagctcgccgccgcccagacgcgcgccgccgagcgccgcgcgttcgaggaggacttccgccagaccctcatgaaagaaagagctgagaagctggagagctggccggaagaaggagaagcgcaaagaggagaagaaaggcaataaagaaggagctcctgccccaggaaaagcaccatgtgggctttcttgaagaaaaggattgaagaacaaataccaaactggctttcagtgcaaaccaactccctcttttaaaggttgggtttctgcccaaggaaaaacttgaataatataggaggccttgccggaattcatgtagagagaggggggggtgtgtgcaatctcacacatggtgaacacgagctctcggctctgtttcc

SEQ ID NO: 75827 - protein, 154 aa, Zea mays
  misc_feature: Ceres CLONE 1560305
MALSSSRPKHLLRPILRGFHASARALARVEPHEFSKPSEYLGSWEPAAEPREAWARLDRLLPPYASEVRELRRQYAYEVQLLQAERQRKADARAEAARAANQERKAAKLAAAQTRAAERRAFEEDFRQTLMKERAEKLESWPEEGEAQRGEERQ

SEQ ID NO: 75828 - DNA, 833 bp, Zea mays
  misc_feature: Ceres CLONE 1560307
  misc_feature: Translation starting site: 332
  misc_feature: Pfam Name: G10 Pfam Description: G10 protein
tccccgcggtggcggccgctctagaactagtggatcccccgggctgcaggaattcgtctcacccctagaaaaattccccagatctggtggggaagaaccctacctcacgtcccggatcccatctggcggccaaggggagttacacgctagccggcggtcggacagccgccgccaaccgcctcagccccaacagtcgcaccgccgccgccgaggcaaactcgaagccacccccgccgccgcagccacagccgcgccgagcttgagccgtcgttgctccgctgaatcgcccccatcgtctctcctgaagagagaggacatttattgagacagcatgcctaagataaagacaagtcgtgtcaagtatcctgaaggatgggagcttattgaaccaaccatccgtgagttggatgccaaaatgagagaagctgaaaatgatccacatgatggaaagagaaagtgtgaagctctctggcctatttttcgtatttctcatcaaaggagccgctacatatatgatctttactacagaaggaaggagatatcacgggagctttatgagttttgcctggaccagagctatgcagatcgtaacctgatcgcaaagtggaaaaaccaggatacgagcgcctttgctgcctccggtgcatacagacacgtgaccacaactttgcaacgacttgtgtctgccgagtccccaagcatctgagggaggagcaagtgatagaatgtgtccattgccgctgcacgggttgtgccagccgtgactaatcttgtcatcatgatgatgggctcacgactcatcatcacaatcctaccacattagggcttgttcc

SEQ ID NO: 75829 - DNA, 791 bp, Zea mays
  misc_feature: Ceres CLONE 1560308
  misc_feature (372)..(372): n is a, c, t, g, unknown, or other
  misc_feature (376)..(376): n is a, c, t, g, unknown, or other
  misc_feature (392)..(392): n is a, c, t, g, unknown, or other
  misc_feature (399)..(399): n is a, c, t, g, unknown, or other
aaaactggagctccccgcggtggcggccgctctagaactagtggatcccccgggctgcaggaattcgtctcacccctagaaaaaatagcgtcgtagtcctagtcaccgcgttcgcttcccgagcacgcaaccatggctcgactgtcagccaccgccgcgctcctcctcctcgtcctctccctcctcgccgtcgcgcactgcggtgccctcgcagtcgcagcagagcacgacaccgagcccgaatcaaccgccgccgtggccgtcgcgacgaaacgtgctatcgactccacgtcacgctgaggcgggcaccgccagcgccactgaagaggaaggctatccgggcgagcagcagcagcatgggttcgaactccntcgnctgccgtctcacgggntccaccnacaccaccaacctctgggtgaaacgccaccaccgggatctaccgtgaccccgtccaacaaattccctttgttctggcccacgggccccaaagcccccaaacagggaaagaagcccccctttggccacactttgcccccccacccccaaaaaaaggggccccaagaaaaacccgggggaaaaaaaaaaaacccccttggggccaaaaccccgggaaccccggaaaattcttcctcctcccccccgaaaaaaccccaccaaaaaaaagggggggaagggggggggtttttttataaaggggggggaaaaaagccccctcccccctttttttccccaacacccccccacaaagggggggcaaaaaaaaaaaaaaaaaaaaaaaatgcggccgggg

SEQ ID NO: 75830 - DNA, 859 bp, Zea mays
  misc_feature: Ceres CLONE 1560309
  misc_feature: Encodes the peptide sequence at SEQ ID NO. 75831
  misc_feature (780)..(780): n is a, c, t, g, unknown, or other
aaagctggagctcaccgcggtggcggccgctctagaactagtggatcccccgggctgcaggaattcgtctcacccctagaaaaaacacagctcagctcagcccagcctccctttcccttgaagcctctccaccaacccaaagtcacagagacagagaggaccaaggcaggcagccgtcagcgagccagctagccagccatgggcaaggactgcggcaaccacggggacgatgacttccggcagtcatgccggcgcctgctggccatcctgctgaccatggcgctgctggtgggcgtcgtggcgctgatcgtgtacctggtgctccgccccacgcacccgcgcttctacctgcaggacgcggcgctgcggcagctggacctgagcaacggctcggccccgctgctgtccacggcggcgcaggtcaccgtggcgtcccgcaaccccaacggccgcgtcggcgtctactacgaccgcctcgacgtctacgccacgtacaagtaccagcaggtgacgctggcgtccaggctgcccgcggtgtaccagggccacggcgacgtcgacgtctggtcgcccgtgctggccggccccgccgtccccttcgcgcccttcctcgccgacgcgctcgcctaggaccctcgcgcggggtacctcgtcctgcagctcaggatcgacgggagggtccgctgggaagtcggcagctgggtgtcgggccactaccacatgttcgtcaccctgcccggctactttatcagcttcgggcgcggctcccgctaccggcgncgctgtcggcgcgcaacgggctcaggttccagaacacctacgtactggcccgcgtcgaaggtctagactctaagcgagc

SEQ ID NO: 75831 - protein, 143 aa, Zea mays
  misc_feature: Ceres CLONE 1560309
  misc_feature (39)..(143): Pfam Name: Hin1 Pfam Description: Harpin-induced protein 1 (Hin1)
MGKDCGNHGDDDFRQSCRRLLAILLTMALLVGVVALIVYLVLRPTHPRFYLQDAALRQLDLSNGSAPLLSTAAQVTVASRNPNGRVGVYYDRLDVYATYKYQQVTLASRLPAVYQGHGDVDVWSPVLAGPAVPFAPFLADALA

SEQ ID NO: 75832 - DNA, 837 bp, Zea mays
  misc_feature: Ceres CLONE 1560316
  misc_feature: Encodes the peptide sequence at SEQ ID NO. 75833
aaagctggagctccccgcggtggcggccgctctagaactagtggatcccccgggctgcaggaattcgtctcacccctagaaaaagtcggagtaggcgggcggcatgctgcaggccagctcggagaggccggcgggcctgctgtgggtgcccgggacgagcccgtggccgacgatggacgcggggccgtcggcgagggcgcagtgatcgcgcggcggcgggaggagatgctggggatgctgcgcgacctcccggagtccgagtacgagctctcgctcaccgacctcgtcgagaaggccggggccgaagccgaagccgaagccgaagccgcgcccgcgaccgcccccaccaaggcagaggacgggaaggacccgggcgccgcgcggtcggcggcagctgcggggaggcacgagcggagggcgtcggcgcggcagcggggcagcggcgggagcagcttccgcagcagcagcgacggcgtcctgctcaacttctacatgccgcgctcgctcacccgcagcttcaccgcgccgcgacccgcccggacgccgtcgttcgcctccggctgccggagccccagcgtcgcatccgactgcaacaaagatggagagggacccggacgccgagaccgtcaagtgctggtcgttgctgtggggatcggcggtggcgaaagtccagccggcgggacccgcgcgcgccgcccagcgtaggcgagtccgcctttccgcgccgcgtcggcagccatgcctcaaggcgggcaagcactccccttcggcgacctatacatgagctggccggatgcgttgctgctgtaccaacccttggtgtctgtctgtacatat

SEQ ID NO: 75833 - protein, 234 aa, Zea mays
  misc_feature: Ceres CLONE 1560316
KAGAPRGGGRSRTSGSPGLQEFVSPLEKVGVGGRHAAGQLGEAGGPAVGARDEPVADDGRGAVGEGAVIARRREEMLGMLRDLPESEYELSLTDLVEKAGAEAEAEAEAAPATAPTKAEDGKDPGAARSAAAAGRHERRASARQRGSGGSSFRSSSDGVLLNFYMPRSLTRSFTAPRPARTPSFASGCRSPSVASDCNKDGEGPGRRDRQVLVVAVGIGGGESPAGGTRARRPA

SEQ ID NO: 75834 - DNA, 910 bp, Zea mays
  misc_feature: Ceres CLONE 1560318
  misc_feature: Encodes the peptide sequence at SEQ ID NO. 75835
gcggtggcggccgctctagaactagtggatcccccgggctgcaggaattcgtctcacccctagaaaaagtcagggcctcttgatcatcagtcgccagaggagctgttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacaaggcgaccggggaggccatcaagcactcgctggggcagtcccacccggtgcgcctggtgccctacaacccggacttcctggacgagtcggagctgtggacggagagccgcgacctcggcaacggcttccgctgcgtccgcagggtcaacaacatctacctcaacttcgatgcccttccacgggaacaagtgggaccggcggcgtccgtgaacggcaccaaaagtcgttgcttttgaaggtggttctgaggggcaaacacccatctcctgggaaagattccgggcccttactaccgggaaacaaacgggaagagaattggaaccattcgcggccccattcgaattgtggctacatgggagtgtcaataccgtacctagagtacagaaatagccagggggtgttcttaatcctccc

SEQ ID NO: 75835 - protein, 190 aa, Zea mays
  misc_feature: Ceres CLONE 1560318
MDGGYYGGRDQRYSGGYYGGGGIATPGYAPAVPYGMSQVNIEGNGCGRALPPQPTVKVYCRANPNYAMSVRDGKVVLAPANPKDEYQHWIKDMRWSTSIKDEEGYPAFALVNKATGEAIKHSLGQSHPVRLVPYNPDFLDESELWTESRDLGNGFRCVRRVNNIYLNFDALPREQVGPAASVNGTKSRCF

SEQ ID NO: 75836 - DNA, 843 bp, Zea mays
  misc_feature: Ceres CLONE 1560319
  misc_feature: Encodes the peptide sequence at SEQ ID NO. 75837
  misc_feature (804)..(804): n is a, c, t, g, unknown, or other
  misc_feature (806)..(806): n is a, c, t, g, unknown, or other
  misc_feature (838)..(838): n is a, c, t, g, unknown, or other
  misc_feature (840)..(840): n is a, c, t, g, unknown, or other
ctccccgcggtggcggccgctctagaactagtggatcccccgggctgcaggaattcgtctcacccctagaaaaatagaaaaaccaattctctatgtgaagatgcaaattgcagctattaatcttgagaaaggaaacaaaaaagagtgcaagaatttgttggaagatgggaaaaccactctggatagtatgactgatgtcgatcccacagttcatgctagcttttactggatatcatctcaataccacaaggcctgccaagaatttgcagagttctataagaatgctcttctctatctggcctacacaactgtggagtctctatctgagtcattcaagctagacttggcttttgatctatctctagcagccttgctgggtgataacatttacaactttggggagttgttagctcacccgattatcaatagtcttattggaactaaggtggagtgggtttatcatatgttacaagcattcaacagcggcaaccttgccctctaccaagaactttgcagggttcacaatgctgctcttactgcacaaccagctttggtgcagaatgagcggaagctgcttgagaaaatcaatattctttgtctgatggagataatctttagtcggccatctgaagatagaactattccattaagtgttattgctgagcggactaagctttcaatcagtgacgtgaaatgtcttcttatgaagagcctctcggttcatcttattgagggaataattgatgaagtggacagtacagttcacgtatcatgggtccagcctagagtgcttggaattcacangntaaggctttgcgcgactcgctggatgctgggntngaa

SEQ ID NO: 75837 - protein, 246 aa, Zea mays
  misc_feature: Ceres CLONE 1560319
  misc_feature (117)..(225): Pfam Name: PCI Pfam Description: PCI domain
  misc_feature (235)..(235): Xaa is any aa, unknown, or other
  misc_feature (236)..(236): Xaa is any aa, unknown, or other
MQIAAINLEKGNKKECKNLLEDGKTTLDSMTDVDPTVHASFYWISSQYHKACQEFAEFYKNALLYLAYTTVESLSESFKLDLAFDLSLAALLGDNIYNFGELLAHPIINSLIGTKVEWVYHMLQAFNSGNLALYQELCRVHNAALTAQPALVQNERKLLEKINILCLMEIIFSRPSEDRTIPLSVIAERTKLSISDVKCLLMKSLSVHLIEGIIDEVDSTVHVSWVQPRVLGIHXXRLCATRWMLG

SEQ ID NO: 75838 - DNA, 907 bp, Zea mays
  misc_feature: Ceres CLONE 1560323
  misc_feature: Encodes the peptide sequence at SEQ ID NO. 75839
  misc_feature (9)..(9): n is a, c, t, g, unknown, or other
  misc_feature (15)..(15): n is a, c, t, g, unknown, or other
  misc_feature (16)..(16): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (39)..(39): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (53)..(53): n is a, c, t, g, unknown, or other
  misc_feature (56)..(56): n is a, c, t, g, unknown, or other
  misc_feature (60)..(60): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (71)..(71): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (118)..(118): n is a, c, t, g, unknown, or other
  misc_feature (180)..(180): n is a, c, t, g, unknown, or other
aaaaaaatntttttnntttnnntttnnnnnnnnnnnntnttnnnnnnnnnttnttnatanaataannnacnaannnnnnnnnncccannnnnnnnaaaaaagctgggaacctccaccncggtggcggccgctctagactagtggatcccccgggctgcaggaattcgtctcacccctagnaaaattccgcaccgccgcctcgccatggaggcagctgccgccgccttcttgtcccctccccgcgtcgccctcgacgcccgcacactctttctccccgcccccgttggctcccccgtctcggccctcatcccagcctccgcccttggttgtttgggccccggggcgcttcggccgggggccaaaccccgggggttccctgaaaaccccccctcaaaaaaaaaccccccctttaaaagggggggtttccgggggccccaaggggaaaaaatcccctcccccccaaaaggggggggggccccctttttcctctaaaaggggggggggcccccccctttgggggaaaaaaaaaccccccctcccccccggggaaaaattttttgcgccccccccttttttttttttaattaataaaaaaaaaaaaaaaacccgcgggggaaattttttttgggcgccccacccccggtttagagagaaaaataaatattttccccccccccccttatttctccaccccacggtggggcggcccccccgggcagaggggggcatatttttttttttctcttcccccccccacaaaaaaagaataatattttttttttttatccccccccccccccccagtgttttgtaaaagtaaaaaaagaacccaccccccccccgtagaaaaagaaaaaacaccaccccgccccctcctctcacaataggttttgttgtgtctacacca

SEQ ID NO: 75839 - protein, 95 aa, Zea mays
  misc_feature: Ceres CLONE 1560323
MEAAAAAFLSPPRVALDARTLFLPAPVGSPVSALIPASALGCLGPGALRPGAKPRGFPENPPSKKNPPFKRGGFRGPQGEKIPSPPKGGGAPFFL

SEQ ID NO: 75840 - DNA, 854 bp, Zea mays
  misc_feature: Ceres CLONE 1560326
  misc_feature: Encodes the peptide sequence at SEQ ID NO. 75841
  misc_feature (768)..(768): n is a, c, t, g, unknown, or other
  misc_feature (769)..(769): n is a, c, t, g, unknown, or other
  misc_feature (777)..(777): n is a, c, t, g, unknown, or other
  misc_feature (778)..(778): n is a, c, t, g, unknown, or other
ccccgcggtggcggccgctctagaactagtggatcccccgggctgcaggaattcgtctcacccctagaaaaaaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgtcggccgccccccgccggctagctagctagctagctcctgcgtgagctagtagctagtgccatgcgtcgtctctgtcgttcggttttgcttcgggtcaccgtgtaccctttgnnctgctggnnttctcttttccctttttcccttttttttcttctttccccggccatgggtcctttgcttttcagcagttctctgctg

SEQ ID NO: 75841 - protein, 170 aa, Zea mays; identical to SEQ ID NO: 73892
  misc_feature: Ceres CLONE 1560326
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase

SEQ ID NO: 75842 - DNA, 817 bp, Zea mays
  misc_feature: Ceres CLONE 1560329
  misc_feature: Encodes the peptide sequence at SEQ ID NO. 75843
  misc_feature (44)..(44): n is a, c, t, g, unknown, or other
  misc_feature (399)..(399): n is a, c, t, g, unknown, or other
agctccccgcggtggcggccgctctagaactagtggatcccccngggctgcaggaattcgtctcacccctagaaaaactcccacgcactccgcaattccgcatcacgcaccccaccccaccgcccgcaaccgcaagctcagattccctcccaccccaccccaccgtcccgctcactccagcccagcccgcgtccccacagcccagcgacagcgagcaccggcggcatccagccatgtgcggcggcgccatcctgtcggacatcatcccgccgccgccgccgcggcgtgtcacggcgggccacctctggcccgagagcaagaagccgaggagagctgcagccggcaggaggagagcccccgtggagcaggagcaggaggaggaattcgaggccgacttcnaggaagtcgaggtggagtccggcgagtcggagctcgagtccgaggacgagcccaagccaaggcctttcgccgcccccagcagcgcggctcgccagaaggggaactaaaccctggggcagctggtggccaatgggccctggctgcaaattccctttaaagggaaaaaggaaaaaacccgtttcgggggggatccccccgggcccccccgggggggaaaaaaggggctccttaaaaaaaaaaaaaacccccccaaaggggggggggcggcctctgggggccggggaaaatttaaaaacctccccccaaaaaaaaattccccaaaaaattttaaaaccccccgagggcgccccccggggtaccccccgggcggaaaaaaggggttaaaaaccccccttctccccccggaagaagaggtgtc

SEQ ID NO: 75843 - protein, 90 aa, Zea mays
  misc_feature: Ceres CLONE 1560329
  misc_feature (56)..(56): Xaa is any aa, unknown, or other
MCGGAILSDIIPPPPPRRVTAGHLWPESKKPRRAAAGRRRAPVEQEQEEEFEADFXEVEVESGESELESEDEPKPRPFAAPSSAARQKGN

SEQ ID NO: 75844 - DNA, 876 bp, Zea mays
  misc_feature: Ceres CLONE 1560330
  misc_feature: Encodes the peptide sequence at SEQ ID NO. 75845
  misc_feature (876)..(876): n is a, c, t, g, unknown, or other
ctccccgcggtggcggccgctctagaactagtggatcccccgggctgcaggaattcgtctcacccctagaaaaagatctcgcttagaattcgtgtaccagaaaccccggccctaaccgcgcccgcaccctcgcccttggctcgccggagattaacgctacagccgtaatcacgtaaattccttttcatggagggtgtgggcgcgcggctagggcgcacttcggcgcgctacgggccggcgacgacgttcacgggccatgtcaggaagtggcgcaaggagtgggtaccagtggtcgccgccgccgccgccgccgccgccaacgccaacaccagcgccaacggtggcacgacgtcctccacggggatgggatctggcggaggatcccgcgggaataatcttctcctgtttaagtggaccccggtgaacggggctaacgggggaggaggggatggggagcagcagcagcaggctgagacggccacgagacgccggcggtatgtgccggtttctttaatggaagagcaaaggcaagaatctaccaaatctgatgatgagaacaaagctaatgatggagatccatcttcgaatgaaactgagccatcaaatggaaagactgatatcaatgatacacctatggatgaatctcaggcaacagatgaggatggtcgaaattctggaaaaacggccgggggaacaaactaaatttaatttaggtttgaaagacccggaagggggaaatgagagttgagactccgaagaaacatgttgcgggaaaacaatccccaaacagagaaataattccaaaaggaaatccgtaacccctggacctttgaaaggaaaatggtcaccccaaaaattttcttttggtccttaatn

SEQ ID NO: 75845 - protein, 171 aa, Zea mays
  misc_feature: Ceres CLONE 1560330
MEGVGARLGRTSARYGPATTFTGHVRKWRKEWVPVVAAAAAAAANANTSANGGTTSSTGMGSGGGSRGNNLLLFKWTPVNGANGGGGDGEQQQQAETATRRRRYVPVSLMEEQRQESTKSDDENKANDGDPSSNETEPSNGKTDINDTPMDESQATDEDGRNSGKTAGGTN

SEQ ID NO: 75846 - DNA, 886 bp, Zea mays
  misc_feature: Ceres CLONE 1560331
  misc_feature: Encodes the peptide sequence at SEQ ID NO. 75847
  misc_feature (361)..(361): n is a, c, t, g, unknown, or other
  misc_feature (363)..(363): n is a, c, t, g, unknown, or other
  misc_feature (369)..(369): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (808)..(808): n is a, c, t, g, unknown, or other
  misc_feature (851)..(851): n is a, c, t, g, unknown, or other
ctccccgcggtggcggccgctctagaactagtggatcccccgggctgcaggaattcgtctcacccctagaaaaactgcaggaactggcgccgacgaccgcggcagaagaagcagcgggtccctcccccgcccctctcaacgtggagtacctggccgccgagttcgccggccacggcgtcagcttcgagcccgtgggcgtcagctgcgccgtcaagatgtcgctgcgcaacggcagcgtggcgcacgtgctgctccccagcgggctcgtcacgtcctacaagcccgccatgtggcacggcacggtcacggaggttctccacacgaacgtcgccgaggtcccaggcgggcgggccctcatccncngcggcntgttcctggaccttcctttccataggtttcaacggcgtatggtcgcccagcgccagacggggggggggggttctctccccaactttccggggaagccccacccacctcccctaaaggggtgaggtttttcttttaaccgggcccgggggaaaaccagcccccccccaagggggggggggtggagcctcccccccccccgaaaaggcttttgcccccggaattccccggggggaaaaaaaaaaaaaaaaatgggggggggggggggtcccccccccacggagggggggaagggaggtaaattgggcccgggaacaaaaactcttggggggggggaaaacccgggaaacccccaaccccccctttggggtggggggcgccgggggtgcccacaacaccccaaacccggggggggaacaccccccgctcgctccgggnnnanaggaaaaaaaaaaaattctccccccccccattaaatgaggggntctgcggggggggccggatttagaggaggagaaaa

SEQ ID NO: 75847 - protein, 162 aa, Zea mays
  misc_feature: Ceres CLONE 1560331
  misc_feature (120)..(120): Xaa is any aa, unknown, or other
  misc_feature (121)..(121): Xaa is any aa, unknown, or other
  misc_feature (123)..(123): Xaa is any aa, unknown, or other
PRGGGRSRTSGSPGLQEFVSPLEKLQELAPTTAAEEAAGPSPAPLNVEYLAAEFAGHGVSFEPVGVSCAVKMSLRNGSVAHVLLPSGLVTSYKPAMWHGTVTEVLHTNVAEVPGGRALIXXGXFLDLPFHRFQRRMVAQRQTGGGGSLPNFPGKPHPPPLKG

SEQ ID NO: 75848 - DNA, 846 bp, Zea mays
  misc_feature: Ceres CLONE 1560332
  misc_feature: Encodes the peptide sequence at SEQ ID NO. 75849
  misc_feature (814)..(814): n is a, c, t, g, unknown, or other
ctggagctcaccgcggtggcggccgctctagaactagtggatcccccgggctgcaggaattcgtctcacccctagaaaaaaaaaaaaaaaaaaacctttcttggagacaccgctcaggcgccattcttccggccgctgcccgcctgccccccccgggaggtcgaactgccttctagagccctctcctgttttcaggcgaatgtgcaggtagcttgacgtctgatgaacgctcagccatgctgctgatgctacacgaaactcttcctttcgtgaggccgacgagttcttgccgggacccaaaactctccgagaagagtgcctctgctctccacggtaaattgggatgcagtgcggtctgcagttcagcggaaggccatcgtgtacagaagccacacattgttcacagctacaaagttagcttcactaggaccagccatcatctgtgtaaaagcttaaacgagagaactacaaggcactgcctgcatcggttccatgttaatgcttcgcccgatgacgacgacttccgctcgtcgcgtaacatagcgatcagtttgttcaagcggtacaagaatgtcattgaccgaggaggtggagaaaacctaaatgagtttgtcagtgctggagtgaccgctacgcactagggtgtacagatgaggggcttagaaaggacttttatgatatgaagatcttgtctggagattgaagcttagggtctttgggggcaccagctcaagtcaaagtcactccttgagatccgtgatgcatctgtggctcagtaagtgttcgtcacatactgtgcacaccacactacagntatcaggtggctccgacccacggtgtcagcca

SEQ ID NO: 75849 - protein, 134 aa, Zea mays
  misc_feature: Ceres CLONE 1560332
MLLMLHETLPFVRPTSSCRDPKLSEKSASALHGKLGCSAVCSSAEGHRVQKPHIVHSYKVSFTRTSHHLCKSLNERTTRHCLHRFHVNASPDDDDFRSSRNIAISLFKRYKNVIDRGGGENLNEFVSAGVTATH

SEQ ID NO: 75850 - DNA, 847 bp, Zea mays
  misc_feature: Ceres CLONE 1560335
  misc_feature: Translation starting site: 174
  misc_feature: SWISSPROT Homolog: EC 2.5.1.6 Methionine adenosyltransferase
  misc_feature (834)..(834): n is a, c, t, g, unknown, or other
aaagctggagctccccgcggtggcggccgctctagaactagtggatcccccgggctgcaggaattcgtctcacccctagaaaaagtgccacacatccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcgggcgaccagggccacatgttcgggtacgccaccgacgagacccccgagctgatgccgctgagccacgtgctggccaccaagctgggcgcgcgcctcaccgaggtgcgcaagaacggcacctgcgcctggctgaggcccgacggcaagaacccaggtgacggtggagtacgtgaacgagggcggcgccatggtgcccgtccgcgtgcacaccgtgctcatctccacccagcacgacgagaccgtcaccaacgacgagatcgcccgcgaccctcaggagcacgtcatcaagcccggnatcccctgagaat

SEQ ID NO: 75851 - DNA, 817 bp, Zea mays
  misc_feature: Ceres CLONE 1560341
  misc_feature: Encodes the peptide sequence at SEQ ID NO. 75852
  misc_feature (709)..(709): n is a, c, t, g, unknown, or other
ctggagctcaccgcggtggcggccgctctagaactagtggatcccccgggctgcaggaattcgtctcacccctagaaaaaatgaacgtgtcaaacagattattgaattgaaaaataaggtttgtgctggaggcgataaaaactttgtggtgatcaatcagaagggcattgaccctccatctctggatctccttgctagagcggggattattgctcttcgaagagcaaagaggagaaatatggagaggcttgtgctagcatgtggtggtgaagctgtcaattcagttgatgagttgactgaagattgtctaggctgggctggtcttgtctatgagcatgttcttggagaagaaaagtacacatttgtggagaatgtgaaaaatcctcgctcttgtactatactgattaaaggacctaatgaccataccattgcacaaatcaaggatgctgtccgtgatggtctaagatctgttaagaacacagttgaggatgaagcagttgtgctgggtgctggtagcttttgaggttgctgcaaagaagcatcttatcgacaatgtgaagaaaaccgtcaaaggacgagcacaacttgggggtgggaggcgtttgcggaagctcttcttgttatacccaagactttggctgaagaactctggtttagaaactcaaagatgtgattgtttctctccagaatgagcatgaccgtggattanttttttgtggggttgaaccatccccctctggggaatcccgattgatcccccagaatgggaagcatctttcgacaaactactctgtggaagcgccaggatcattcaatt

SEQ ID NO: 75852 - protein, 94 aa, Zea mays
  misc_feature: Ceres CLONE 1560341
MERLVLACGGEAVNSVDELTEDCLGWAGLVYEHVLGEEKYTFVENVKNPRSCTILIKGPNDHTIAQIKDAVRDGLRSVKNTVEDEAVVLGAGSF

SEQ ID NO: 75853 - DNA, 1203 bp, Zea mays
  misc_feature: Ceres CLONE 1560343
  misc_feature: Encodes the peptide sequence at SEQ ID NO. 75854
aatccacagaaaaaaagcgtcccgcctcatcccgagatcagaatcagaggccacgcggcgatggcgatggcgatgccgatggcagtggcgcgggtgaccagcctcgcctgcgccccccgacaggcgcagcatcgccgccgccatagccttgccccgccgtgcgcctcgggtgcggtggaggtgcgggtctgcacgaaccgcacgtgcgcgcggcagggggggcgcgaggtcctggctgcgctcgcgggcctcgcaccgccggcggtcgacgtggcctcctgcgggtgcctcgggcgctgcggcgccgggcccaacgttgcggcgtccgtccctgggagcaccgcggtgttcggccacgtgggcacggcggcgcgaggcgcgcagctactggagcacctcctcggccccgcggaattcgatgcggccctagggctcaccgcgctggccacgagggagaaggcggaggctgccctcgagaagggaaacgcggacgaagcggaagcccttctcaccgaggttattgggttcaatgcttgtggtggtctgcatttggtgtacatgagcaggtctaaggcgagattggaaattggggatatccctggtgcacttggggatgctgaggaagcaataagaatagctcccagatttcctcaggctcacttattgcgaggcgacacactttttgcaatgggcgaatattctgtcgcggaagatgcctatgcagatgccttggatcttgatccatctattcgtcggtccaagtctttcagggctcgcgtggaaaggctacgagagaagcttgttagtgccaataatccgtagttcattttgaagctctctctccatcagaagttcgatccacaagtaatgtagatatgttcttggtgaaggtaataatgctcacacactttgcaagccactggtcaggaattgattgttgccacagcttggaggatccaacagttcatatgaatgtagggcactgtggtttttcccacctgaacggctgaactacactatgatctacaaacttagaatagtctagtgtattttattgtatgtttatgccctacaatgtaagctactgacttccaaaccatgctagtatgtattgagatttgagagtcattctcatttcagaaaattgtatggctgcactctctgttgatatgatcttggcattctcaaaaaaaaaaaaaaaaa

SEQ ID NO: 75854 - protein, 253 aa, Zea mays
  misc_feature: Ceres CLONE 1560343
  misc_feature (197)..(230): Pfam Name: TPR_2 Pfam Description: Tetratricopeptide repeat
MAMAMPMAVARVTSLACAPRQAQHRRRHSLAPPCASGAVEVRVCTNRTCARQGGREVLAALAGLAPPAVDVASCGCLGRCGAGPNVAASVPGSTAVFGHVGTAARGAQLLEHLLGPAEFDAALGLTALATREKAEAALEKGNADEAEALLTEVIGFNACGGLHLVYMSRSKARLEIGDIPGALGDAEEAIRIAPRFPQAHLLRGDTLFAMGEYSVAEDAYADALDLDPSIRRSKSFRARVERLREKLVSANNP

SEQ ID NO: 75855 - DNA, 996 bp, Zea mays
  misc_feature: Ceres CLONE 1560344
  misc_feature (75)..(75): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
ctccccgcggtggcggccgctctagaaatagtggatccccctgggctgcaggaattcgtctcacccctagaaaanannnaaaaaaaaaaaaaaaaaaaaaaaaaaaaaaaaaaaaaaaaaaaaaaaaaaaaaccggcccccgccacgttcgcaattacagagaatctaaagagacccgcgccagagtgggcaaatctaccctttaagcgacaaagccaaaacaaacggagagggaccctccagtaggggggcggccctcggcccaggggggttctccggaaggggggggccaaggccgcccttcttcctgggcgaccgggggaacccaagggcgtcttttacccagggaaacctcgagaggccgcgggaactccactggaccatggggggcataagggtcaacaaccccccctggcaggggggcatcaagggctcaaatagacaatcttccgcgggggggccgaatcggggatgccggggaaaaaggctcaaggccaagggcccgccccccgttgggcaaaggatgcggggcttaggctccagggccccttgggggtccgaaaaaacaaacgccttccttgcgggcgaacctcctaagggagcaacccaaagaaaggaggcccgccccccggggagacaagtcccccaaaaaaaccaaataaaattttggtggcaacaaaccaaacaaaaggaactccccaaaggaggtcccggggccatttttcaaaagaaagagaaaaagagcccctctcgagggggctttctgggaaaaatcccagaaaaaaaaaaaaagccccccccgggaggaaattttttttcacacaaattttcaaaaaaaaaatacccccggggagaaaaacctccccccccactgtgtgttttggggaaacccccaccaaaaacccggggccccccccacgcgtgttgtgaaaaacctccacaaaaagggggggggtcctcccccgcgggggggtatccccaaaaaagggagggttg

SEQ ID NO: 75856 - DNA, 787 bp, Zea mays
  misc_feature: Ceres CLONE 1560347
  misc_feature: Encodes the peptide sequence at SEQ ID NO. 75857
ctccccgcggtggcggccgctctagaactagtggatcccccgggctgcaggaattcgtctcacccctagaaaaagcgccacacacagtacgtacaagcctctcatcagcaatggagtccaccaagctctccgcgctgctggtgctcgccatgctcgcgctctcctcgtccccgctggctctagcgtgggagaaggcggaaccggagtgccactcgtgcgagtccggctcgccaccctcgaccggcggcgtccccctgcctcccgtcagcataccgtcagtcccgctgccccctgtcagcataccgtcggtccccctgccccctgtcagcataccgtcagtgcccctgccgcccggtgacccttccctcccattcccgatccgttggggggaagcccccaacccccaacccaaaaaaagggaaacccggaaagggggggccccccccggcctttccgtttttccccccgaaaggcccaaaaacccccaagggccccaaaagccggttttcctctgggaaaaaagagtggcccccccatttggaaaggccccctcttaaaagtttttcgggggccccctttgggttggggaaaaacattttttctctggggggaaaaacaaagagagggggggactactttttgtgggggggaaaaacacccccacaaaaagggttccccaaaagggggtggttgtggccccccccccccctttctctttaaaaaaaagggggggggtatttatttcctcccccggggggggtggttgtttttttcctctcccccgggt

SEQ ID NO: 75857 - protein, 148 aa, Zea mays
  misc_feature: Ceres CLONE 1560347
MESTKLSALLVLAMLALSSSPLALAWEKAEPECHSCESGSPPSTGGVPLPPVSIPSVPLPPVSIPSVPLPPVSIPSVPLPPGDPSLPFPIRWGEAPNPQPKKRETRKGGAPPGLSVFPPERPKNPQGPQKPVFLWEKRVAPPFGKAPS

SEQ ID NO: 75858 - DNA, 822 bp, Zea mays
  misc_feature: Ceres CLONE 1560349
  misc_feature: Encodes the peptide sequence at SEQ ID NO. 75859
  misc_feature (754)..(754): n is a, c, t, g, unknown, or other
ctccccgcggtggcggccgctctagaactagtggatcccccgggctgcaggaattcgtctcacccctagaaaaagctcatcgaccctttcgccggcgaggtctgcggggttctggttccttggcgaggataagtctgtccacaaggctctcggcgggggtaaaactgctgatgtacttttgtggaaagacaagaagacctctgctgcggtagttggtggtgcaactgtcctatgggttctgttcgaaattgtagaataccatctcctgaccctggtttctcatgtgctgatcgctgcactgaccatcttgttcctgtggtccaatgcgactgtctttatcaaaaagagtcctcctgatgttcctgaagtgcagatatctgaagaccttgctgtaaacattgcgctagcattgcgtgctgacatcaacaaggcacttgccctgcttcgggagattgctctgggccataacctgatgaagttcctaggcgtggtcgtcgccctttggattctttcagagatcggggagctatgtgatctcctgagattgatgtacattgtggtcttgatcctccacacagtgccgatactgtactacaagtatcaggacctagtggaacatttcgctgcaaaggcgcacagggagctctgcaagcaatacgcgggtcctggatgctaaaagtctgagccagaatccaagagctcccacaaaagataagaaacagaaactagacgtggaggatgaccaagcgccttnttttcggctttgggcgacgagagtttgtagcccaatggtctgaatgtgtttcgtgggcctttgggtag

SEQ ID NO: 75859 - protein, 67 aa, Zea mays
  misc_feature: Ceres CLONE 1560349
MKFLGVVVALWILSEIGELCDLLRLMYIVVLILHTVPILYYKYQDLVEHFAAKAHRELCKQYAGPGC

SEQ ID NO: 75860 - DNA, 859 bp, Zea mays
  misc_feature: Ceres CLONE 1560354
  misc_feature: Encodes the peptide sequence at SEQ ID NO. 75861
  misc_feature (730)..(730): n is a, c, t, g, unknown, or other
gagctccccgcggtggcggccgctctagaactagtggatcccccgggctgcaggaattcgtctcacccctagaaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacaacatccagaaggagagcaccctccacttggtgctgcatcttaggggtggtatgcagatctttgtgaaaaccttactggcaagacatcactcttgaggtgggagtctcagataccattgacaatgtcaaggccaagatccangacaaggagggcatcccgccggaccagcagcgtcttatctttgcccggcagcagctggaggatggacgcacccctgcggatttacacattcagaaggagagcaccctccactggtgctgcgcctcaggg

SEQ ID NO: 75861 - protein, 166 aa, Zea mays
  misc_feature: Ceres CLONE 1560354
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLHLRGGMQIFVKTLLARHHS

SEQ ID NO: 75862 - DNA, 797 bp, Zea mays
  misc_feature: Ceres CLONE 1560361
  misc_feature: Encodes the peptide sequence at SEQ ID NO. 75863
ctccccgcggtggcggccgctctagaactagtggatcccccgggctgcaggaattcgtctcacccctagaaaaaaaacagcatcatggcgctcaccacgagcactaacaaccaagccttgcttgacgctcagctagagctctggcacacatcctttgctttcatcaagtccatggctctcaagtctgcagtggaccttggcatagccgacgccatccacagccacggtggcaacgccaccctgccccagatagtttccagggccgcgctccacccgtccaagatcccctgcctgcgtcgcctcatgcgggtgctcacagccgccggcatcttcagcgccgcccaccgctcgccggacgacggcggcggcgagctcgtctatggactcacaccggcgtctcagctcttggttggcggctcttcaagcctggctcccttcatgtccctggtgttacaccaggtctacgtgtcgcctttccttggcctcggcacatggttacagcacgagcgctcagacccgaccctgtttgagatgacgcatgggctcactgcctgggacctgaatgaccacaagccagccttcggcgagctcttcaaccaaaggtatgggtctgcgacagcaactttcgtcatgggaaatcggccccaaaggagaggggggggggaaacccttcccggggggtgaaaaccccccttttcaacaccccccaaagggctttggcccgcgggccccctggttatttttaaccccgtttcccccaagttccaggggaaggggttgggaatccccccccaggg

SEQ ID NO: 75863 - protein, 199 aa, Zea mays
  misc_feature: Ceres CLONE 1560361
  misc_feature (30)..(78): Pfam Name: Dimerisation Pfam Description: Dimerisation domain
  misc_feature: SWISSPROT Homolog: EC 2.1.1.146 (Iso)eugenol O-methyltransferase
MALTTSTNNQALLDAQLELWHTSFAFIKSMALKSAVDLGIADAIHSHGGNATLPQIVSRAALHPSKIPCLRRLMRVLTAAGIFSAAHRSPDDGGGELVYGLTPASQLLVGGSSSLAPFMSLVLHQVYVSPFLGLGTWLQHERSDPTLFEMTHGLTAWDLNDHKPAFGELFNQRYGSATATFVMGNRPQRRGGGETLPGG

SEQ ID NO: 75864 - DNA, 831 bp, Zea mays
  misc_feature: Ceres CLONE 1560363
  misc_feature: Encodes the peptide sequence at SEQ ID NO. 75865
  misc_feature (615)..(615): n is a, c, t, g, unknown, or other
ctccccgcggtggcggccgctctagaactagtggatcccccgggctgcaggaattcgtctcacccctagaaaaacccgccgccgctcgcccctcgcccctctcaaacctccgcgctcccgcccagctagggtttccccgatctcccctcctcctcaaccgccgccgtctccgagagcgccgccacgatgttggagctgcggcttgtgcaggggagcctcctcaagaaggtcctggaggcgatccgcgagctggtcaacgacgccaacttcgactgctccggcaccgggttctcgctgcaggccatggactcgagccacgtcgccctcgtcgcgctgctcctccgcgccgaggggttcgagcactaccgctgcgaccgcaacctctccatgggcatgaacctcaacaacatggccaagatgctccggtgcgccggtaacgacgacatcatcaccataaaggccgatgacggttctgacaccatcacctttatgttcgagtcgcccaagcaagataagattgcggatttcgagatgaaactgatggatattgatagcgagcacctcggaatcccggattccgagtaccaggccatcgtccgcatgccttcttctgangttatgaggatctgcaaggaccttagcagcatcggagacactgtcgttatctcggtaacaaaggagggcgtgaagttctccacatctggagaattggggagtgcgaaccattgtttgcagggcagaacaaacctattgacaagccagaagaagctaccattattgagatgcaagagccgggttcccctgaccttttgccctaagggacatgtactc

SEQ ID NO: 75865 - protein, 215 aa, Zea mays
  misc_feature: Ceres CLONE 1560363
  misc_feature (1)..(125): Pfam Name: PCNA_N Pfam Description: Proliferating cell nuclear antigen, N-terminal domain
  misc_feature (127)..(211): Pfam Name: PCNA_C Pfam Description: Proliferating cell nuclear antigen, C-terminal domain
  misc_feature (143)..(143): Xaa is any aa, unknown, or other
MLELRLVQGSLLKKVLEAIRELVNDANFDCSGTGFSLQAMDSSHVALVALLLRAEGFEHYRCDRNLSMGMNLNNMAKMLRCAGNDDIITIKADDGSDTITFMFESPKQDKIADFEMKLMDIDSEHLGIPDSEYQAIVRMPSSXVMRICKDLSSIGDTVVISVTKEGVKFSTSGELGSANHCLQGRTNLLTSQKKLPLLRCKSRVPLTFCPKGHVL

SEQ ID NO: 75866 - DNA, 835 bp, Zea mays
  misc_feature: Ceres CLONE 1560364
  misc_feature: Encodes the peptide sequence at SEQ ID NO. 75867
ctggagctccccgcggtggcggccgctctagaactagtggatcccccgggctgcaggaattcgtctcacccctagaaaaacctcctcgcattcgccgctgcgtcaacgtgtcttccttcccgcggtctctccgccgcctcccagatccggcggccatggcaaggaacccgggctgcaccgtcttcataggtaacttggatgacaaggttcctgagagggttctgtatgaaattcttattcacgtaggtcgtgttgtagacctacacatacctcgtgacaaggaaactagccgaccaaaaggctatgcttttgctgagtatgaaacagaggagattgcccaatatgctgttaagctattttctggtcttgttcgacttcataataaaacgcttagatttgcggtgcgtttctttttactccctcattttacataaattacattactgtagctggatagttgaatgtcactgtcccttttttatggcatataatactcccccatccctaaatgtgtgatattaattagttcaaaattaaactaaccaacgtccaatatttagggatggcggtaggagtatctattactatgtatgtatgtgccgagaacttgcgactcatattgagcctagcctcatatatgcttgtacttgactaattaaggcactttcaattactatatgctctctactataagacacgactctgacaatactgatattctagacacatctctgaggcagacaacccctcctgaaatggcattatcccatggaactcctaagctaaaactctgtaccacaggcaaagcctcatgcacccgtatgaggactagttc

SEQ ID NO: 75867 - protein, 92 aa, Zea mays
  misc_feature: Ceres CLONE 1560364
  misc_feature (9)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MARNPGCTVFIGNLDDKVPERVLYEILIHVGRVVDLHIPRDKETSRPKGYAFAEYETEEIAQYAVKLFSGLVRLHNKTLRFAVRFFLLPHFT

SEQ ID NO: 75868 - DNA, 870 bp, Zea mays
  misc_feature: Ceres CLONE 1560367
  misc_feature: Encodes the peptide sequence at SEQ ID NO. 75869
ctccccgcggtggcggccgctctagaactagtggatcccccgggctgcaggaattcgtctcacccctagaaaaaagcgaccgaatccgatcgccttggcgcaggcgttcgatgggcaaccactaccagacgctgggtgtccggcaggacgccaccaaggctgaggtcaaggctgccttccgtcgcagcgcgctacgcgaccaccctgaccgccacgccggctccaccgacgcggccgcccgtgccgacgccgccagccggtttcgccaggcgtccgacgcgtactacgtcctctccgacgacagacgccgcgccgagtacgacctccgtcttcgcggttccacgtcttcctacgcgcgcacctcctcctctggttgggcctcctcgtcggcttcctacgggtacggccatggcggcggttcgtggcgacggactcctccgggtgcaggtgccggcgccggcgcctcggtggggtcaattgattgggaattcttactgaaggcggtcactcggcgagggttccttatcaatctgggattagccagtgtattgctatctgggggcaacttttcttgattggactattttagaaaatttggaagatgataacacccgggaaaccatttgaagaagccataggaaaaggtcggaaagacgccaggaaggaaaatagataaagctttgaatcttttttcaggggaacattaggggggttattataatacccctaaggtaaaaacccctgtgtgccaattccgatcggttggcccccaccccccccggaaagttacctttgggaaaaaaggaataaaatcttgaacaaattttttttctctttcccgaacctccccgagacttttgggcttttgat

SEQ ID NO: 75869 - protein, 154 aa, Zea mays
  misc_feature: Ceres CLONE 1560367
  misc_feature (3)..(71): Pfam Name: DnaJ Pfam Description: DnaJ domain
MGNHYQTLGVRQDATKAEVKAAFRRSALRDHPDRHAGSTDAAARADAASRFRQASDAYYVLSDDRRRAEYDLRLRGSTSSYARTSSSGWASSSASYGYGHGGGSWRRTPPGAGAGAGASVGSIDWEFLLKAVTRRGFLINLGLASVLLSGGNFS

SEQ ID NO: 75870 - DNA, 1038 bp, Zea mays
  misc_feature: Ceres CLONE 1560369
  misc_feature (29)..(29): n is a, c, t, g, unknown, or other
  misc_feature (42)..(42): n is a, c, t, g, unknown, or other
  misc_feature (65)..(65): n is a, c, t, g, unknown, or other
  misc_feature (68)..(68): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (107)..(107): n is a, c, t, g, unknown, or other
  misc_feature (109)..(109): n is a, c, t, g, unknown, or other
  misc_feature (111)..(111): n is a, c, t, g, unknown, or other
  misc_feature (265)..(265): n is a, c, t, g, unknown, or other
  misc_feature (860)..(860): n is a, c, t, g, unknown, or other
agcttgggggtgggtgtgtttggtcgtcntttgtggtggggntttctctctctattatattgtanttnttttnnnnnntnnnnnnnaaaaaactggaagctccccgncngntggcggccgctctagaacagtggatcccccgggctgcaggaattcgtctcacccctagaaaaacagcatctcaagccaccatcgaccttcaagtctcgctacgtagcagtgcaataaaaaaagcagccgcaatggcgagcagcaccatggcccntctccctcacggcccttcgccggcaaggcccgtgaacgtgcccgtcgtcgtcccgctttcggcgaagccccccgtgacaatgcgcaaagacgggcggggaagggccaaaccggccggcgggcttcccggaaccctggggtacgggccccaaccccttgggtgtaccctgggcccccttttccggggaaaacccccccaaaattcccttgaagggggggaaatttccccgggggggaaaaaaacgggggggggggaaaaacccccggggggggctttttttttggggggaaacacccccgaaaaaaacttttttcccccacaaaaaaaacccgcgggagaaaccctggggggggggaaaaagaaccccccccccccccccccgggggggggcaaattatttgggggggggcgcccccccccccggggggggggtggttttttcttccccggagggaaaagagattttctccctctcccccccccaaagaggggggggatataaaatattatcttcgtaaaaaaaagaacgccccttttgtgtgttatatatataagaggggggggggcgcccccccccacaaaatttttttttcanggggggggggggggggaaaaaaaataaaaaatcaccccccctcgggaggagaaaaaacaatatattttttttcttttttttcgggaaagaaaaaagaaacaacacccccccctcccgtgtctggtgggggccgcccctacaaattgtggtctcttttattgtggggggccgccccacc

SEQ ID NO: 75871 - DNA, 1045 bp, Zea mays
  misc_feature: Ceres CLONE 1560370
  misc_feature: Encodes the peptide sequence at SEQ ID NO. 75872
  misc_feature (1)..(1): n is a, c, t, g, unknown, or other
  misc_feature (2)..(2): n is a, c, t, g, unknown, or other
  misc_feature (17)..(17): n is a, c, t, g, unknown, or other
  misc_feature (18)..(18): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (46)..(46): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (93)..(93): n is a, c, t, g, unknown, or other
  misc_feature (404)..(404): n is a, c, t, g, unknown, or other
nnaaaacataaaaaaanntaaattgnnncnnncnnngnnnnnnncnccnnnnnnnnnnnncgttnnnnnnnnccaaagctggagctccaccgncggtggcggccgctctagaatagtggatcccccgggctgcaggaattcgtctcacccctagaaaaaaccaatcccatccccacaaccgggtgccgccgccttctatggcggacttcggcgacgagctctttctcgacgtcggggacgatggtttcggagacctctcctacgtctccttctccgagtccatcgagttggatctcgcctgcccacgcgacgtcttttccgcggggtttgatcccgaaaccctaacccacatcccggggtccccaatctccttcgactccgaacccgaacttcgcccactctcntcctcgctgaactgctccccgcccttctggggctgcctcgatgacgccgctagctttcaagtgggagggagaatcgcgaacgctgccccttcggcgtcggggggtggcgcctggcggcgccccggaagggggaagaacaaaggactttaaaagggaaaccccccaatgtccgaaccccccaacatggtttcggggtttccctttcaaccaaaccggggaaaaaaaccttggggccctttaattggaaagggccatttcccaacccgccggggtaaaaaaaaaaaaaaatccagaattttttttttccccaaaaagaaagcccccccccccgtttttaacccactctcccggccgagaagaggcggaaaaccccccgagagcttttttataaaagggagtctttttttccccccaaaaaaaacaggggtgttttggggggggggggagaaaaaatctttcctcccccggggggggcctcttttttagaaaaaaaagagaaaaaaaaaaatttttttcttagggggggtgttctttcccgcggggggagccacacctcttttttataaaaaaaaaaagggggggggggggcctccccccccccccccccggggggggggggtttatttattagagaggggggg

SEQ ID NO: 75872 - protein, 118 aa, Zea mays
  misc_feature: Ceres CLONE 1560370
MADFGDELFLDVGDDGFGDLSYVSFSESIELDLACPRDVFSAGFDPETLTHIPGSPISFDSEPELRPLSSSLNCSPPFWGCLDDAASFQVGGRIANAAPSASGGGAWRRPGRGKNKGL

SEQ ID NO: 75873 - DNA, 843 bp, Zea mays
  misc_feature: Ceres CLONE 1560372
  misc_feature: Encodes the peptide sequence at SEQ ID NO. 75874
ctccccgcggtggcggccgctctagaactagtggatcccccgggctgcaggaattcgtctcacccctagaaaaaaccggcaagaccaaccaacccacttctgactgaccactgtgccgcgccgtgctcaccgaacggtcgaccacacagaacgacgatggccgcgtcggcgctgcaccagaccaccaacttcctcgggcaggccctggtcgcccgcgccgccggcgtcgatgccggcggccgcatcaccatgcgccgcaccgtcaagagcgttccccagagcatatggtacggccctgaccgccccaagtaccttggcccgttctccgagcagacgccgtcgtacctgaccggcgagttccccggcgactatgggtgggacaccgcgggcctctcggccgacccggagaccttcgcgcgcaaccgggagctagaggtgatccactcccggtgggcgatgctgggggcgctgggctgcgtgttcccggagatcctggctaagaacggcgtcaagttcggcgaggcggtgtggttcaaggccggcgcgcacatcttctcggagggcgggctggactacctggggaaccccaacctggtgcacgcgcagagcatcctggccatctgggcgtgccacgtggtgctcatgggcttcgtcgagggctaccgcgtcggccgcggcccgctcggggaagggctcgacaacgtgtaccccggcgggcgccttctacccgctggggcctcgcgacgacctcggacaccgccagccgagctcaaggttgaagaagctcacgatcggccgccttggcaatgttctccaaggtacggcattccttcgtgcaaggcc

SEQ ID NO: 75874 - protein, 229 aa, Zea mays
  misc_feature: Ceres CLONE 1560372
  misc_feature (59)..(213): Pfam Name: Chloroa_b-bind Pfam Description: Chlorophyll A-B binding protein
MAASALHQTTNFLGQALVARAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAHIFSEGGLDYLGNPNLVHAQSILAIWACHVVLMGFVEGYRVGRGPLGEGLDNVYPGGRLLPAGASRRPRTPPAELKVEEAHDRPPWQCSPRYGIPSCKA

SEQ ID NO: 75875 - DNA, 905 bp, Zea mays
  misc_feature: Ceres CLONE 1560376
  misc_feature: Encodes the peptide sequence at SEQ ID NO. 75876
  misc_feature (552)..(552): n is a, c, t, g, unknown, or other
ctccccgcggtggcggccgctctagaactagtggatcccccgggctgcaggaattcgtctcacccctagaaaaaaccagcaccgaggcaggagcggcgatccattccacacaaccaccactgctcttgccccagcccgccgcaggagttgccagatctgccccggtcacaggaactccgactccgagccctctccaatggcggttaaggtctacgtcgtgtactattccatgtatggacatgttggcaaactagctgaagagatccagaaaggtgcctcgtctgttgaaggtgttgaagctaaaacatggctggtccctgaaaccctccctgaggaagtgcttggaaagatgggcgcaccccctaagcctgacgtgccagtcatcacgccgcaagaactcgcagaggccgacggaatcctcttcgggttcccaacgaggttcggaatgatggcagcgcagatgaaggcgttcttcgatgccactggtgggctctggagggagcagagccttgccggcaagcctgccggcgtcttcttctgcactggatccanggtgggtggcaagaagacgacagcgttgacagcgatcacccagttgacgcaccacggcatggggttccgtgctggggggctaaaccttcggcgccaagctgttcgggatggaacaaggttcaggggggaaggcccctagggggccggaccttttcccccccaaaggcttcaggggggccaaaccaagggggacctggaacccccccttccccccgggggaaatactttcccaggcgtttcccaaaaaaacccaagggtgtcaccccggatctacaaaaaaaaccccttgggcggaatttttaaaaaaaccctttttatcagatttcccctccacccccccacaaaaaaggcgg

SEQ ID NO: 75876 - protein, 164 aa, Zea mays
  misc_feature: Ceres CLONE 1560376
  misc_feature (7)..(138): Pfam Name: Flavodoxin_1 Pfam Description: Flavodoxin
  misc_feature (119)..(119): Xaa is any aa, unknown, or other
MAVKVYVVYYSMYGHVGKLAEEIQKGASSVEGVEAKTWLVPETLPEEVLGKMGAPPKPDVPVITPQELAEADGILFGFPTRFGMMAAQMKAFFDATGGLWREQSLAGKPAGVFFCTGSXVGGKKTTALTAITQLTHHGMGFRAGGLNLRRQAVRDGTRFRGEGP

SEQ ID NO: 75877 - DNA, 829 bp, Zea mays
  misc_feature: Ceres CLONE 1560378
  misc_feature: Encodes the peptide sequence at SEQ ID NO. 75878
ctccccgcggtggcggccgctctagaactagtggatcccccgggctgcaggaattcgtctcacccctagaaaaaagcgaagcaagcagcctaaaaaaaccgtatcgtctcgcctgttcagtttccttctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtgaagggcgtcgttagccccgtctacgaccgcttcggcggcctgcctctcgacgtcctcgccttcgtcgaccgcaaggtggacgacacggtgcacgaggtggacaagcacctcccgggcgcgctgaaggcggcgtcggggcatgtctacgcggtggttcggggcgtgccggaagtggcgcgcgagctggcggccgaggcgcagcggtcgggcgtgaggggcgcagcccgtgcggcgctcgcgatgacggagccggtggcgcgggacgtgtacggccgcgtggagcccgtggccaaggacctctacgtgcggtacgagcccgcggcggaagcacctggccgtctccgcctggcgctcgctgaacggcctggccgtgttcccgcaccttcgggggaaattcgtcttgct

SEQ ID NO: 75878 - protein, 208 aa, Zea mays
  misc_feature: Ceres CLONE 1560378
  misc_feature (19)..(200): Pfam Name: REF Pfam Description: Rubber elongation factor protein (REF)
MAEEQSNPQHQQAEEREVMVEQQQPRRAPKLRYLDFVQVAAAQAAVCLAGLYGLAKDHAGPLRPSVDAVESAVKGVVSPVYDRFGGLPLDVLAFVDRKVDDTVHEVDKHLPGALKAASGHVYAVVRGVPEVARELAAEAQRSGVRGAARAALAMTEPVARDVYGRVEPVAKDLYVRYEPAAEAPGRLRLALAERPGRVPAPSGEIRLA

SEQ ID NO: 75879 - DNA, 841 bp, Zea mays
  misc_feature: Ceres CLONE 1560379
  misc_feature: Encodes the peptide sequence at SEQ ID NO. 75880
tccccgcggtggcggccgctctagaactagtggatcccccgggctgcaggaattcgtctcacccctagaaaaagtcgccgcctgtctccactctctctcgtcgccgtcctctcccgttcgcaacggcacgctccccagcggcgaaatggcctctaagcgaggtggctgggcaccggtgccggccaagaagaacactgataaggtgacgaaccctctgttccagaaaaggcctaagcatttccgcatctgtggctcgttgcctcccaagaaggacctgcaccgattcgtctagtggaccaaggtcgtgcgcatgcagcgccagcgtcgcatcctcaagcagcgcctcaaggtgcctccggtgctctactgattcacccgtaccgtcgacaataacctcgctaccaaactgttctagatgcttcttaagtacccgccctaagactaggctgccgagaatgagaggcttctgaagagggcccacgctgagaatgaaggagaaactgttgaatccaagaaaccaattgttgtgaagtatggccttaaccatgtgacttacgtcgatgagcagaacaaggctcagctcgttgtcatcgctcatgatgaggatccgattgaactggttgtttggcttccagccgtgtgtcagaagatggaggtcctctgctgcgatggtaacggaaacgctcgcgttgaatacatcgttcagcagaagactgcatcagtcttgtgactgaccactggtcagagcgaagacaatcttgaggtcagcaagatcttggaggctgttatgcgagcttcatgacaagtttaaggaattctgaaatagttggggaggtggctt

SEQ ID NO: 75880 - protein, 48 aa, Zea mays
  misc_feature: Ceres CLONE 1560379
MASKRGGWAPVPAKKNTDKVTNPLFQKRPKHFRICGSLPPKKDLHRFV

SEQ ID NO: 75881 - DNA, 837 bp, Zea mays
  misc_feature: Ceres CLONE 1560380
  misc_feature: Encodes the peptide sequence at SEQ ID NO. 75882
ctccccgcggtggcggccgctctagaactagtggatcccccgggctgcaggaattcgtctcacccctagaaaaaactagcattacacatacgcactttctctctctactgtctgtctgtttctcccaatcctccacagtctctctctagagtagacccaggaaagaggcgatggatatggccattgacacgccatcgccggcgccgcccacgccgccggcgccatcggcagcggccgggcggcagacgcgtgcggcagaggcggtgcgtctggagcaccaactggtgcgcgtgcctctcgagtccctccgcgccaccgtccgctcgaaccaccgcctcgccgagaaggagatcgccgccgtcctctcctccgcctccgcggcccccgcagagagcagtgccgccgccgtcgaccacctcacctccctcgtctctcgcctccacggcctcaagcgcaagatggaggagggcgcacgagcggaggaactgcaggtgcagcggtgcccggcgcgtctggaccggctggcgactgccagcaccggcgacgatgccgaatgggaggacatgcggttgaagaagatccctggtcgatacatgcttcggatgtcctactacaattccgccaccaagctcgctgagacttctggtattcaggacctcgttgatattgatgttcttctcgaagcaaaaagagaaatgattctcttcaaaataagaaagttctcctgctttagcttggggtgcagaaaaaaatctcgcctaaagaaatcaaaagtaagcttgattttttctgaggccttcaaaatttgtggaattttgccaggttaaaaattctttt

SEQ ID NO: 75882 - protein, 218 aa, Zea mays
  misc_feature: Ceres CLONE 1560380
MDMAIDTPSPAPPTPPAPSAAAGRQTRAAEAVRLEHQLVRVPLESLRATVRSNHRLAEKEIAAVLSSASAAPAESSAAAVDHLTSLVSRLHGLKRKMEEGARAEELQVQRCPARLDRLATASTGDDAEWEDMRLKKIPGRYMLRMSYYNSATKLAETSGIQDLVDIDVLLEAKREMILFKIRKFSCFSLGCRKKSRLKKSKVSLIFSEAFKICGILPG

SEQ ID NO: 75883 - DNA, 731 bp, Zea mays
  misc_feature: Ceres CLONE 1560385
  misc_feature: Encodes the peptide sequence at SEQ ID NO. 75884
aaagctggagctccccgcggtggcggccgctctagaactagtggatcccccgggctgcaggaattcgtctcacccctagaaaaagccgctccggcctcctccgtcgggaccgccgacgacgcgccgcgcggaagcctgcggggatattgggtaagcagttgtgatcctgttctcttgctcggatgccgggttactatgacatcgatgacatcctcatggaggatgagcctatttcagttgttttccaagtaactgcaaatggtgttggcctgctagatcctgggtgctgaaaaagtaactggtgtagacaaggggcgcccaagggtggaccctccccattttttggcttttgcggcatggggcctgcttgttctcctgggaaacaaaaggctgtggtccaaataaaaacccccaaccctcccattggcttttccacaaccagaaaaaaaacccttggggaaaaagggaaaaatccccaaaacccttgaatggccgggcccctggttgttgggaatttttaaaaggggttttcccttttgccccccggtaaccttttttttttggaacccttaggaaattggccaaaaaatttggtttccccttttgtgggggagagggggaaaaattttagcccttttttgggcccctggttttccctttgggggaaatatttgcccctttccccccccccgtggtggggggaaaacaacaaaaaaaagagggttttttct

SEQ ID NO: 75884 - protein, 35 aa, Zea mays
  misc_feature: Ceres CLONE 1560385
MPGYYDIDDILMEDEPISVVFQVTANGVGLLDPGC

SEQ ID NO: 75885 - DNA, 835 bp, Zea mays
  misc_feature: Ceres CLONE 1560387
  misc_feature: Encodes the peptide sequence at SEQ ID NO. 75886
  misc_feature (611)..(611): n is a, c, t, g, unknown, or other
ctggagctccccgcggtggcggccgctctagaactagtggatcccccgggctgcaggaattcgtctcacccctagaaaaaatcccatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtacgagctgtccaaggacccctccgtgagcgtcgccatcgtggagcagtccgtgtccccgggcggcggcgcgtggctgggcgggcagctgttctcggccatggtggtgcgcangccggcgcacctgttcctggacgagctgggcgtgggctacgacgaggccgaagactacgtggtggtcaagcacgcggcgctgttcacgtccaccgtgatggagccggctcctgcgcgggccaacgtgaaactgttcaacgccgtgggcggtgggaagacctgatccttgccgccgggggcccctccggcggcgttggtcaccaaacggggcggcccctggtcct

SEQ ID NO: 75886 - protein, 194 aa, Zea mays
  misc_feature: Ceres CLONE 1560387
  misc_feature (62)..(195): Pfam Name: Thi4 Pfam Description: Thi4 family
  misc_feature (141)..(141): Xaa is any aa, unknown, or other
MATTAASSLLKSSFAGSRLPSATRTTTPSSVAVATPRAGGGPIRASISSSPTPPYDLTSFRFSPIKESIVSREMTRRYMTDMITHADTDVVIVGAGSAGLSCAYELSKDPSVSVAIVEQSVSPGGGAWLGGQLFSAMVVRXPAHLFLDELGVGYDEAEDYVVVKHAALFTSTVMEPAPARANVKLFNAVGGGKT

SEQ ID NO: 75887 - DNA, 812 bp, Zea mays
  misc_feature: Ceres CLONE 1560388
  misc_feature: Encodes the peptide sequence at SEQ ID NO. 75888
ctccccgcggtggcggccgctctagaactagtggatcccccgggctgcaggaattcgtctcacccctagaaaaaatgttcaccgagaaaccctagttcgaacgcgccgccatcaccgtcgtctctcgctcgttccctcgcgctctccgctcggatcggagcgagagtaggggcgtgtcggcggtgaaagcgaccgcgtcagccatggcggacgaggagcattcggagaggagagaggaggcctccgagcttgcccccttcgacccgaccaagaagaagaaaaagaagaaggttgtcatccaagaaccttctgatgaagtggacaagcttgcagagaagacagaaacactggcagtcgcagaacccgctgaacttaacttcactggaatgaagaagaaaaagaagaagccggtggatcttgattcaactcttgatgagcttggagatggggaggacactcaagatgatcaagctgtagaggaacaaggggaaggcattgtgctgggaagtgtccctacatacccttgggagggaactgatcgggattataaatatgaagagctgctggacagggtgttcaacattctacgtgagaacaacccagatcttgctggggataggcgtaggaccgttatgaggccaccacaagttcttagggagggaacaaagaagacagtttttgttaactttatggatttgtgtaaaacgatgcataggcaacctgagcatgtgatgatgtttttacttgctgaaatggggacaagcgggtcacttgatgggcagccaaaggttggtgattcaaagaaagatttc

SEQ ID NO: 75888 - protein, 203 aa, Zea mays
  misc_feature: Ceres CLONE 1560388
  misc_feature (123)..(202): Pfam Name: eIF-5_eIF-2B Pfam Description: Domain found in IF2B/IF5
MADEEHSERREEASELAPFDPTKKKKKKKVVIQEPSDEVDKLAEKTETLAVAEPAELNFTGMKKKKKKPVDLDSTLDELGDGEDTQDDQAVEEQGEGIVLGSVPTYPWEGTDRDYKYEELLDRVFNILRENNPDLAGDRRRTVMRPPQVLREGTKKTVFVNFMDLCKTMHRQPEHVMMFLLAEMGTSGSLDGQPKVGDSKKDF

SEQ ID NO: 75889 - DNA, 806 bp, Zea mays
  misc_feature: Ceres CLONE 1560392
  misc_feature: Encodes the peptide sequence at SEQ ID NO. 75890
ctccccgcggtggcggccgctctagaactagtggatcccccgggctgcaggaattcgtctcacccctagaaaaagtccgtggagaagcgggagcaggtggcggcgatggaagagcaaggcggccaggcggcgctcgggtgggcggccagggacgactccggcgtcctctccccctacagcttctccagaagggttcctaaagacgacgatgtcacgatcaaggtgctctactgcgggatctgccacaccgacctgcacgtcatcaagaacgactggcgaaacgccatgtacccagtcgtcccggggcacgagatcgtgggcgtggtgaccggcgtcggcggcggcgtcacgcggttcaaggccggcgacacggtcggcgtgggctacttcgtggggtcctgccgctcctgcgacagctgcggcaagggggacgacaactactgcgcggggatcgtgctcacctccaacggcgtcgaccacgcgcacggcggcgcgcccaccagggggggattctccgacgtcctggtcgcgagcgagcactacgtggtccgcgtccccgacggcctggcgctggaccgcaccgcgccgctgctctgcgccggcgtcaccgtgtacagccccatgatgcgccacggcctcaacgagcctggcaagcaccctcgcgtcgtcggcctcggcggcctcggccacctccccgtcaagtttcggcaggcctttcggaatgaagggtaccgtcatcagcacgttcgccagcaaggcgccggaggccatcgagaacctcggggcccgacgaatttcctattagc

SEQ ID NO: 75890 - protein, 233 aa, Zea mays
  misc_feature: Ceres CLONE 1560392
  misc_feature (33)..(150): Pfam Name: ADH_N Pfam Description: Alcohol dehydrogenase GroES-like domain
  misc_feature: SWISSPROT Homolog: EC 1.1.1.255 Mannitol dehydrogenase
MEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFVGSCRSCDSCGKGDDNYCAGIVLTSNGVDHAHGGAPTRGGFSDVLVASEHYVVRVPDGLALDRTAPLLCAGVTVYSPMMRHGLNEPGKHPRVVGLGGLGHLPVKFRQAFRNEGYRHQHVRQQGAGGHREPRGPTNFLL

SEQ ID NO: 75891 - DNA, 794 bp, Zea mays
  misc_feature: Ceres CLONE 1560394
  misc_feature: Encodes the peptide sequence at SEQ ID NO. 75892
  misc_feature (396)..(396): n is a, c, t, g, unknown, or other
acccgcggtggcggccgctctagaactagtggatcccccgggctgcaggaattcgtctcacccctagaaaaactcccggcctcccctcccttgccgtccacttcttcctccaccacagtcatcagtggcgttatcctcttcgttctcgcctccctggttgttgttggctgggtgttggcgagctgggagtagagaccgagaagtggagcggccatgaagatccagtgcgacgcgtgcgagggcgcggctgccacggtggtgtgctgcgccgacgaggccgcgctgtgcgcgcgctgcgacgtcgagatccacgccgccaacaagctcgcgagcaagcaccagcgcctcccgctcgaggcgctctccgccaagctcccgcgctgcgacgtctgccangagaaagcggcgttcatcttctgcgtggaggaacgggcgctcttctgccaggactgcgacaagcccctccacttcccgggcacccttttccgggaaccccaaggctacctgggcccccgggattcccgggggggggctcccccccgggttttcccccgcgaaaaaaaccctttggaaccccccaaaatttttaaaaaaacaatccccccccacaggggggccccctttttagaccccccccgggggggcgcggcttttttttcctcccccggggggaaaaaaaaaaaggggcccccctcccccccccccccacaatttttttttttcttcccgcgcgggggggggggggtggggtttttttaaaaaaaaaaaaaaaaccccccccctttggttgtttc

SEQ ID NO: 75892 - protein, 181 aa, Zea mays
  misc_feature: Ceres CLONE 1560394
  misc_feature (1)..(47): Pfam Name: zf-B_box Pfam Description: B-box zinc finger
  misc_feature (61)..(61): Xaa is any aa, unknown, or other
MKIQCDACEGAAATVVCCADEAALCARCDVEIHAANKLASKHQRLPLEALSAKLPRCDVCXEKAAFIFCVEERALFCQDCDKPLHFPGTLFREPQGYLGPRDSRGGAPPRVFPREKNPLEPPKIFKKTIPPHRGAPFLDPPRGGAAFFSSPGGKKKKGPPSPPPPQFFFFFPRGGGGVGFF

SEQ ID NO: 75893 - DNA, 759 bp, Zea mays
  misc_feature: Ceres CLONE 1560395
  misc_feature: Translation starting site: 161
  misc_feature (548)..(548): n is a, c, t, g, unknown, or other
ctccccgcggtggcggccgctctagaactagtggatcccccgggctgcaggaattcgtctcacccctagaaaaaagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccggggggcttcatcgagcccaagtggctggcctatggcgaggtgatcaacggccgctacgcatgctggggcgcgtgggcgcatcgcccggagatcttcggaagatgggcatcatcccccggagaccggctgccgtgttcaagaggncgtcatcccgcccgcggcacctaaaatactgggccgactcctaaaggctcttgtcttcaaatgggggctattggcttccccaagacccgccccctccgggatgggaacaacccgggctcccttgggcaagaaaaaacttccccggccccaaaaagttttttcccgggtctcggaaaccccttcttaccccggggggggcccccttttaaac

SEQ ID NO: 75894 - DNA, 855 bp, Zea mays
  misc_feature: Ceres CLONE 1560396
  misc_feature: Encodes the peptide sequence at SEQ ID NO. 75895
gcgctctcgaactagtggatcccccgggctgcatgaattcgtctcacccctagaaaaactcatcggcctccggtcttctggtctccccagatctcccaccggggaaccctacccgagcatcagccatggcgatcgcggcgcgcgtcctgcgccgcctcccgctccacctctacccctcgctcgctcgctctttctgcgcagtttccccggccgccgcctcggccgccccggcgtccgccaaggtcgccgatcgcatcgtgcgcgttctcgccatcgatctcgagggggggcgccgcgaggtcgtcggcctctccgggcagacactcctccgcgcgctcgccaacgcggagctcatcgagccggcctcccaccgcctcgaggatatcgacgcgtgctccgccgagtgcgaggtccacatcgcgcaggagtggctcgacaagctgccgccaccgtcctacgaggagcggtacgtgctcacgcgcgcgtccaggaaccgcgagctcaacaagcacgcgcgcctgggctgccaggtcgtcctcacgccggagctgcatggcatggtcgtcgctgtccccgagcctaagccgtgggacatcccgtaatggcctgccgcgacgaatggcaaggtgcggctttcgacgctgtgagccttccttcattcccctggctcggtcaagcttgtgcgcctctgccatacccttttatgttaccgaatttgatgaagaataaatagtttgatgggaaaaaactgcccattggtaaacttttggttcttttggattgtggagtgtaaatggaagcttgtaaaggtggaatatcccgttggcaaattacccccaagttcaatggtttctt

SEQ ID NO: 75895 - protein, 158 aa, Zea mays
  misc_feature: Ceres CLONE 1560396
MAIAARVLRRLPLHLYPSLARSFCAVSPAAASAAPASAKVADRIVRVLAIDLEGGRREVVGLSGQTLLRALANAELIEPASHRLEDIDACSAECEVHIAQEWLDKLPPPSYEERYVLTRASRNRELNKHARLGCQVVLTPELHGMVVAVPEPKPWDIP

SEQ ID NO: 75896 - DNA, 1333 bp, Zea mays
  misc_feature: Ceres CLONE 1560397
  misc_feature: Encodes the peptide sequence at SEQ ID NO. 75897
  misc_feature (832)..(832): n is a, c, t, g, unknown, or other
  misc_feature (1144)..(1144): n is a, c, t, g, unknown, or other
aaataataagcggtccttttttctttcggtttttgtctgggtgtgtgggttttaattttccccacaggactcctttaaactggaattcccctcggtggcggccgctctagaactagtggatcccccgggctgcaggaagtcgtctcacccctagaaaaaaaacgcaggccgcactcgcgtgcggaactagagctccttcagagaagtgccgtgccagtgccaccgccggccgcatcatcgttccgcccccctgagtgttcagtaacttcttccgatccatattatggcttcaaagcatcaacagaaacatttcctggatgaagccatgatcaggcacccgacacgggaggaggaccgtgagggcacatggacctcagtgctgacaatcctcggctttggattcctaaccttcaactcattcatggttgggtacgggtcaaatggagatgttggatctatttcctttgtggtcttcgggggccccccccccccattctgctggttaaattaggctggttctaattccacacaactattaatagaagtcgcccttagccgggaagcagaaaagaaaatgcgccttcgttgggggtacgtgacccacgcgataaatgctcctggccggcgatgttattttaatacacagaggttggggcaggcaagttgatgacacaaagtttcccgggggtaagaatggtcaggcctttaatttgtgtggtggacagagagcacgcgaagggaaggcgatatccgtgatgggttataacatggtccgggagtacatatatgagagaatgaccgaatgatcaccgttctcgtgattccgggggcntctgttgtgatgataaatagaagactatctcttgtccaccgacatcaagacgttgggggttaaatggcctcgctctgcaacatggatggccactgagatgtatcagtgtaaggggtcgcatgtgaccgccgcgagatgtacttgtatgatctgagcacacaagaggaggtggaactccgtgtatagtagtactgctcactccggagatcagagatatctgtgggaggacaagtgctaggagccagtttgtgatatatagagtggggagattgcgctatctatgcgggacattatctaaggttctaacagcgntaagttcctcagatacgcgatataatactgtgcgcgtgtgagatgtaagtgtgcagacagctcgagcattagtgctgtgcatctcagtgtatgtcctagccaggtgattgaggagcagagcagtatatgagtctatcgagggtatgaatgtacagttgtcggacgcggacacggtagctcgaatctcat

SEQ ID NO: 75897 - protein, 75 aa, Zea mays
  misc_feature: Ceres CLONE 1560397
MASKHQQKHFLDEAMIRHPTREEDREGTWTSVLTILGFGFLTFNSFMVGYGSNGDVGSISFVVFGGPPPPFCWLN

SEQ ID NO: 75898 - DNA, 854 bp, Zea mays
  misc_feature: Ceres CLONE 1560400
  misc_feature: Encodes the peptide sequence at SEQ ID NO. 75899
  misc_feature (498)..(498): n is a, c, t, g, unknown, or other
ctccccgcggtggcggccgctctagaactagtggatcccccgggctgcaggaattcgtctcacccctagaaaaaagacgccacctgttcttccttcctctcctctctgcaacgcgtcgggaagcagctgccagccatggcaatggcgtcgtcgtcgagcgggctgaggagctgcagcgcattgggcgtgcccagcctgctggcgccgtcgacgtcgtcgtcgtcccggtccggccgcctgccgttctgcgcccacgccaccacctccggccgcgtcaccatgtccgcggagtggatgcccgggcagccccgccccgcccacctcgacggctcctcgccaggtgacttcggcttcgaccccctgggcctggccacggtgccggagaacttcgagcggttcaaggagtcggaggtgtaccactgccggtgggccatgctggccgtgccgggggtgctggtgcccgaggcgctggggctgggcaactgggtgaaggcgcangagtgggcggccgtccccggcgggcaggccacgtacctgggcgcccccgtgccgtggggcacgctgccgaccatcctggcggtcgaggtcgtgggcatcgccttcgccgagcacagcgcacaatggaaaaagaccccgaaaagaaagtacccccgggggggcttcgaaccggtcgggtttttcagggaccccccaagctccaggaatacaacctcaaggagatcaaaaaggccccccttcccagggtggccttttgcgggtttttggggccaaaaaatcggggtaaccccgggacccggcccgcttcaaaaacatttcccccccacttttgcgaaaccctggggacaaaaaaaatt

SEQ ID NO: 75899 - protein, 239 aa, Zea mays
  misc_feature: Ceres CLONE 1560400
  misc_feature (58)..(214): Pfam Name: Chloroa_b-bind Pfam Description: Chlorophyll A-B binding protein
  misc_feature (121)..(121): Xaa is any aa, unknown, or other
MAMASSSSGLRSCSALGVPSLLAPSTSSSSRSGRLPFCAHATTSGRVTMSAEWMPGQPRPAHLDGSSPGDFGFDPLGLATVPENFERFKESEVYHCRWAMLAVPGVLVPEALGLGNWVKAXEWAAVPGGQATYLGAPVPWGTLPTILAVEVVGIAFAEHSAQWKKTPKRKYPRGGFEPVGFFRDPPSSRNTTSRRSKRPPFPGWPFAGFWGQKIGVTPGPGPLQKHFPPTFAKPWGQKK

SEQ ID NO: 75900 - DNA, 882 bp, Zea mays
  misc_feature: Ceres CLONE 1560401
ctccccgcggtggcggccgctctagaactagtggatcccccgggctgcaggaattcgtctcacccctagaaaaactatcccttggttgccgcactctacaagtgcctcttcttcaccgccgcttgggcaacctgctgtaattttcctgccgccttctccactagtgctgatgggcaacgaactagtgcgcgtgctcaccactggagccgcgcgactacttggatatgacctggttcacagacatcgtgtccggagttctggctatgccagaccggcctgttcttgctgcggctcataaggtcccggctggttatcaaccgcattaccggcgttgatcaccagctactgtcagatgacggctcctcttccgacgtgactctgccgtgccctcgatgatagccaaatctgcactcgggagcagtatcaacagtggtcgtcggcagcattctgcaaccatcgcgggacagtaaaagggaaacctttcaagtaccaaccaaggtttcacttgaggaaatcccttccccttttcccgttctaaaggcaatgtagcttccccaattttttaggatcttggagggccgcccaaacccacccaaaaggttaatggccctttttttttggaaagaaatttgcccccccccccaattccaaaaaaataacctttttttttttctctgaaccgggttagggaaccccaaaccccgggaaaattggggccgaaattttcccccaaagatttttctcctgttccccgggtaatgtggtatataaaaaaaattttttcctcttccgggggagaacccccaaataaattcttctccaaaaaaaaaaaaatggtgtcccccattggccccggggggagagaattttttcacaggaggg

SEQ ID NO: 75901 - DNA, 858 bp, Zea mays
  misc_feature: Ceres CLONE 1560402
  misc_feature: Translation starting site: 188
  misc_feature: SWISSPROT Homolog: EC 1.1.1.22 UDP-glucose 6-dehydrogenase
ctccccgcggtggcggccgctctagaactagtggatcccccgggctgcaggaattcgtctcacccctagaaaaaacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcaggggcaggaacctcttcttcagcactgatgttgagaagcacgtcgctgaggctgacattatcttttgtctcggtgaacacccccaccaagacccgtgggcttggagctggcaaggctgccgacctcacctactgggagagcgctgcccgcatgattgcggatgtctcccagtctgacaagatgtttgttgagaagtccactgtccctgtcaagacgccttagcttatgagaaatcttgaccccaaaaggaaaggcatcaactatccaatcctttcaaccccaaatttccttgcggaaggccctgccctttaagaaccttttcaaaacctaaaaaaaggttttttcgggggccgggaaaacccctcgaggggaagaaaggcccttccacggtcttcaaggaagatggcaccccccccctgggggtcccccaaagaaaacggagatccccctccccccaaaaacccttggtggttccgctctaaacaca

SEQ ID NO: 75902 - DNA, 707 bp, Zea mays
  misc_feature: Ceres CLONE 1560406
  misc_feature: SWISSPROT Homolog: EC 2.1.1.68 Caffeate O-methyltransferase
  misc_feature (593)..(593): n is a, c, t, g, unknown, or other
  misc_feature (608)..(608): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
tggagctccccgcggtggcggccgctctagaactagtggatcccccgggctgcaggaattcgtctcacccctagaaaaagttgtatccgatgccaactccatttaccgcgctccttcagtccatcatacaaatgcctgcagcgctaatcgtaatagccatgggctccaccgccggcgacatgacctcgatagaggacgacgacgcgtgcatgtcccccatgcagatggcctcctcatccatactacccatgacgataaagaacgtcatcgagctgggcctgctgcacgtgctgcacacggaggtcgcgcagcccccaaggcggacgcctgactaccctacgaaggtggttgcccccgaaatcccccgaagcgggccacccaaaacccccccccccccccccccggccccatgtgggaaaaagggtttcccccccccctttttggggttcaaaaaagggggggggggccccaaaggggaaagcggaaaaaccctttttttaaaaaaaaaatttttttttttttcgggggggggagccccccccccccaggagggggggggccccccccccccccccccccgaaaaaaaaaaaanttggtttttttcggncnnnnaggtaaaaaaaaaaaaaaaaaaaaacaagccctcccctccttttaaaaaaaaaaaaaaaaaaaaaaaaattctccctcttctttaaagaaaaac

SEQ ID NO: 75903 - DNA, 846 bp, Zea mays
  misc_feature: Ceres CLONE 1560410
  misc_feature (577)..(577): n is a, c, t, g, unknown, or other
ctccccgcggtggcggccgctctagaactagtggatcccccgggctgcaggaattcgtctcacccctagaaaaagcacgcccgcccgtgatgcccgccgccgcgcgcgtcttcctccttcctccctgctagctccgcgcttccttcccccaccaacgcccgcacccgccaagtcccccaccaacgccgctatagcccgcacctctctagactagggcacccaaacccgagccgtcgtccccattgtgcctctcgacgcgcagccaaacccaaacccttcctcccgacgggcgacggcgatggccgccgcgacagagaagacggctgaggacatccgccgcgagctccaggagctccagtgccagcaccgcgagatcaccgagcgcctgcgcgaccctcgtggccttcgtcgcggcgcccccggccctggtcctagacctgcccccccccccccccgcccgctccgcggcttcgtgagacccatgagcttctcacatgcccccactcattcctcgttttgtttaatcttaatctatttgtgtgcgtgcaagacatttttttcaatgtttatgatgtancatgtgggtgtggaagtggcggattagcctccgcagaagcgttggctgctatcggccgtatttaaagttgatggcgctgaaaaaatgaagatgacacaaaggatgccgatggggaggggcaagaaggcgggttccggtgccactgaatgcagtgaaagggaggatttttaccaattcgtgttagcagtgggaatatagagtaggatcgcaacggtcaacggccgatgtcgaacaaaaaccaagtcggtgggggggtagccacttagaac

SEQ ID NO: 75904 - DNA, 786 bp, Zea mays
  misc_feature: Ceres CLONE 1560413
  misc_feature: Encodes the peptide sequence at SEQ ID NO. 75905
ggcggccgctctagaactagtggatcccccgggctgcaggaattcgtctcacccctagaaaaattccccggctcggctcggcacaggatccggccggccttttcactaaactcgcttcatccgctcagcctccaaccaaccgagagaagccagagaaaaggttactccgcagaaagcaaaaccctagcccactccggcgcgccaccggccgatggtttcgatgagcaccacgccgaagccgcttgactccgccgtcgtcagcgcagccgttgacggcggggatgagggtggtggtggaggcggtgagcgggaagaagcaggcgcacggggcggtgatggcgccgccaccgatggtggtcccggccgcggcgcccgcggccgaggaggaggttcggaaggtcaggaagccgtacaccatcaccaagtcgcgggagagctggacggagccggagcacgacaagttcctcgaggccctgcagctttttgatcgtgattggaagaaaattgaagcatatgttggctcaaagactgttatacagataaggagtcatgcacagaagtacttcctgaaggttcagaagaatggtacgggcgagcatctgcccccacccaggccaaaacgaaaggcagctcatccatatccacagaaggcatccaaaaatgtttctcaagctattttatcacaagaacaacctacccagaagggacaaggtcctggcatgcctatggattctgctactggggaaaaacacaaatgcgaatggggcgggggccttcctggggaca

SEQ ID NO: 75905 - protein, 168 aa, Zea mays
  misc_feature: Ceres CLONE 1560413
  misc_feature (50)..(95): Pfam Name: Myb_DNA-binding Pfam Description: Myb-like DNA-binding domain
MRVVVEAVSGKKQAHGAVMAPPPMVVPAAAPAAEEEVRKVRKPYTITKSRESWTEPEHDKFLEALQLFDRDWKKIEAYVGSKTVIQIRSHAQKYFLKVQKNGTGEHLPPPRPKRKAAHPYPQKASKNVSQAILSQEQPTQKGQGPGMPMDSATGEKHKCEWGGGLPGD

SEQ ID NO: 75906 - DNA, 830 bp, Zea mays
  misc_feature: Ceres CLONE 1560414
  misc_feature: Encodes the peptide sequence at SEQ ID NO. 75907
ctccccgcggtggcggccgctctagaactagtggatcccccgggctgcaggaattcgtctcacccctagaaaaaaagaacagagcgaacagagcaagcagagcgagcgagctgtccggccaaaccctcacggccgcctccacaatgccgcgccatctcgcgctgctcctgcccctgctcctgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgcggcggccggcgggtgggtggcgtggggcctgaacccaaccggcgagggcatggccggcgcgcacgcactagtggcgctggcgggggccggggccgcggcgcccgccgtgcggacatacaacatcacggggtacgtcccgctgggcaaggcctccacgccgctggacttcccggcgaccgacctcgccgcggacgccgcgggcggcaagatccgggtgtacggcaagctgcaactgctcaaggggatgaaggccgtgaaccatgtgtggcatgtcggcgcgtcctccacgggcggcgcccccgacaagcacgcgttccaagcggacaacctcggcgccaagagcaagctcgtcctcgccggcaaagcccccgcggcggccgaggccctctcgaccgccctcgcgcccgaagctggcggcccgtccgcaggcgaaaaaaacaggcccggggcgcatcctcaaacacggcgccctaca

SEQ ID NO: 75907 - protein, 229 aa, Zea mays
  misc_feature: Ceres CLONE 1560414
  misc_feature (88)..(201): Pfam Name: DUF568 Pfam Description: Protein of unknown function (DUF568)
MPRHLALLLPLLLLASPAATRLASAACAGEKFPAGRAYASCEDLPKLGASLHWTYDASKSSLSVAFVAAPAAAGGWVAWGLNPTGEGMAGAHALVALAGAGAAAPAVRTYNITGYVPLGKASTPLDFPATDLAADAAGGKIRVYGKLQLLKGMKAVNHVWHVGASSTGGAPDKHAFQADNLGAKSKLVLAGKAPAAAEALSTALAPEAGGPSAGEKNRPGAHPQTRRPT

SEQ ID NO: 75908 - DNA, 763 bp, Zea mays
  misc_feature: Ceres CLONE 1560416
  misc_feature: Encodes the peptide sequence at SEQ ID NO. 75909
  misc_feature (394)..(394): n is a, c, t, g, unknown, or other
ctccccgcggtggcggccgctctagaactagtggatcccccgggctgcaggaattcgtctcacccctagaaaaaattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcantactggagcaacatcaggtgccccagcaacaacgggcagagcagctggaagaacgcctggaagaaggccggcgcctgcttcgggctcagcgagaagactacttcgagactgccctctccttcgtagcggatcaaccactccgtcgctcaaagcaaagtatcgaactggacttcgggctcaccggcctcaggggatccccaagctttcaaaacgggattaacccaaccccgggaatccagggaacaaggggccccttttaaaaagaaaaaggcggtttccagttttatttttttggccgggggggggaaaagggaatttttatttaaaaggggccccccgccccaaaaaaaaataaacccggtgttcaag

SEQ ID NO: 75909 - protein, 141 aa, Zea mays
  misc_feature: Ceres CLONE 1560416
  misc_feature: SWISSPROT Homolog: EC 3.1.27.1 Ribonuclease T(2)
  misc_feature (100)..(100): Xaa is any aa, unknown, or other
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLNXYWSNIRCPSNNGQSSWKNAWKKAGACFGLSEKTTSRLPSPS

SEQ ID NO: 75910 - DNA, 1179 bp, Zea mays
  misc_feature: Ceres CLONE 1560418
  misc_feature (69)..(69): n is a, c, t, g, unknown, or other
gatgttcgttttttacgtgtgctgagggaggggcaaggatacatatccttgtatattttgttgtccttnctctcaaacaaagaaaaaatggaactcaccgcggtggcggccgctctagaactagtgggatcccccgggctgcaggaattcgtctcacccctagaaaaaaaaccctaagcctttccctcccacacgcgcttcaccccgcacatcgccggcgatgggatccaaggaccaggggcggaggggccgctctcctcgggcggcggcttctatctcgtcgtttcgccgccgggcatgcgcagctgggggcaccggccgtgcacaaaatcccgtcaacggggctgccttggtttatgaaaggcctttgaaagtttttaacccccccgatgggaaggccccaaaatgaagcctgaagaaaaaaacctttttaagggggccccaatggaaaaccaagaaggaatcggggaaaagccatttgtggaaaaaatgataggcaaaaaggtcccattggggaatccagaatgttgtacactccccctttggggaaaccctctcccagaggcaataaaaatttttttggaggccccaagagaaaaatttgtttttcccaaaataaaatgggggttggagagttttccaccccacaacctgtgggggggagtttgtttgaaccacacacccccataatataatattttggggggggaattatttattatcaacactccccccccagggagtggttataaaattattcctaccaaaaagggggggggggcgtttttccccgcggaaatattttttggcggacacaatcaaccgggccctcaaaatgtgggggaagaggctcctcttattaaacaacaccacaccccctttcggggtgggaaaagacttctattaggggaggggtggttggttccccaccccccccggagcgggatatattatttttctttcctcccccgccagcaggaagaagtatataaacttactcacccctctcgcccaggagtggaggggtgtgtccccccgcctgccgctgggataaaagaaacaaacactccttctctatcttggaagggaaggcgcccgccccgcgcgagggggggggcgcaaagaagagtgcgtgtttgtggggaggagacaataatggtggggcgacgccaccacccc

SEQ ID NO: 75911 - DNA, 771 bp, Zea mays
  misc_feature: Ceres CLONE 1560419
  misc_feature: Encodes the peptide sequence at SEQ ID NO. 75912
acccgcggtggcggccgctctagaactagtggatcccccgggctgcaggaattcgtctcacccctagaaaaaattgggagctcactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggtgagcgccgggaacgagccctccgtcctcctactagctgcgatccgtagccttgcgtcgctttcgcgcctagtctagatcgccacgttctagatctgtggtgttttactttcccgggtgcggggtggtcgaaatcccttcatccacccagaagagcttcgtggcttggtcttttgattaagcctccggccttccccccgggggtcggtggaatctgaaaaaaaccgtcccgggggaatctggccctgcctggtaaaatcctcccccggaaaaggttagggaaaggccccttaaagggggggctttaaaaaattttttaaaacccccttgggggggtggcccccccccccccgggggttttttttttttttgccggcccccgctttaaaaaaacccccccaaaaaaaaggggccccccccccgggttttttttttaaaaaaaccccccccgggggggggggggggggggttttttttttttttttttttaaagagaagaggtgtggagaaaaaaaaaaaaa

SEQ ID NO: 75912 - protein, 47 aa, Zea mays
  misc_feature: Ceres CLONE 1560419
TRGGGRSRTSGSPGLQEFVSPLEKIGSSLAGRCLLRIAPRRPHSLRC

SEQ ID NO: 75913 - DNA, 851 bp, Zea mays
  misc_feature: Ceres CLONE 1560420
  misc_feature: Encodes the peptide sequence at SEQ ID NO. 75914
ccccgcggtggcggccgctctagaactagtggatcccccgggctgcaggaattcgtctcacccctagaaaaaaagctagccaagttattagctactacatactagtggccggccggacacgatcgatgggcaggccgccgtgctgcgacaaggcgggggtcaagaaagggccatggacgccggaggaggacatcgtcctggtgtcctacgtccaggagcacggccccggcaactggcgcgccgtgcccgtcagcacgggcctcatgcgctgcagcaagagctgccgcctccgctggaccaactacctccgccccggcatccggcgcggcaacttcacaccccacgaggaaggcatcatcgtccacctccaggccttgctaggcaacagatgggcggccattgcttcttacctcccacagagaaccgacaacgacatcaagaactactggaacacccacctcaagaagaagctccggaagcagcaagccatcggcgccatcttcgcgccacctcccccctccgaacccaccgccggccatgccgattgccgtcgtcacgacatggcccgctcctccaaggacagccacgcttgcctggccgacagcacaccagcggctgatgaggtcgtcacccagctcatcgcccagcagttcgccgccaccgaccgtgacacctcgtcctcctcgtcctactcgtacgcctccagcacggaaaacatctccaggctgcctcaacgccttcatgaaaaacgccttcccgggcgcgggacgaccctacccacaccattaagactttcctcggcccattgaacatcaacccttttcaaccacaagttccggggggggacatcc

SEQ ID NO: 75914 - protein, 227 aa, Zea mays
  misc_feature: Ceres CLONE 1560420
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
MGRPPCCDKAGVKKGPWTPEEDIVLVSYVQEHGPGNWRAVPVSTGLMRCSKSCRLRWTNYLRPGIRRGNFTPHEEGIIVHLQALLGNRWAAIASYLPQRTDNDIKNYWNTHLKKKLRKQQAIGAIFAPPPPSEPTAGHADCRRHDMARSSKDSHACLADSTPAADEVVTQLIAQQFAATDRDTSSSSSYSYASSTENISRLPQRLHEKRLPGRGTTLPTPLRLSSAH

SEQ ID NO: 75915 - DNA, 856 bp, Zea mays
  misc_feature: Ceres CLONE 1560421
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (350)..(350): n is a, c, t, g, unknown, or other
  misc_feature (351)..(351): n is a, c, t, g, unknown, or other
  misc_feature (358)..(358): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (373)..(373): n is a, c, t, g, unknown, or other
  misc_feature (375)..(375): n is a, c, t, g, unknown, or other
  misc_feature (377)..(377): n is a, c, t, g, unknown, or other
  misc_feature (380)..(380): n is a, c, t, g, unknown, or other
  misc_feature (381)..(381): n is a, c, t, g, unknown, or other
  misc_feature (385)..(385): n is a, c, t, g, unknown, or other
  misc_feature (387)..(387): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (696)..(696): n is a, c, t, g, unknown, or other
  misc_feature (815)..(815): n is a, c, t, g, unknown, or other
  misc_feature (816)..(816): n is a, c, t, g, unknown, or other
nnnnnnnnnnnnnnnnnnnnnnnnnnnnnnnnnnnnnnnnttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaactggagctccccgcggtggcggccgtctctagaactagtggatcccccgggctgcaggaattcgtctcacccctagaaaaagcacaccacacaacacaacacaataatacagcaaaggaggctagcagaagtgcaggattaataagctaagctagtagaaattaagcaaagcataggcacagccatggctacctcctctggnntctgccntannntatagcctgntngntgnntggngntgggnnngnnnggggccctttgttcgggccttaaaaggggtttcgggaacaacttgttgtccaaaatttttaaaaaaaccgttgggggcccccagccgcgaaagtcccacccaattaaaaaaagggggggggaaaaaacccccccccggggggggccacaaaaaaggggtttctttttgggggggggggggggtttccctttttttctcccccgggggctctcccccccttttttttccaaaaaaaaaaaagaagttttttttttttccccaaaaaaaaggggggggtgggaaaaaaaaaacccccccncaaaaaataatatttttttggtgaaaaaaaaaaaaaaaaaaaaaaaaaatattttttttgggggggggggggaaaaaaaaaaaaaaaaaaaaaaacccccgtgtgtgccccgcgtgcgnngaaaaaaaaaacaaaatatttttgttttttttgtgggaaa

SEQ ID NO: 75916 - DNA, 854 bp, Zea mays
  misc_feature: Ceres CLONE 1560425
  misc_feature: Encodes the peptide sequence at SEQ ID NO. 75917
  misc_feature (373)..(373): n is a, c, t, g, unknown, or other
  misc_feature (412)..(412): n is a, c, t, g, unknown, or other
  misc_feature (421)..(421): n is a, c, t, g, unknown, or other
  misc_feature (422)..(422): n is a, c, t, g, unknown, or other
  misc_feature (482)..(482): n is a, c, t, g, unknown, or other
  misc_feature (643)..(643): n is a, c, t, g, unknown, or other
  misc_feature (687)..(687): n is a, c, t, g, unknown, or other
  misc_feature (809)..(809): n is a, c, t, g, unknown, or other
ctccccgcggtggcggccgctctagaactagtggatcccccgggctgcaggaattcgtctcacccctagaaaaaagtttgccgctctgtgagcctgctgccgtcttcttccgccgccgccgccgtcgtcgtcttcgtccgtagatcagagagcggggaggaagaaaaagcgatcgatggcgtccaactacgtggacacgccgggcgaggagggacggttccacggccctcacagccacagcaccagcacgaccccgacgggcggcgcggcggcggcggcggcatcgccgcgcaacttccggcgcttctcctccgcgtcctccgcgggccacagccacggcggcggcgggcgggcagaagacgacggcagcagnctcgcggggcggcattacttttttttttcacaccccccncctcccccnncaacaattttctcattccccacctacctactatttatcctctcaaccttttctcctctcnaatcatacccctcctcttcaacctaacacaaaaatatttaaaaaaatttcccattttcctccccccccccattctaaacccctccttttaatttttctctaaattcccaaaatcctattctaaatcctccccttaaaaaatttcataccaatttctatacnaatactatttctaatatttatacccaaccttttttccaaacaanaaaaaatattctatccccccactttaccccctctcctctttttttacattaaaaccatctcacttttttccctctctatactctcataaacacaatattttccctccccataaaataattanttaaattatttaatcaaccccccctatttattataactatcccca

SEQ ID NO: 75917 - protein, 110 aa, Zea mays
  misc_feature: Ceres CLONE 1560425
  misc_feature (66)..(66): Xaa is any aa, unknown, or other
  misc_feature (83)..(83): Xaa is any aa, unknown, or other
  misc_feature (103)..(103): Xaa is any aa, unknown, or other
MASNYVDTPGEEGRFHGPHSHSTSTTPTGGAAAAAASPRNFRRFSSASSAGHSHGGGGRAEDDGSXLAGRHYFFFSHPPPPPXTIFSFPTYLLFILSTFSPLXSYPSSST

SEQ ID NO: 75918 - DNA, 773 bp, Zea mays
  misc_feature: Ceres CLONE 1560427
  misc_feature: Encodes the peptide sequence at SEQ ID NO. 75919
ctccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtggggacacgcggggcctctcggccgacccgggaagaaacatccgccgcgccaaaccgggaaactggggaggggaaatccccccccccccggggggggcaaaatttctgggggcccccctgggggtctttcctttttttcccccgggagaaaaccttgggccccaaaaaaaaaggggggttttaaaattttttttccaaaaaaaaaaaaatttttttttttttttttttaaaaaagagggggggggggggggccccccaaaaatataaatatttttttttggggaagggggggggggggggggggttatattcatcggggggggaaaaaccccccacccaccttggggggggcgcgaaacaaaaaaaaaaaattttccccctcctcttggttgggggggggg

SEQ ID NO: 75919 - protein, 149 aa, Zea mays
  misc_feature: Ceres CLONE 1560427
MAASALHQTTSFLGQALVSRAAGVDAGGRITMRRTVKSVPQSIWYGPDRPKYLGPFSEQTPSYLTGEFPGDYGWGHAGPLGRPGKKHPPRQTGKLGRGNPPPPGGGKISGGPPGGLSFFSPGRKPWAPKKKGGFKIFFPKKKKFFFFFF

SEQ ID NO: 75920 - DNA, 873 bp, Zea mays
  misc_feature: Ceres CLONE 1560430
  misc_feature: Translation starting site: 188
  misc_feature: Pfam Name: DUF179 Pfam Description: Uncharacterized ACR, COG1678
  misc_feature (402)..(402): n is a, c, t, g, unknown, or other
ctggagctccccgcggtggcggccgctctagaactagtggatcccccgggctgcaggaattcgtctcacccctagaaaaaattcatccatcacttgcggactcgcctcgtgcgcttccatttccactccgacccggccggcgacccgccccccggtccccggagcgaccgaggcctcgctcaccgacatgtgggccctcaacaacgccaaggccggcggaccctgcctcacgccgcggcacccagcgccgccctcccttgcgtcgccgtcgacggcatcggctgggcggaggttctggaggcgcagccccgtgtgggcgcccctggtggcggtgcgtgcgtcggggggcacgaggaaggacggctccgtcggtggcgaggccagcggcgaggaagccgatancaaggcgtcgtctgccgggcatgatgatgcatctaccccaacaggggatacctctgctgggttgaaccaatcgcatgacgaaccaaaaacaagcaagccgattaatgtttctagcagcaactactggcgagatgtcagggcaaaccttgtgcgtcgggaacaggagctattagtggatccaagtactccatcagagtcgaaggcgtcctcaggagatccattacagctccctcaaaatgggctcatgctattacgatgccagaggcaggatgcgttctggttgctaccgaagcgctagacgacgacagcatcttcgaaagaaacgtcatcttcctcctcaggctcggtacaaggggcacgttccacaggcccgttcggagtcatcatggaaccgtccgctctacaccaagatccagcacgtggaaccgaatgttcccgagaccaggggaacgccctttggcggactccccc

SEQ ID NO: 75921 - DNA, 813 bp, Zea mays
  misc_feature: Ceres CLONE 1560432
  misc_feature: Encodes the peptide sequence at SEQ ID NO. 75922
  misc_feature (1)..(1): n is a, c, t, g, unknown, or other
  misc_feature (718)..(718): n is a, c, t, g, unknown, or other
  misc_feature (777)..(777): n is a, c, t, g, unknown, or other
naaagctggagctccccgcggtggcggccgctctagaactagtggatcccccgggctgcaggaattcgtctcacccctagaaaaattccttcactgccagtcttgcatcccgtccccgtccgcgccggccgacgccgccttttcgtccccgcgtcagcgtcgcggctccactgagcgtgcgtgtcaccggcgggaggcaagggcaggcggtggtggcgatggcgtccgctgacgcgcgcttggcggggatcgcctcctccatccgcgtcatccccgacttccccaagccagggatcatgttccaggacatcacgacgttgctgctcgatcccaaggcgttccgtgacaccatcgacctctttgtcgagcggtacaaggaccaagggatcaccgtggttgctggtgttgaagctagagggttcatttttggtcctcctatcgctttagccattggcgcaaaatttgtgcctttgaggaagccgaagaagttgccaggcgaggtgatctccgaagagtattctttggaatatggaactgacaagatagaaatgcatgtcggagctgtacaggccaacgaccgggctcttgtagtcgatgatcttattgctaccggtggaacactatgtgcagctgtcaaacttattgaaacgtgtggagcaaagggttgtttgagtgtgctttgtgtcatttgaattgccagaactgaagggccgagacnagctgggggacagggcagttttttgtccttggtggaagcagaccgcctggagcgaaacntggggacttctcagaagagtttggcccccgtcgatt

SEQ ID NO: 75922 - protein, 157 aa, Zea mays
  misc_feature: Ceres CLONE 1560432
  misc_feature (30)..(158): Pfam Name: Pribosyltran Pfam Description: Phosphoribosyl transferase domain
  misc_feature: SWISSPROT Homolog: EC 2.4.2.7 Adenine phosphoribosyltransferase
MASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIETCGAKGCLSVLCVI

SEQ ID NO: 75923 - DNA, 797 bp, Zea mays
  misc_feature: Ceres CLONE 1560434
  misc_feature: Encodes the peptide sequence at SEQ ID NO. 75924
tggcggccgctctagaactagtggatcccccgggctgcaggaattcgtctcacccctagaaaaaacaccacacaacacaacacaataatacagcataggaggctagcagaagtgcaggattaataagctaagctagtagaaattaagcaaagcataggcacagccatggctacctcctctggttcttgccttattattagcctgttggtggtggtggtggcggcggctctgtcggcctcaacggcgtcggcacagctgtcgtcgacgttctacgacacgtcgtgccccaacgcgatgtccaccatcagcagcggcgtgaactccgccgtggcgcaacacgctcgtgtgggggcgtcgctgctccggctccacttacacgactgcttcgtccaaagatgcgacgcgtccattctgctgaacgacacgtgcggggagcagacccagccgccgaacctaactctgaacccgagggccttcgacgtcgtcaacagcatcaaggcgcaggtggaggcggcgtgcccgggcgtcgtctcctgcgccgaaatcctcgccgtcgccgcccgcgactgagttgtcgcgctcggcgagccttcatggaccgtgcttctgggcagaatgactcgacaggttcgttccctagccagtacagcgacctcccacctccgacgttaagcctccaacactgttaacccccgtcagcaagaaaaacctccacgcgaccgaacagggtcgctctctcggcgctcatacaatcgagggaggcccagtggtcaaagcttaacgggccaatctaaaac

SEQ ID NO: 75924 - protein, 134 aa, Zea mays
  misc_feature: Ceres CLONE 1560434
  misc_feature (47)..(135): Pfam Name: peroxidase Pfam Description: Peroxidase
  misc_feature: SWISSPROT Homolog: EC 1.11.1.7 Peroxidase
MATSSGSCLIISLLVVVVAAALSASTASAQLSSTFYDTSCPNAMSTISSGVNSAVAQHARVGASLLRLHLHDCFVQRCDASILLNDTCGEQTQPPNLTLNPRAFDVVNSIKAQVEAACPGVVSCAEILAVAARD

SEQ ID NO: 75925 - DNA, 842 bp, Zea mays
  misc_feature: Ceres CLONE 1560436
ctcaccgcggtggcggccgctctagaactagtggatcccccgggctgcaggaattcgtctcacccctagaaaaaattccccggatcggctcggcacttgatgacggacggccgtgtcactaaactggcttcatgagctcagcctccaaccaacagagagaagccagagaaaaggttactccgcagaaagcataaccctagcccactccggcgcgccaccgggcgatggtttcgatgagcacctcgccgaacccgcttgactccgccgtcgtcagcgcagccgttgaccgcggggtatgagggtggtggtggaggcggcggccggaaaaaacacgccctcggacctgagatgggagttccccggatactgctggtgggacaccgcgggcctctcgaccaacacgtagacattggcgcgcaaccgggagctggacgtgatccactcacagctggagatgctgggagcactgggctgcgtgttcgccgagatcctggccgataacggctgcaagtacagcgaggcggtgtggttctaggccagcgcgcagatcttctgagagggcgggctggactacctggggaaccccaacctggtgcacgcgcagagcatccctgggcctctgggcgtggcaggaggtgctcatggggcttcttccgagggctaccgcgtacaggggcggcccggttcggggttagggcctcgaccaaggtgtaccccgaggggggcccctttcaaacccgctggggcctgcgccgaagaaccctggtaaacccaaccccccaagctccaatgggggaaggaagactcaagaaacgggccgcccccttgccaagtgtttctcc

SEQ ID NO: 75926 - DNA, 873 bp, Zea mays
  misc_feature: Ceres CLONE 1560438
  misc_feature: Encodes the peptide sequence at SEQ ID NO. 75927
  misc_feature (693)..(693): n is a, c, t, g, unknown, or other
acccgcggtggcggccgctctagaactagtggatcccccgggctgcaggaattcgtctcacccctagaaaaaatctcatctctctccccgacctcccagctctagagtctagacagccacaggcaggagctccacgagtccacgtgacctcagacctcacacattcacagtgtcacgctgcctcaacgtcatgtctctcctcgcctcccccacgccgttcggcgtgaccgccatccgccgccgcgtcgccccgcttcctctcctccctgctggcggtcgcgccgccctgcacgtggccctcgcgcgccgcggcggggtctcgtcccggacgcagcggcgcctcgaggaacgaggaggcaagaagcgccgcggtggggtcgtggcgcccgacgtggacgaggacgcggcggaggcgggggtggctgagtgggaaggggagccgctggggttcgaggtgtcgacggagcccatgccgcggctgccagacccggagacgcccgacttctgggagggacctcagtgggaggccctcggcttcttcgtgcagtacatgtgggcgttcggcgtcgtcttcggcctcattgcttgcggtgtcgctgtggccacttacaacgatggtgcaacagatttcaaagacacgcctgcttacaaagagtcccaatcacaggagttccctgaggagtcagaatcatncagcgctgatgtgtttgagggcatccgactgaggtagcaccagctctcgagtaggactattcaagaggcacggggaaaaagttgtctctcgattcaagctataaccctatagggcttcgccttcgcaatataaatccaaagttttggtttgaagatgctaagaaaaatggctgggaaata

SEQ ID NO: 75927 - protein, 179 aa, Zea mays
  misc_feature: Ceres CLONE 1560438
  misc_feature (168)..(168): Xaa is any aa, unknown, or other
MSLLASPTPFGVTAIRRRVAPLPLLPAGGRAALHVALARRGGVSSRTQRRLEERGGKKRRGGVVAPDVDEDAAEAGVAEWEGEPLGFEVSTEPMPRLPDPETPDFWEGPQWEALGFFVQYMWAFGVVFGLIACGVAVATYNDGATDFKDTPAYKESQSQEFPEESESXSADVFEGIRLR

SEQ ID NO: 75928 - DNA, 1031 bp, Zea mays
  misc_feature: Ceres CLONE 1560454
  misc_feature: Encodes the peptide sequence at SEQ ID NO. 75929
  misc_feature (53)..(53): n is a, c, t, g, unknown, or other
  misc_feature (419)..(419): n is a, c, t, g, unknown, or other
  misc_feature (420)..(420): n is a, c, t, g, unknown, or other
  misc_feature (428)..(428): n is a, c, t, g, unknown, or other
aaagctggagctcaccgcggtggcggccgctctagactagtggatcccccggnctgcaggaattcgtctcacccctagaaaaaaccattatcactcaggcggaaacgcgccggagggagggagagaggaggggcgtgggtggctgggccgagcgactcctccttccagtccaccgctataaagccccgcaggcctggcgagtcccgacggttccattactggtccctagcatgaagcaggatggagttggcgctcagcttgggggagaccatggcggatgccgggagggacctcatgctggggcttgggatggcggtcggggtgcggaatcaccaccacccacatagagcttctcccacgccccgagcaccgggaggagtaggtggtaccctttttaaattaccccccctctgggggannaacagatnaatgtctaaatccgaggtcccccaacaacgtccagggtctagcgttggtctttttacaatcagggcgcacttctccctccccccgattgacttttttgcccctttcgaggccgaatttatctccgaccaaccttctggaacactcaaccttcgttccaccctataaccccttttccatccgttaaacatgcgaacgttattaccaagaaaatatttggtagtcctctcctccgttaaaaatgtggttgccccatcctttgcgacccataataaatgggcaaatttccttgtatctttaggtcaccaacttgtattttgggtccggtcttcacaagactattatctgattcctctatcctccttatttacgctctgcaatgattttccgagacatactttaccgtcactcatcacttctgaacacccacaaccttattatgtcttgacgcccctttcttttttgtcggtattatccttactgaatccttggggaaatccccgattgagacgtttcgtcccctggtgtaccccagtttctacattgcttttcaatcctcatacacctctgtggcacttacgtacgtgaattacatgggtctcagg

SEQ ID NO: 75929 - protein, 117 aa, Zea mays
  misc_feature: Ceres CLONE 1560454
  misc_feature (60)..(60): Xaa is any aa, unknown, or other
  misc_feature (63)..(63): Xaa is any aa, unknown, or other
MELALSLGETMADAGRDLMLGLGMAVGVRNHHHPHRASPTPRAPGGVGGTLFKLPPLWGXNRXMSKSEVPQQRPGSSVGLFTIRAHFSLPPIDFFAPFEAEFISDQPSGTLNLRSTL

SEQ ID NO: 75930 - DNA, 886 bp, Zea mays
  misc_feature: Ceres CLONE 1560455
  misc_feature (456)..(456): n is a, c, t, g, unknown, or other
  misc_feature (457)..(457): n is a, c, t, g, unknown, or other
  misc_feature (463)..(463): n is a, c, t, g, unknown, or other
  misc_feature (611)..(611): n is a, c, t, g, unknown, or other
aaagctggagctccccgcggtggcggccgctctagaactagtggatcccccgggctgcaggaattcgtctcacccctagaaaaatcgacgagctcgcgcagaacaagcgcgccttcgccgccgccgccgcctcgtcggcggcggccaccacctcgacgtcgctgggcaacgacaaccgttcctcctcccccgcgtgcgcgcgggagcacctcttcgacaaggcggtcacccccagcgacgtgggcaagctgaaccggctggtgatcccgaagcagcacgccgagaggcacttcccgctgcatctcgcggccgccggcggcggcgagagcacgggcgtgctcctcaacctggaggacgcctcggggaaagtgtggcggttccggtactcgtactggaacagcagccagagctacgtgctcaccaagggctggagccgcttcgtcaaggagaagggcnnctcagncggcgacgtcgtcggcttctaccgttccgcggccgggcgcgacagcaagctcttcatcgactgcaagttgcgacccaacagcgccgaaaccgcctcgacgacaagccgcgtggggctatcgcctccccggggcccggggggaaaggcngggcttttttttggggtcaatttgtttaagggcccggggggaacccttgggccgggtgcaaaaaaaacaggaaatttgtcctttccccccccggggggggaaaaaaaaaaaaatctgggggagggggggccctcttttggggaaacacaggtttcgggggggggggggagtttttttttttttataaaaaaaaaaaaacaagccctttttttttttgtggtgccccccccccccccccaaaaaagaggggacccccgcgggccgatgaaattttt

SEQ ID NO: 75931 - DNA, 819 bp, Zea mays
  misc_feature: Ceres CLONE 1560459
  misc_feature: Translation starting site: 175
  misc_feature (643)..(643): n is a, c, t, g, unknown, or other
ccgcggtggcggccgctctagaactagtggatcccccgggctgcaggaattcgtctcacccctagaaaaaatctcccgcaacgcaagcgcaacagaagcatactacgccgctacgcgctgggcggtgccgcacaggcacagctatagatactactccagcagtgttgcatagaaatggacagcggcagcagcctcgtggacgacaccagcggcggcggcgcgtgcacggacaagctaaggtctttggccgccgccgccgccgccgccgcctccgcctcggggccaccgccggagcgcatgggcagcggggccagcgcggtcgtggacgcggccgagccgggcgccgaggcggactccggctccgccccggcctccgtcgccgccgccgtcgcggcgggcgtgggcgggaagctgccgtcgtccaggtacaagggcgtggtgccgcagcccaacgggcggtggggcgcgcagatctacgagcgccacctgcgcgtgtggctcggcaccttcgcgggcgaggccgacgcggcgcgcgcctacgacgtcgcggcgcagcggttccgcggccgcgacgcggccaccaacttccgcccgctcgcggacgccggcccggacgccgccgccgagctccggttcctggcgntccgctcaaggccgaagtcgtcgacatgctgcgcaagcacacgtacttcgacgagctcgcgcagaacagcgcgccttcgcggcggccacccactcgacgtcgctgggcaacgacaacggttcctcctcccccgcgtgcccgccgggagcacctcttcgacaaggccggcacccccc

SEQ ID NO: 75932 - DNA, 780 bp, Zea mays
  misc_feature: Ceres CLONE 1560465
  misc_feature: Encodes the peptide sequence at SEQ ID NO. 75933
  misc_feature (484)..(484): n is a, c, t, g, unknown, or other
  misc_feature (487)..(487): n is a, c, t, g, unknown, or other
  misc_feature (511)..(511): n is a, c, t, g, unknown, or other
ctccccgcggtggcggccgctctagaactagtggatcccccgggctgcaggaattcgtctcacccctagaaaaagcttgcttcgcttcacctgcccccctgcccacattttccttccttccttccctcccgtcgccgcctgaaaccgcgacagcaagggtcgcacagagcaaggacgacgacgagaaggctcggttcggctcttcccagtctctccgagggagcaaggagaggatcggagggtgcgatggcgatcgaccacgagtccccgttcaaggagctccgcctcaagaaccgcaggatcatgggcggcggcggccctgaccctgagccggaggaggaggaggcggccacggcggcgtacgcggggcagtggccgcgctggctgcagccgctgctttcggcgcgcttcttcgcgcactgcaggacgcacggcgactcgcaccgcagcggcgagtgcaacatgttctgcctggactgctccnccncgggtgcgggcgcgggcccccccnccctgtgcttactgtgcctggggcaagcccaccgggacacccaaacatccggattcggggcttctcctaacccaaagtttttccgggggtccaaaattccggggttttttggacatcgccggggggggaaacttttgttttttaaaagggccccgggtttttttttctttaaaaaagggccccccaaaaaaaaaagccttggaaattaaagggccccctttggggtttcccccaaaaccttctgggggaggggggtcccccccccaact

SEQ ID NO: 75933 - protein, 157 aa, Zea mays
  misc_feature: Ceres CLONE 1560465
  misc_feature (80)..(80): Xaa is any aa, unknown, or other
  misc_feature (81)..(81): Xaa is any aa, unknown, or other
  misc_feature (89)..(89): Xaa is any aa, unknown, or other
MAIDHESPFKELRLKNRRIMGGGGPDPEPEEEEAATAAYAGQWPRWLQPLLSARFFAHCRTHGDSHRSGECNMFCLDCSXXGAGAGPPXLCLLCLGQAHRDTQTSGFGASPNPKFFRGSKIPGFFGHRRGGKLLFFKRAPGFFFFKKGPPKKKSLGN

SEQ ID NO: 75934 - DNA, 964 bp, Zea mays
  misc_feature: Ceres CLONE 1560467
  misc_feature: Encodes the peptide sequence at SEQ ID NO. 75935
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (96)..(96): n is a, c, t, g, unknown, or other
  misc_feature (464)..(464): n is a, c, t, g, unknown, or other
naaaatttnnnnnnnnnaaannnnnnnnnnnnnnnnnnncnnnnnnnnnnnnnnnnnnnnnnnnnnnggacaaatgannnggcgggaggcctgaangtggaggcggccgctctataacagtggatcccccgggctgcaggaattcgtctcacccctagaaaaaactcctctcctctcaacctaccctaaccgccgccgccgcccgccgtcctttcctgtataataaaacctcaaatcgtctctctcccgtcctcccctccaccgccgcagccgccgccgtacctcctcctcccgcgcagtagccaccgccaccgccggaaatgaagaccatcctggccacggagacgatggacatccccgagggggtcacggtcacggtggcggccaagctggtgacggtggaggggccgcgcggtaagctcacccgcaacttcaagcacctcaacctcgacttccagctgcangacggcggtcgcaagctcaaggtcgacgcctggtttggcacccgccgaaccatggccgccatccgcaccgccatctcccacgtccagaaactcatcgcaggcgtcaccaaaggtttcccgctacaagatgcgggttcgtctacgctcacttttcccatcaacggcttccatcaccaaacgccaacatccggccatttgaagaaccccaacctcccctcccgggaaaaaaaaagggcaaggaaaggtttaaaaatgccttgaaagggggggaccacttcttgggctttcaaaaaaaaagggccaggggattaaacctttggttctttggaaagggaaaaaaaatgttttaaaactttgtttctttttcctcccgcgtggggtttttctttaaacaccccaaaaatgccccttgttcccaaaaaaaaaaagagatattcccggaaaatattcctttgggccggggggtttcctattttggagaggaaaccaaaaggggccca

SEQ ID NO: 75935 - protein, 134 aa, Zea mays
  misc_feature: Ceres CLONE 1560467
  misc_feature (12)..(86): Pfam Name: Ribosomal_L6 Pfam Description: Ribosomal protein L6
  misc_feature (48)..(48): Xaa is any aa, unknown, or other
MKTILATETMDIPEGVTVTVAAKLVTVEGPRGKLTRNFKHLNLDFQLXDGGRKLKVDAWFGTRRTMAAIRTAISHVQKLIAGVTKGFPLQDAGSSTLTFPINGFHHQTPTSGHLKNPNLPSREKKRARKGLKMP

SEQ ID NO: 75936 - DNA, 913 bp, Zea mays
  misc_feature: Ceres CLONE 1560471
  misc_feature: Encodes the peptide sequence at SEQ ID NO. 75937
  misc_feature (424)..(424): n is a, c, t, g, unknown, or other
ctccccgcggtggcggccgctctagaactagtggatcccccgggctgcaggaattcgtctcacccctagaaaaaagaccaccactgcgccattggccagctagagccaaccagaagagcttgcagttactgagagtgtgtgagagagagaggatgatgggtggcagcggcagggctgctctgctgctggccctggtggccgtgagcctggccgtggagatccaggccgacgccgggtacgggtacaccccgacgccgacgccggccaccccgaccccgaagccggagaagccccccaccaaggggcccaagccggagaagccgccaaaggagcacaagccgcccaaggagcacgggcccaagccggagaagccgcccaaggagcacaagccgacgccccccacgtacacccccgagccccaaancccacggctgccggacgtacacttcccaccccgaacgcccccccaagcccgaagccccccccacttacacttccccgcccccttacgcccccaaaaaaacccatttcccaattcccttccgaaggttaaacccccctttcccccccaaaaccctttccgaccacccttaaagcccgaacccccccccccaaaaagttaaattccccccaagccccccccaagccccccccggggttttgaaagaagccttccccccccccccccccaaatagctttaaaccccccctccgggaagagataaacccccccctttttttttcttcccaaagtccccctccgcaccaccccttaaagtgtggggagcccccccgccgctaagtgatgagaacctctctcccaaggaggccccccccataaaccccgaccggggggggggtgttataatatgagtactgcccgttcgcgcgcgagagacaccctcagattttc

SEQ ID NO: 75937 - protein, 155 aa, Zea mays
  misc_feature: Ceres CLONE 1560471
  misc_feature (90)..(90): Xaa is any aa, unknown, or other
MGGSGRAALLLALVAVSLAVEIQADAGYGYTPTPTPATPTPKPEKPPTKGPKPEKPPKEHKPPKEHGPKPEKPPKEHKPTPPTYTPEPQXPRLPDVHFPPRTPPQARSPPHLHFPAPLRPQKNPFPNSLPKVKPPFPPQNPFRPPLKPEPPPPKS

SEQ ID NO: 75938 - DNA, 822 bp, Zea mays
  misc_feature: Ceres CLONE 1560475
  misc_feature: Encodes the peptide sequence at SEQ ID NO. 75939
  misc_feature (734)..(734): n is a, c, t, g, unknown, or other
  misc_feature (822)..(822): n is a, c, t, g, unknown, or other
ctccccgcggtggcggccgctctagaactagtggatcccccgggctgcaggaattcgtctcacccctagaaaaaaagttgggaggggagcacgtgcccaggtgcccgtccaggatccaccacaaccgccagtgccttttacaggtcatgccgcggacggcactgcttcgccttactgcagcttcgacgcgcgcgtcctcggctcccgcggcgcggcggctgtactcgtcctcacactcacacggacacggcagcgaggagcacgcgatcactcgggaggatgagcagcttccaccgccgccccacgggccggaccccggcgtgcggcggctgcctcgtcgccgtggagagcatcggagagagttattatctgtcacaatggcctccagagatcacactggcttgacccgacaacttcttgattttcaacatgatacaatagatgaggtaggcgcaggacatgacccattcattgatttgaaagcgagattcatggactttaaacagagaaactatgtggaaaaattttcaaattaccaaacccttgctgagcagcaaacaccaaagttcatggtggttgcttgtgctgactccagggtctgccctaccgctgttttggggtttcagcctggggaagcatttacagttcgtaatgtggcaaaattggtaccaccatatgagcatggggggacagagactagtgcagcactagagtttgctgtcaataccctccangtaagaaatgtactggtgataggccacagtaggtgttgggggcatccaggcactaatgagcatgaaagatgattcgacctccggaagn

SEQ ID NO: 75939 - protein, 219 aa, Zea mays
  misc_feature: Ceres CLONE 1560475
  misc_feature (134)..(220): Pfam Name: Pro_CA Pfam Description: Carbonic anhydrase
  misc_feature: SWISSPROT Homolog: EC 4.2.1.1 Carbonate dehydratase
  misc_feature (196)..(196): Xaa is any aa, unknown, or other
MPRTALLRLTAASTRASSAPAARRLYSSSHSHGHGSEEHAITREDEQLPPPPHGPDPGVRRLPRRRGEHRRELLSVTMASRDHTGLTRQLLDFQHDTIDEVGAGHDPFIDLKARFMDFKQRNYVEKFSNYQTLAEQQTPKFMVVACADSRVCPTAVLGFQPGEAFTVRNVAKLVPPYEHGGTETSAALEFAVNTLXVRNVLVIGHSRCWGHPGTNEHER

SEQ ID NO: 75940 - DNA, 830 bp, Zea mays
  misc_feature: Ceres CLONE 1560479
  misc_feature: Translation starting site: 157
  misc_feature: SWISSPROT Homolog: EC 3.1.3.25 Inositol-phosphate phosphatase
  misc_feature (50)..(50): n is a, c, t, g, unknown, or other
  misc_feature (60)..(60): n is a, c, t, g, unknown, or other
  misc_feature (61)..(61): n is a, c, t, g, unknown, or other
  misc_feature (312)..(312): n is a, c, t, g, unknown, or other
  misc_feature (336)..(336): n is a, c, t, g, unknown, or other
aaactggactccccgcggtggcggccgctctagaactagtggatcccccngggctgcagnngaattcgtctcacctcctagaaaaaagaattgctgctgggtgctggccgttgcgggcgaaccgaaaatcacgggcgcgagagatcggagcacggcatgtcggaggagcagttcctcgccgtggcggtggaagccgccaagagcgccggcgagattattcgcaagggattctaccagaccaagaacgtcgagcacaagggccaggtggatttggtgacggagacggacaaggcctgcgaggacctcatcttncacccactccggaagcacttcccnggacccacagtcatcgggggagggagagtcccgcgcgctcggggccaccgctgaccctcacgacgaccccacctggatcgtcgatcccctcgacgggaccactaatttcgtccatgggtttcccatttgaatgtggtctccggttgggcctccccctgggggaaaattccccctgtctggaatcgtctttaaccccctttaaggaaagaactttttcccggggggttcttgggaaaaagagggtttcccggaaaggggccccccaattaaaaccctctctttcccaaagaaatttgggggaggggtttcttttggggaaacaaagggggtgaaaccccttttgggcccaaacccccccttgggggggttatatcccccccccaaaaatttccggggggttttttattaaaagattttcttccctccccccgggggggggggggaaaaattggggttttaaaaaaaaaattggggggagaactccccccgggggg

SEQ ID NO: 75941 - DNA, 821 bp, Zea mays
  misc_feature: Ceres CLONE 1560480
  misc_feature: Encodes the peptide sequence at SEQ ID NO. 75942
  misc_feature (1)..(1): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
naaagctggagctcaccgcggtggcggccgctctagaactagtggatcccccgggctgcaggaattcgtctcacccctagaaaaaaatcaaacgcaggccgcagtcgcgtgcggaactagagctccttcagagaagtgccgtgccagtgccaccgccggccgcatcatcgttccgcccccctgagtgttcagtaacttcttccgatccatattatggcttcaaagcagcagcagaaacagttcctggatgaagccatgatcaagcagccgacaccggaggaggaccgtgagggcgcatggccctcagtgctgacgatcatcggctttggattcctaaccttcaactcattcatggctgtgtacaggtcaaatggagatgttggatctatctcctttgtggtcttctcttacctggtcctcgttctgctgttctactgcctgcgccgattcgagacaactccaccagagtcgcctagccgggagcacataaaaatggccgtgtgggtactcaccacgatgctcactgctgcgttctcatacaaggtggcagcaattatgccactcccggtgcaggtgctggtgtgggcaatggcaggagcaactgtgttcggtgggtttttatgctttcttcatccaccaggaaaaaaccgcccagctggaacccccaaaaccataacgagggtgcccgtcctgctagccggtgtgcttgctgtgcgatcgtttggcatgtgcttgttgaggtgtaggatgnnnnnnnnnnnnnnnnnnnnnnnnnnnnnnnnnnnnnnnnnnnnnnnnnnnnnnnnnnnnnnnnnnnnnnn

SEQ ID NO: 75942 - protein, 179 aa, Zea mays
  misc_feature: Ceres CLONE 1560480
MASKQQQKQFLDEAMIKQPTPEEDREGAWPSVLTIIGFGFLTFNSFMAVYRSNGDVGSISFVVFSYLVLVLLFYCLRRFETTPPESPSREHIKMAVWVLTTMLTAAFSYKVAAIMPLPVQVLVWAMAGATVFGGFLCFLHPPGKNRPAGTPKTITRVPVLLAGVLAVRSFGMCLLRCRM

SEQ ID NO: 75943 - DNA, 849 bp, Zea mays
  misc_feature: Ceres CLONE 1560482
  misc_feature: Encodes the peptide sequence at SEQ ID NO. 75944
  misc_feature (584)..(584): n is a, c, t, g, unknown, or other
  misc_feature (641)..(641): n is a, c, t, g, unknown, or other
ctccccgcggtggcggccgctctagaactagtggatcccccgggctgcaggaattcgtctcacccctagaaaaagaaacatagtgcagcaagcaactgcaaagcagcaagctctactcttcttctgtactgaacgtgtgactagataacaataagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggcggtggctacaacaagtccggcggcggcgatgactacggccgtagcggcggcgacgactacggccgtggcaccggcggtggcgggtacaacaagtccggaaacgacggctacgacagcgggtacaacagatcgggcaccaccaacgacgacgaatacggccgtggcaccggcggcgggtacggcagcaagccctctggcgacgacgcgtacnccggcggcggcggtggcgggtacggcaagcagtccggtggaagcgcggacaagggcngaaagtacggctcctcccgggacgactcggagaagttcaggaaaggaggagaaggagcaccagcaccagggagcacctcggcgagattgggcgccctcgccggcgggggccctttcgccctggtacagaaggcacgaaggcgaaaaaaggaccccggagcacggcgcagccggcacaaagatccaaagaaaggccttggccggccgtt

SEQ ID NO: 75944 - protein, 228 aa, Zea mays
  misc_feature: Ceres CLONE 1560482
  misc_feature (141)..(141): Xaa is any aa, unknown, or other
  misc_feature (160)..(160): Xaa is any aa, unknown, or other
MADEYGRSGYGRSGAGDDYDSGYNSKSGTDDYGRGEGGYNKSGGDDDYGRSGGDGYGRSGGDDYGRGTGGGGYNKSGGGDDYGRSGGDDYGRGTGGGGYNKSGNDGYDSGYNRSGTTNDDEYGRGTGGGYGSKPSGDDAYXGGGGGGYGKQSGGSADKGXKYGSSRDDSEKFRKGGEGAPAPGSTSARLGALAGGGPFALVQKARRRKKDPGARRSRHKDPKKGLGRP

SEQ ID NO: 75945 - DNA, 858 bp, Zea mays
  misc_feature: Ceres CLONE 1560483
  misc_feature: Translation starting site: 240
  misc_feature: SWISSPROT Homolog: EC 1.11.1.11 L-ascorbate peroxidase
  misc_feature (159)..(159): n is a, c, t, g, unknown, or other
  misc_feature (801)..(801): n is a, c, t, g, unknown, or other
  misc_feature (828)..(828): n is a, c, t, g, unknown, or other
ctggagctccccgcggtggcggccgctctagaactagtggatcccccgggctgcaggaattcgtctcacccctaaaatttgtgctacggctatcgaggaagctggtggtccaatacttcctatgaaatataggacgtgttgtatgtaccatcttctgancatcgtccgcccgtaggggtagcttcctgatgctggccctctcgatcctgctgaacaccttatgagaggtttttttttgaatgggccttgatgactatgatattgttgcactactcgggtgctctcgctcttggaagagcatggactcgaccgcgagcggctggggaaaccttcttgcttgctaccctccggatgggcctggtgagcctggacgggtttctggacgcttccagtgcgttgaacttcgataatagctactcctctgacatcatctcatctttttccgaacatcattcaagacctgcactttttgagccttcttccctgcaataagcaaacagaacatgatcttctcgttttgcctccacacgctgcattatctgaagacccatccttcccggtttactctgacttgttcgctatggaccaacatgcgttctttagaactatggtgaagctcatgctgaactcaccgatctcggtgcaaattgcgatccccctgacggattctctctcgacgatgacacaatgtcttctccgtgcattactagatgactgctagacccatcactcggttcggtcatgaagcgtgcagcagcgatcagctactgccggaacgacagtctacggacgcagactccnctagccagaagacccttcgtcccctgnccaacattctccgtaatgggctatgaagcg

SEQ ID NO: 75946 - DNA, 830 bp, Zea mays
  misc_feature: Ceres CLONE 1560487
  misc_feature: Encodes the peptide sequence at SEQ ID NO. 75947
  misc_feature (738)..(738): n is a, c, t, g, unknown, or other
  misc_feature (786)..(786): n is a, c, t, g, unknown, or other
ccccgcggtggcggccgctctagaactagtggatcccccgggctgcaggaattcgtctcacccctagaaaaaaaaaacagcgagtgtcatccagtgcaagctcccagtcccagggtagtagaggactagaggcaggctagagcaaagcacgcggattgcgtggctagcgcaataatggcgatggccacggccaagctcgtccttctcatggtcctcgtggccggcagctccagcggcggcagcgcgtgggggccgctgatgagccgcctccggatgccgacggcgcggtcgtccgtggaggtggcggcggagcgcctccaggaggactacgtcgtatcggcggctgcgccgctgatccacgcgctgcggccgctgctgggctccgcgggggacctgggccggcgcgccggcgtgccgtgcgacagctggcgcctggccgtggagacgtacaacaagcgcgactggacgacggtgccggccagctgcgagcgctacgtcggccactacatgctcggcggccactaccgccgggactcccgcgtcgtcatcgacgaggccatcgcctacgccgagggcctcaagctgggcggcaacggcaaggaggtctgggtcttcgatatcgacgagacgtccctctccaatctcccctactatgccacccatggcttcggcactaagctatacaacgcgacgagcttcaacgagtacgtgctggaggggagcgcgccggtgctgccngagacgcagcggctgttcaagaagctcgtctcgctgggcatcaagccngtgtcctgacgggccgcaccgagaacagagggccatcaccgtca

SEQ ID NO: 75947 - protein, 206 aa, Zea mays
  misc_feature: Ceres CLONE 1560487
  misc_feature (66)..(206): Pfam Name: Acid_phosphat_B Pfam Description: HAD superfamily, subfamily IIIB (Acid phosphatase)
  misc_feature: SWISSPROT Homolog: EC 3.1.3.2 Acid phosphatase
MAMATAKLVLLMVLVAGSSSGGSAWGPLMSRLRMPTARSSVEVAAERLQEDYVVSAAAPLIHALRPLLGSAGDLGRRAGVPCDSWRLAVETYNKRDWTTVPASCERYVGHYMLGGHYRRDSRVVIDEAIAYAEGLKLGGNGKEVWVFDIDETSLSNLPYYATHGFGTKLYNATSFNEYVLEGSAPVLPETQRLFKKLVSLGIKPVS

SEQ ID NO: 75948 - DNA, 847 bp, Zea mays
  misc_feature: Ceres CLONE 1560489
  misc_feature: Encodes the peptide sequence at SEQ ID NO. 75949
  misc_feature (145)..(145): n is a, c, t, g, unknown, or other
  misc_feature (242)..(242): n is a, c, t, g, unknown, or other
ccccgcggtggcggccgctctagactagtggatcccccgggctgcaggaattcgtctcacccctagaaaaaatcagatagagagagcatagtcgatcatgaagggtggcaagaaggaagtggccggtgcgatggtggccatactngctggttctgcagctcatggcagctccaccgacggccatggccgcccgctcgccgcacggagccgtgccggatggctccctcgccacgacgcccaangtgacgatgctgtcggccacgctgtgctacacgggggagacatgcaaatacattggctgcctcactcctgcttgctcctgcaactatagtgatcgtctatgctacatcatatttactcctgttgcttgaggccattccgcgaagccacaactcttacaatatgcatgcgcccggccgacaacgaaggccccctgccttttcgtgagacttccgtttcaagggaatgccatgttttcaagggccaccccatggaatgccttttcccctaaaattggcccaatttaaaatttaaccccccgtttccggggggaaacccgcaaaaaaaaggggggggggttttttattttttctccaacccccccccacctcggtttttttctccccccccccaaatttttgtgtggggaaaaaatttttttttttttattgcggagaaaaaagggctaaaaccccccccccgggagaaaaccactataacaatttcttaaaaaaggggggggtgtgccaaaacaaaaaaaatttggggggacacccaaaaagaggtgtgtgggggttttttttgcggcccccccccggggggggagaaaaaacctttttttttttta

SEQ ID NO: 75949 - protein, 69 aa, Zea mays
  misc_feature: Ceres CLONE 1560489
  misc_feature (27)..(27): Xaa is any aa, unknown, or other
MAAPPTAMAARSPHGAVPDGSLATTPXVTMLSATLCYTGETCKYIGCLTPACSCNYSDRLCYIIFTPVA

SEQ ID NO: 75950 - DNA, 1137 bp, Zea mays
  misc_feature: Ceres CLONE 1560491
  misc_feature (63)..(63): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (75)..(75): n is a, c, t, g, unknown, or other
agcagagagttgagatttagattgagtgtagagtttttctgtgtcgcaaaccctattattttntttcctannntnacaaaaagagaactcaccgcggtggcggccgctctagaactagtggatcccccgggctgcaggaattcgtctcacccctagaaaaaagtgaaaggcatcgtctcgacgtctcgtgaccgctggactcgccgccgccccaggctagctcgatgattgggtgcgccaagccgctcgcggcgccgctgcaggcatgggctcgcccgccgtctcccgccggtcgccgcctccccccctcgttctgcgcccctgacacctccccagctctcacccacgccgtcgagagcccaggccagtctcagtctgacgacgccccgccaccacgctcgggtgaggccgcctcgtccctggcgccgcgcgcgagctcgcatctcgaccgatggtcccggtcgcgggcgctgcggacgggcaaccggccgggcgctgaaacgcgcgggtctctcctcgggcctcggacttcggcgcccaccgagggaataaagtctgccacggccccgaagaaacgcttacccatggcaggttgaaaggattgggccaaggaaacaaaaaaaaccttggttgcccaaaggccccaaaaaaaggaaaaacccccccccggcccccggggaaaaaaggcgcccaattctaaaacccaaaagaggtgtggccccataaaaaccagggggacaaccccgcgggggtggtggagaaacacccgccccgagaagagaaccaccacctccccggaggagtatgaaaaaaatcccctcagggggtgggtatctccgggataaaacgaaatttctctcgaaaagagagaagtgtggtgctctttatggcaccaagaaaacacagggggggggattgtgtccgcccccctgttaaaaaaaaaaaccacccacaccgccgcggttgtttattttccctgtggtaaaaaaggaaccccccaaactcatgcgggataaaccccaccactttatatttggtgggggcggttctaaaaaaaaaacacacacactccccccctctaaaaagaaagagagagggggctcctccgtggttggttttactaccacacacccccct

SEQ ID NO: 75951 - DNA, 814 bp, Zea mays
  misc_feature: Ceres CLONE 1560493
  misc_feature: Encodes the peptide sequence at SEQ ID NO. 75952
ccccgcggtggcggccgctctagaactagtggatcccccgggctgcaggaattcgtctcacccctagaaaaaaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggcctgccaggtcgtgctcatgggcgccatcgaggggtaccgcgtcgccggcggcccgctcggagaggtcgtcgacccgctctaccccggcggcagcttcgacccgctcggcctcgccgacgaccctgaggccttcgcggagctcaaggtgaaaggagctcagaacggccgcctcgccatgttctccatgttcggggtcttcgtcccagccatcgtcaccggcaaaggcccgctcgagaatctcggcgaacacctcgccgaccccgtcaacaacaacgcatgggcctatgcccacaactttggtccccgcaagtgaagggggttgaaaggcgcacccct

SEQ ID NO: 75952 - protein, 234 aa, Zea mays
  misc_feature: Ceres CLONE 1560493
  misc_feature (33)..(201): Pfam Name: Chloroa_b-bind Pfam Description: Chlorophyll A-B binding protein
MRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAIEGYRVAGGPLGEVVDPLYPGGSFDPLGLADDPEAFAELKVKGAQNGRLAMFSMFGVFVPAIVTGKGPLENLGEHLADPVNNNAWAYAHNFGPRK

SEQ ID NO: 75953 - DNA, 668 bp, Zea mays
  misc_feature: Ceres CLONE 1560496
  misc_feature: Encodes the peptide sequence at SEQ ID NO. 75954
tggagctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaagggccaagccagcgggcggcggtccgggggagccccgttgggtacgggccccccaaaccgccttggctggtaccctgggggccccccctggttccgggggaagccccccccgaagccttccccgttaaagggggggcgaaattttccccggggggggaaaattaccccggtgtggggggaaaaacccccgggggggggcccctttttttcggggggggaaacccccggggaaaaaaatttttttttcccccaaaaaaaaaaaacccggggaaaactctttgggggggggggggaaaccccccccccctcccccccccgggggggggggcccacataattttttgggggggggggggcccccccccccccccgggggggggggggggggggtttttccccccccc

SEQ ID NO: 75954 - protein, 150 aa, Zea mays
  misc_feature: Ceres CLONE 1560496
MASSTMALSSTAFAGKAVNVPSSSAFGEARVTMRKTAAKGQASGRRSGGAPLGTGPPNRLGWYPGGPPWFRGKPPPKPSPLKGGRNFPRGGKITPVWGEKPPGGGPFFSGGETPGEKNFFFPQKKKTRGKLFGGGGETPPPSPPRGGGPT

SEQ ID NO: 75955 - DNA, 890 bp, Zea mays
  misc_feature: Ceres CLONE 1560497
  misc_feature: Encodes the peptide sequence at SEQ ID NO. 75956
  misc_feature (430)..(430): n is a, c, t, g, unknown, or other
  misc_feature (431)..(431): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
ctcaccgcggtggcggccgctctagaactagtggatcccccgggctgcaggaattcgtctcacccctagaaaaaaaaatcgcttaccgcccccgaagcgtctcggttcgcatagcagagctgctcttgcaacaagccaaacaacccagtggctgctagccgagacaggggatagattgagagaggcgcgcagatggcgacgccgtcgtcgtcgctttgctccagcttcgcctccctgcggaccgcctccatcggccacccccgtgggatcgcctcctccacgcccaggaaggcattccatgtgagggcatcagctcgggttgacaagttctcaaagagtgacatcatcgtgtcccctttcactctccccccacaccttgcgaagcttggtgatcaggtaaaagcccccgaggaggcaaggatgcactggnnattctgttgnnntgtcatggatggggcgctttgtggccaacatcacaatttggaccccttgggttgttcacagctctggcggcggggnnnnnctgatcttcccgttgggatgtacatcctgatgattgtgggaacctgaagcagcgaggtccctggattttatccaaggcaggttgcctgaaattggttagtggtccccctgtgaaacagacattcgaccattccatttggccccgaaacagtccaatcagatttaaaagttcttggagccaaagggcggggagttgtttttgaatcccgcgaactccccttcactgcaatttgatttaccttccttgaatggtgttaaacctggtgccgaattaatgtcctgggaaatcccgggggtttgggtggcccaaaacctttttccgagagttcagtatagagaaaaatggcccaaacttggaaaggttttgg

SEQ ID NO: 75956 - protein, 125 aa, Zea mays
  misc_feature: Ceres CLONE 1560497
  misc_feature: SWISSPROT Homolog: EC 5.1.3.1 Ribulose-phosphate 3-epimerase
  misc_feature (80)..(80): Xaa is any aa, unknown, or other
  misc_feature (83)..(83): Xaa is any aa, unknown, or other
  misc_feature (84)..(84): Xaa is any aa, unknown, or other
  misc_feature (110)..(110): Xaa is any aa, unknown, or other
  misc_feature (111)..(111): Xaa is any aa, unknown, or other
MATPSSSLCSSFASLRTASIGHPRGIASSTPRKAFHVRASARVDKFSKSDIIVSPFTLPPHLAKLGDQVKAPEEARMHWXFCXXVMDGALCGQHHNLDPLGCSQLWRRGXXDLPVGMYILMIVGT

SEQ ID NO: 75957 - DNA, 709 bp, Zea mays
  misc_feature: Ceres CLONE 1560499
  misc_feature (216)..(216): n is a, c, t, g, unknown, or other
  misc_feature (242)..(242): n is a, c, t, g, unknown, or other
  misc_feature (254)..(254): n is a, c, t, g, unknown, or other
  misc_feature (260)..(260): n is a, c, t, g, unknown, or other
  misc_feature (261)..(261): n is a, c, t, g, unknown, or other
  misc_feature (264)..(264): n is a, c, t, g, unknown, or other
  misc_feature (277)..(277): n is a, c, t, g, unknown, or other
  misc_feature (278)..(278): n is a, c, t, g, unknown, or other
  misc_feature (291)..(291): n is a, c, t, g, unknown, or other
ctcacccgcggtggcggccgctctagaactagtggatcccccgggctgcaggaattcgtctcacccctagaaaaaaaatcccagacgccacgccacccaacacatacaaacacacgcacgcgcgcgcgcgcgcctcccgctgttccgcaaaacaaaggaaacgaaggagaggaggccatggcgccgagaacgtcagagaaaaccatggcaccggcnggcggcctgctgccacggggctcgtncgctcagcgtcngcggcnngcngcggggcccggcnngccccgcactaancaaaaaggctaaggaaacgggcttggggccgtacccgccgaaaatcccaccgggaaaaaaacccggggggggtgggactttaaaaaggcaaaaaatcccgggggctaaaaaccccccccccaaaaacccggggccccagggaaaaaaaaatcccttccccccggggggcccccccccccaacggggtgggggagaaaaaaaaaaacccccttaaatttttttaaaaaaaacccgggggccccctcaggggggaggccccccccccccccccccgaggggggggggttttcccccccggggggggggccccaacaaagaaggggggggccccccccaaaaatttttttttttgggaggccccctctttttgccccccctatttttttttttttttggggggggggcccaacaccaaaaa

SEQ ID NO: 75958 - DNA, 949 bp, Zea mays
  misc_feature: Ceres CLONE 1560502
  misc_feature: Encodes the peptide sequence at SEQ ID NO. 75959
  misc_feature (408)..(408): n is a, c, t, g, unknown, or other
ggagctccccgcggtggcggccgctctagaactagtggatcccccgggctgcaggaattcgtctcacccctagaaaaaccattatcactcaggcggaaacgcgccggagggagggagagaggaggggcgtgggtggctgggccgagcgactcctccttccagtccaccgctataaagccccgcaggcctggcgagtcccgacggttccattactggtccctagcaggaagcaggatggagttggcgctcagcttgggggagaccatggcggatgccgggagggacctcatgctggggcttgggatgggggtcggggtgcggagggaggaggaagctcatagagggaggaggaatccgcaacgcacgggggcgccgctgacctcgccgaggagtgcgtttccccccccnaacccctcgaggggaacactattttcggtcatgggtttcccctttggaagtgtcctccgatggcctcaccattgggaaaaaatcccactggtccgagtcttcttcaaagctcttctggaacgagctttttaccgcccgttcctgggaaaaaggggccttttcggaaatgggtcccccctttaaagccaccctcctccaggagaaatttattggaagggctttttcttggtcacccaggcctgggcaccagttctaaaacacaaaccccctggggtgtgtaccccccccacaaaaagcacccgggtttttttttccagattttcactcccaaggggaggggtggtgacccttggcatttaaaaccgccgccggaaatggccctttgtgctaacctatctttttgtgttttagatacaatttttgggggcccccaggacaaaatgaccctgggggtctttaatttttcccagaccgggcggggtttttttttttttctcacgccgcgcagaagtatatttgtttgcgctctaaaatagacaaa

SEQ ID NO: 75959 - protein, 118 aa, Zea mays
  misc_feature: Ceres CLONE 1560502
MELALSLGETMADAGRDLMLGLGMGVGVRREEEAHRGRRNPQRTGAPLTSPRSAFPPPNPSRGTLFSVMGFPFGSVLRWPHHWEKIPLVRVFFKALLERAFYRPFLGKRGLFGNGSPL

SEQ ID NO: 75960 - DNA, 1133 bp, Zea mays
  misc_feature: Ceres CLONE 1560504
  misc_feature: Encodes the peptide sequence at SEQ ID NO. 75961
  misc_feature (52)..(52): n is a, c, t, g, unknown, or other
  misc_feature (53)..(53): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (526)..(526): n is a, c, t, g, unknown, or other
gtgaaaagggttatgtttgatgggcgcttgcccttggggttacgtggggganntctgggtttttgggggggnnnnnacaaagctggaactccccgcggtggcggccgcttttcaatagtggatcccccgggctgcattgattcgtctcacccctagaaaaaagctgcagctaccggccttcctctcccccattccaattccgagaacaggggcggcggagtcaaccaggtacgatgtgctcggtagcgaggctggcgtttgtgcttgcactggccatagccgcctcatcaattacggttgcggagagcagagattttaatatctttgctcagggcagcttgcctgatgcaaccaagggatcgtcaggtctagctgcaaccagtggaaagttgtgtcagttatgcgagcagtactcatccgaggcgctcctctatctcacacaaaacgagacccagactgagattcttagcattctacaccatgaatgtgccagcccttgccccactcaagcagcaagtgcatcacngctggttggactactaccgtacccctttttctttcttgggagggtctccatgggttaaccccctggagaaagttcctgcgaagtccgaatggcattctcctggcaaagaaaggggggatagaaaggatttaaggcccttaccccaaccccccgggggaaggggggtaccctttgggaggcggtttctggtgtggcccaacacccaattggttttgggtttgtgtgtttgaaaaaaaaaatttcctgttttaatacaaatggccctctttaaaaaaggagaaccccccccaaaaccatttgtggccaaagccttgtggggaaaaagtttaaatttccggagcccctgtaactttccaaccccaaaaaaaaaccttttggccatagccaataggggtcggcgccagaaaaaccttaatgggaaaaccaggcgccgatgtggccaaaagggcgcggggtgtggggttcccccctcaaaggttattaaatttcccaccccgttgaatttctccggggtggaaaagggggcccaaagaagaatatctcctttggaaaaaaacaaccgggatggttccgggcccccttgggagaaacaaggcccatggccaaa

SEQ ID NO: 75961 - protein, 116 aa, Zea mays
  misc_feature: Ceres CLONE 1560504
  misc_feature (51)..(90): Pfam Name: SapB_1 Pfam Description: Saposin-like type B, region 1
  misc_feature (98)..(98): Xaa is any aa, unknown, or other
MCSVARLAFVLALAIAASSITVAESRDFNIFAQGSLPDATKGSSGLAATSGKLCQLCEQYSSEALLYLTQNETQTEILSILHHECASPCPTQAASASXLVGLLPYPFFFLGRVSMG

SEQ ID NO: 75962 - DNA, 757 bp, Zea mays
  misc_feature: Ceres CLONE 1560505
  misc_feature: Encodes the peptide sequence at SEQ ID NO. 75963
  misc_feature (42)..(42): n is a, c, t, g, unknown, or other
  misc_feature (69)..(69): n is a, c, t, g, unknown, or other
  misc_feature (70)..(70): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (76)..(76): n is a, c, t, g, unknown, or other
  misc_feature (78)..(78): n is a, c, t, g, unknown, or other
  misc_feature (300)..(300): n is a, c, t, g, unknown, or other
  misc_feature (301)..(301): n is a, c, t, g, unknown, or other
  misc_feature (372)..(372): n is a, c, t, g, unknown, or other
  misc_feature (432)..(432): n is a, c, t, g, unknown, or other
  misc_feature (494)..(494): n is a, c, t, g, unknown, or other
  misc_feature (495)..(495): n is a, c, t, g, unknown, or other
  misc_feature (572)..(572): n is a, c, t, g, unknown, or other
  misc_feature (587)..(587): n is a, c, t, g, unknown, or other
  misc_feature (601)..(601): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (638)..(638): n is a, c, t, g, unknown, or other
  misc_feature (647)..(647): n is a, c, t, g, unknown, or other
  misc_feature (648)..(648): n is a, c, t, g, unknown, or other
  misc_feature (656)..(656): n is a, c, t, g, unknown, or other
  misc_feature (661)..(661): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (686)..(686): n is a, c, t, g, unknown, or other
  misc_feature (687)..(687): n is a, c, t, g, unknown, or other
  misc_feature (691)..(691): n is a, c, t, g, unknown, or other
  misc_feature (697)..(697): n is a, c, t, g, unknown, or other
  misc_feature (698)..(698): n is a, c, t, g, unknown, or other
  misc_feature (705)..(705): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (720)..(720): n is a, c, t, g, unknown, or other
  misc_feature (721)..(721): n is a, c, t, g, unknown, or other
  misc_feature (725)..(725): n is a, c, t, g, unknown, or other
  misc_feature (733)..(733): n is a, c, t, g, unknown, or other
  misc_feature (734)..(734): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
ctccccgcggtggcggccgctctagaactagtggatcccccngggctgcaggaattcgtctcacccctnngnnnananaaaaaaaaaaaaaaaaaaaaaaaaactgctcgaccggaccgacgagcgacgaagcgcgcacaaagagaagaacctcggagctgagatggcacaagccatggcgtcgatgacaggcctctcgcagggcgtcctgcccagcaggcgcgccgacagcagaaccaggacgggccgtcgtcgtcgtcagggcgtccgcggagggcgacgccgttgcgcaggcgggcnncgccgcgccgtgatcgggggcttggtggccacttgggcattcggtccgggcgggcgccccttgttccccanagcgcggccccccccccaaaaccccctctaaaaccctctcaaaatttgggaccccccccncgccgcccccccctcgggggggggaacccccccccgggggaccctctcctaactcttgaaanncacccggcggggggggggagctttttcccccccccccccccccccttaaaagaaagaagggggtgtttccccccctntccgacggcaccacnccggtggtggtggncccccnnnnnnnnngcgcgcgcccccccgccccccgnccgcgcccnncgccgcgncccgncccgnnncgccgnnncggccggcgnnccgnccgggnngcgcgcncggggnnnncggggnngggncggggcgnncgggnnnacgcgggggcgcggcg

SEQ ID NO: 75963 - protein, 79 aa, Zea mays
  misc_feature: Ceres CLONE 1560505
  misc_feature (46)..(46): Xaa is any aa, unknown, or other
  misc_feature (70)..(70): Xaa is any aa, unknown, or other
MAQAMASMTGLSQGVLPSRRADSRTRTGRRRRQGVRGGRRRCAGGXRRAVIGGLVATWAFGPGGRPLFPXARPPPQNPL

SEQ ID NO: 75964 - DNA, 807 bp, Zea mays
  misc_feature: Ceres CLONE 1560507
  misc_feature: Encodes the peptide sequence at SEQ ID NO. 75965
ccgcggtggcggccgctctagaactagtggatcccccgggctgcaggaattcgtctcacccctagaaaaagttttgttgtttacttctattttttttgcccgtcagcagccccaccgcaaccgacgcctccagcactccagtcctactcctccacccacccagctcgctgcttccggagtccggagagctcgcgtcgcgcgtgcgcgggcgtgggtgcgtgcggcggcgaagcaccagcaccaccctctcgcgtcgcgcgcgcgtctcgatggccgacggggagccttccctcacgcgctggaccttcgaggatttcgtggtccactacgaagggcgcttcggcctccagcgcgaggccgacggcgacggcgacggcgatggcgacgacgcacccccgccgcgcggatccgatcatggggccagccgccccgccactgcccgcgccaacggcggcgcggacctcgccgtcctcgagcagttcgagcggatggagaggaaggtggagataagcaatggagctacagaggatggtccactgcagaaatctctacttccttcatttgaatctgcagaaatgcgcaacttagctgagacattgttaagggatataattcgtggaagtccagatgttaaatgggaaagcataaaaggtctggagaatgcaaagcgtcttctcaaagaagcagttgtaatgccccattaatatcccaaattactcacaggtctatttatcacttgggaaagcatattactgtttggtccaccctggtacaggaaagaaaatgctagcttaagctgtggctacg

SEQ ID NO: 75965 - protein, 144 aa, Zea mays
  misc_feature: Ceres CLONE 1560507
  misc_feature: SWISSPROT Homolog: EC 3.6.4.3 Microtubule-severing ATPase
MADGEPSLTRWTFEDFVVHYEGRFGLQREADGDGDGDGDDAPPPRGSDHGASRPATARANGGADLAVLEQFERMERKVEISNGATEDGPLQKSLLPSFESAEMRNLAETLLRDIIRGSPDVKWESIKGLENAKRLLKEAVVMPH

SEQ ID NO: 75966 - DNA, 841 bp, Zea mays
  misc_feature: Ceres CLONE 1560511
  misc_feature: Encodes the peptide sequence at SEQ ID NO. 75967
  misc_feature (634)..(634): n is a, c, t, g, unknown, or other
  misc_feature (696)..(696): n is a, c, t, g, unknown, or other
tccccgcggtggcggccgctctagaactagtggatcccccgggctgcaggaattcgtctcacccctagaaaaaaccactcgccagctcgccacttcctcccgtctcctcccttgcagaggcggcgcgtaaaccccgatggccgcctctctcctccacgccgccgccgccgccgcctcgctcctgagctccacccagcacgcccgcgcgggtgccgccgcctttcaccccctcgcgtgtgccccatccctacgccttacgcgctcctcgttctcgaccaatcgccacctcgagatttcactccgggcgatctcggccagtcgccgtttcgcggggaggggggcaccccgggaccgccgcgttgtcgccgccctagcgggggagcaaaccgagggttcagaggtgggggatgacagaaacggggagataaagcccgaggaagctcaggaaatttggaaggtaatgctggagcagttcaaggctgaggccctgcggatgcaggccctgtcaatgcaggcttatgatgtctactccgagaggacgagggaggtcttgctggaagcatcagagaagctgaagatacaggcagacaaagcacagaaggacctgagcggtgtagctaccgaaattggtcangagggacaggaatatctgatgatggcagctcggaaactcccagactcgatcaaggatatcancaacacgttcaggggctcttggaaaaatggatttggccatcagagtatgaggattatcatggggggcattccgttttgggaccctttcttaccgtaggggggtttcctcaccttcatgtttggccgggaagtacttcctgccctt

SEQ ID NO: 75967 - protein, 110 aa, Zea mays
  misc_feature: Ceres CLONE 1560511
  misc_feature (58)..(58): Xaa is any aa, unknown, or other
  misc_feature (79)..(79): Xaa is any aa, unknown, or other
MLEQFKAEALRMQALSMQAYDVYSERTREVLLEASEKLKIQADKAQKDLSGVATEIGXEGQEYLMMAARKLPDSIKDIXNTFRGSWKNGFGHQSMRIIMGGIPFWDPFLP

SEQ ID NO: 75968 - DNA, 820 bp, Zea mays
  misc_feature: Ceres CLONE 1560513
  misc_feature: Encodes the peptide sequence at SEQ ID NO. 75969
  misc_feature (191)..(191): n is a, c, t, g, unknown, or other
  misc_feature (192)..(192): n is a, c, t, g, unknown, or other
  misc_feature (208)..(208): n is a, c, t, g, unknown, or other
  misc_feature (250)..(250): n is a, c, t, g, unknown, or other
  misc_feature (280)..(280): n is a, c, t, g, unknown, or other
  misc_feature (300)..(300): n is a, c, t, g, unknown, or other
  misc_feature (301)..(301): n is a, c, t, g, unknown, or other
tccccgcggtggcggccgctctagactagtggatcccccgggctgcaggaattcgtctcacccctagaaaaactgcgtcagggcctctcgatcgctcatcagtcgccagaggagttgttgatcgaggcgagtgaggttgaaaagaaggcggcgaacaaaggcaccatcgtcatggacgggcggatactacnnggcggcgggtactacnggcggcggtgggcgcccatcgcggacggccgggtacgctccngcgtccgtacgggatgtcgcagtgacatcnagggcacggttgcggggggnncttccccccaaccaaccgtaaaggtactggccggccaccccaatttacccttaaggttccccaaggaaaagggggcttggccccgcaaaacccccggggaaaatcccccccctggataaaggaaatttgggggggggccccccctctctggggccagaagggggtcccccgcgttttcccccttgtgaaaaaaagggcccccggggggagcccctcaccccccccccgggggggggggccccccccccggggggggggggtggttcgcccccaccccccaaattttttttttaaaaaaacactgtttggttgtgtgggagaaagaaacccccccccccccccccaaaaaattttttcccccccccccccccccccggggggaaaaaaaaaaaattttcttcctcttttttttcccccccccccccccccacacaaaaaaaaaagaaggggggggggggtgttttttttttaaaacaaccaccccacccctctcctctttctttgaagatagggaaggga

SEQ ID NO: 75969 - protein, 82 aa, Zea mays
  misc_feature: Ceres CLONE 1560513
  misc_feature (7)..(7): Xaa is any aa, unknown, or other
  misc_feature (13)..(13): Xaa is any aa, unknown, or other
  misc_feature (27)..(27): Xaa is any aa, unknown, or other
  misc_feature (37)..(37): Xaa is any aa, unknown, or other
  misc_feature (44)..(44): Xaa is any aa, unknown, or other
MDGRILXGGGYYXRRWAPIADGRVRSXVRTGCRSDIXGTVAGGXSPQPTVKVLAGHPNLPLRFPKEKGAWPRKTPGENPPPG

SEQ ID NO: 75970 - DNA, 899 bp, Zea mays
  misc_feature: Ceres CLONE 1560514
  misc_feature: Encodes the peptide sequence at SEQ ID NO. 75971
ccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggaggtgctggagaagtgggtgcgcgtggacttcaaggagcccgtgtggttcaaggccggcgcgcagatcttctcggaaggcgggctggactacctgggcaaccccaccctggtgcacgcgccaagcatcctggccgtgctcggcttccaggtcatcctcatggggcctcctcgaagggctttccgcatcaacggccttcgacgggggtccggcaaggggaaacaacctcttacccgggggggccagttattttcaacccgcttgggccctctccgaaaaaaacccctttaccctttggcccaagccttagggttcaagggagaatcaaaaaaccggcccgcctccgcccaggtttcctccagtgttgggggttttcttcgtccgcgg

SEQ ID NO: 75971 - protein, 249 aa, Zea mays
  misc_feature: Ceres CLONE 1560514
  misc_feature (69)..(229): Pfam Name: Chloroa_b-bind Pfam Description: Chlorophyll A-B binding protein
MASTIMAATSRIVAAKTPFLGQGRAAAAAANASPLRDVAAAAAGGRITMGNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPTLVHAPSILAVLGFQVILMGPPRRAFRINGLRRGSGKGKQPLTRGGQLFSTRLGPLRKKPLYPLAQALGFKGESKNRPASAQVSSSVGGFLRPR

SEQ ID NO: 75972 - DNA, 876 bp, Zea mays
  misc_feature: Ceres CLONE 1560519
  misc_feature (284)..(284): n is a, c, t, g, unknown, or other
gagctcaccgcggtggcggccgctctagaactagtggatcccccgggctgcaggaattcgtctcacccctagaaaaaagtccaaagccccttgccttctatccctttcacacacgcctctccttccctctctctctctctatcttcctgcctgaggcagcagccatttccgcttccgatcgtggaggcttggtgtggaaggaggaaaggaggccagctgctggttttcggtgcggcggagatgtctgaggtgtcggtgataaacaggcggaagtggaggatgcnggtgccgggcagctggacctgcccgcggggttttgccttccaccccaccgacgaaggagatcttctcgcactaacctcgcccaatagggcccttaaaccaccggtttcgttttcgggggccccccggggagggccaacccccaacaaggggcgaagcccttgggaccctgccaggcaagggcccaaaaatgggggaaaaaggagaggggaactttttttcccccaaggggattccaaataaccccaaaaggggaacccggaaaaaaaaccccccccccggaaaaaccggttattggagaaaggccccccccccaaggaaaagagagaaattttttgggggggccggcggctctctctctcggggtgtttaaaaaaaaaaaacttttttttttttcacccgggactccccctcccccctcggggaaaaaaaacaacggggggggtaacaacaaaaatatcccccccccgggggagaaatttttccgggggggtgcccccccccctccccccacaaaaaaaagagaggcgctctgcgctagaggtgttataaaaaagaaagttgtgggtagaaaaaccaccctccccttttggt

SEQ ID NO: 75973 - DNA, 857 bp, Zea mays
  misc_feature: Ceres CLONE 1560520
  misc_feature: Encodes the peptide sequence at SEQ ID NO. 75974
ctccccgcggtggcggccgctctagaactagtggatcccccgggctgcaggaattcgtctcacccctagaaaaatagccttgcccccgaccgcggattccccctcggccgccgcgcgcccgcacccgcacccgcgatgatgaactgcgccggaggcggagaccccgtggaggacttcctgatctccggcgccgtcgacgacgaagatctagccatcttctgcgacggaggacttgggattgagggtgtcaatggagatgcttgtggatttgagcagtctaatttgggcaaaaggggtagagatgaaccatgttcatctggtctaaaatccaaagcttgtcgtgaaaaaatgaggagggacaagctgaatgacaggttcctggaattaagttcggttatgaatcctggaaaacaagcaaagttggataaagccaatatcttgagcgacgcagcccgtatggtggcacaacttagaggtgaggcagaaaagcttatagaatcaaatgagaagctgcgggagaatatcaaggacctgaaggaggagaagaatgagctccgctaagagaaagtgaggctgaaggtagagaaagataggctggagcagcaagtcaaagccatgagtgtagctcctacaggatatgttccccatctccctcagtcagcttcataccacccggctgcatttgctccatttgtgccgccacagcaagctgcaggcaacaagagtgctccgatccctgcacctttccctgggatggcaatgtggcagtggctgcttccgacatcgtggacacacttcagactaaagctctggccgcctagtgcttagggcagctagcttgccttgggatggtgacc

SEQ ID NO: 75974 - protein, 141 aa, Zea mays
  misc_feature: Ceres CLONE 1560520
  misc_feature (62)..(113): Pfam Name: HLH Pfam Description: Helix-loop-helix DNA-binding domain
MMNCAGGGDPVEDFLISGAVDDEDLAIFCDGGLGIEGVNGDACGFEQSNLGKRGRDEPCSSGLKSKACREKMRRDKLNDRFLELSSVMNPGKQAKLDKANILSDAARMVAQLRGEAEKLIESNEKLRENIKDLKEEKNELR

SEQ ID NO: 75975 - DNA, 846 bp, Zea mays
  misc_feature: Ceres CLONE 1560521
  misc_feature: Translation starting site: 254
  misc_feature: SWISSPROT Homolog: EC 3.4.22.15 Cathepsin L
  misc_feature: SWISSPROT Homolog: EC 3.4.22.1 Cathepsin B
  misc_feature (600)..(600): n is a, c, t, g, unknown, or other
ctccccgcggtggcggccgctctagaactagtggatcccccgggctgcaggaattcgtctcacccctagaaaaaagaaccagggttcgtgcgggtcgtgctggtcgttcagcgcgtctggagcgctggagggtgcgcactacctcgcaactggcaagctggaggtgctttcggagcagcagttcgtcgactgtgaccacgagtgtgattcatcggagcctgattcatgtgattcgggttgcaatggtgggctaatgacgacggcattcagttatctccagaaggccggtggccttgagagtgagaaggattacccttacactgggagtgatggcaaatgcaagtttgacaagtccaagattgttgcttcagttcagaacttcagtgttgtgtctgtggacgaggctcaaatttctgctaacctcatcaaacatgggccattggcaatcggcatcaatgctgcctacatgcagacatacatcggaggcgtgtcatgcccatacatctgtggcaggcaccttgaccatggtgttctccttgttggatatggtgcttctggtttcgcccccatcgcctgaaaggacagccttactggatcatncagaactcgtggggcgagaactggggggagaacgatactacagatatgcaggggtccaacgttcccaacagtgcggcgtcaattccatggtctctaccgtgtccgcagcccacgccttcaagggattaactctggtcaccgggaaaaccgggatccctatattggaaaaaattaaacccgggagaaaaccacttggggcttttttgttttcaagggcccaaaaatttttaaaaccccaatgggatt

SEQ ID NO: 75976 - DNA, 786 bp, Zea mays
  misc_feature: Ceres CLONE 1560523
  misc_feature: Encodes the peptide sequence at SEQ ID NO. 75977
  misc_feature (341)..(341): n is a, c, t, g, unknown, or other
  misc_feature (404)..(404): n is a, c, t, g, unknown, or other
  misc_feature (426)..(426): n is a, c, t, g, unknown, or other
  misc_feature (428)..(428): n is a, c, t, g, unknown, or other
  misc_feature (488)..(488): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (537)..(537): n is a, c, t, g, unknown, or other
  misc_feature (564)..(564): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (588)..(588): n is a, c, t, g, unknown, or other
  misc_feature (591)..(591): n is a, c, t, g, unknown, or other
  misc_feature (596)..(596): n is a, c, t, g, unknown, or other
  misc_feature (597)..(597): n is a, c, t, g, unknown, or other
  misc_feature (628)..(628): n is a, c, t, g, unknown, or other
  misc_feature (633)..(633): n is a, c, t, g, unknown, or other
  misc_feature (659)..(659): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (705)..(705): n is a, c, t, g, unknown, or other
  misc_feature (712)..(712): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (763)..(763): n is a, c, t, g, unknown, or other
gcggtggcggccgctctagaactagtggatcccccgggctgcaggaattcgtctcacccctagaaaaactagggcagcgcgtgcggaaaccctagtcgccgccgatgtcggaccctttctacccgtactaccgcggagccttcccgggcggcgacggtgcgcagccgccgccacgttactcggattttgaggtcgacctcatcgcggcccgttacgccggcaccctattgccttatccatcctctgccgacgtcggcgcccttcgactcgtatgtcggcgcgagacgatcccgcggaaaggccccgacttgttggaaaaaaattttttttttttcctctcngggggggccaccccccgggggggggaaaacaaaaaaaaaaaaaaaaagggtttctcccccggngttttttttttttttttttgantnaagagagaaaacaaaagaaaagaggggagagagggggggagggataggggtgtacattcnccnnntattttttttttnnnntttttttttattttattaannnnnnntntttcgtataataaccccgccccccccngnnnnggttgctgctgtggtgctnatnctcannttttcctcccctctctccacatacggggaanagagncgaagaggaaagagagaggaaggatntatagagcgaggatgggggggggtaaggtgatggaggggnnngggnggcgcgnttagcgtgagtgtagtaggtgatcaaacnnnngtccgctgccggcgaggancgaggagcgtaatacagccaacg

SEQ ID NO: 75977 - protein, 106 aa, Zea mays
  misc_feature: Ceres CLONE 1560523
MSDPFYPYYRGAFPGGDGAQPPPRYSDFEVDLIAARYAGTLLPYPSSADVGALRLVCRRETIPRKGPDLLEKNFFFFLSGGATPRGGENKKKKKKGFSPGVFFFFF

SEQ ID NO: 75978 - DNA, 751 bp, Zea mays
  misc_feature: Ceres CLONE 1560525
  misc_feature: Encodes the peptide sequence at SEQ ID NO. 75979
ctggagctccccgcggtggcggccgctctagaactagtggatcccccgggctgcaggaattcgtctcacccctagaaaaagaacgaacccagccgaagcgcgagctgagcaaggcggaggcggcgggaccggcgatggagcggctgcagcggatctttggcgcctccggcatggggcagccgccgacggactcgccgctgctcgactcctccgagcaggtctacatctcctccctcgcgcttctcaagatgctcaagcacgggagggccggcgtgcccatggaggtcatgggtctcatgctcggcgagttcgtcgatgactacaccgtcagggtcgtcgacgtcttcgccatgccgcagagcgggactggggtcagcgtcgaggccgtcgaccacgtcttccagacaaacatgcttgacatgctcaagcagaccggcaggccagaaatgggtgtaggctgggtatcactcacatccctgggcttcggttggctggcctatcagggcgtttgatattcaatacttcagccgaaatttttggaaagctttttagaacccccccgggggcattttcccttttttgtaaaaacccccccccccaaaatgttaaaggggaaaggggggttttttgagccctcccccccccaaaaaaacccccccaaaccccttatttttttttgcccaaaaaacccccgcggaaaaaaaaaaacaaaaagtgttggggcccccccaaaaaaacccccccctttttt

SEQ ID NO: 75979 - protein, 125 aa, Zea mays
  misc_feature: Ceres CLONE 1560525
  misc_feature (24)..(125): Pfam Name: Mov34 Pfam Description: Mov34/MPN/PAD-1 family
MERLQRIFGASGMGQPPTDSPLLDSSEQVYISSLALLKMLKHGRAGVPMEVMGLMLGEFVDDYTVRVVDVFAMPQSGTGVSVEAVDHVFQTNMLDMLKQTGRPEMGVGWVSLTSLGFGWLAYQGV

SEQ ID NO: 75980 - DNA, 888 bp, Zea mays
  misc_feature: Ceres CLONE 1560527
  misc_feature: Translation starting site: 581
  misc_feature: SWISSPROT Homolog: EC 3.4.22.51 Cruzipain
  misc_feature (888)..(888): n is a, c, t, g, unknown, or other
aaagctggagctccccgcggtggcggccgcactacaactagtggatcccccgggctgcattactctcgtctcacccctagaaaaaaactacttcctagtataaagtgacagtatttgggcgagaagggaaccgaaaccaagcaacccaatccaaaccagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagttttatttttttcccaccaccacgcgtaccggctgttcgttttcaaggccaacctgcgccacacgcgccggcaccagctgctggacccgtcggcggagcacggcgtcactaagttctccgacctcacgccggcagagttccgccggacctacctcggcctccgcaagtcccggcgcgctctcctcagagaactcagggagtcggcgcacgaggcgcccgtgctccccaccgatggtctccccgacgatttcgactggagggaccacggggccttcggccccgtcaagaaccaaggttcctgccgggtcgtggcgggtcgtttagcgtgttctggagcgctggaaggtgcgcactacctttcaatctggcaagactggaggaggctttcggaaacattatttcgctccaccgttgaccccagagtgtgaattcatcgggagcctgaattaattgggatttgccgtttgccaattggtggggcataaggcacgaacgcggtttccatttattttccatagagaggccgggtgagccctatn

SEQ ID NO: 75981 - DNA, 818 bp, Zea mays
  misc_feature: Ceres CLONE 1560528
  misc_feature: Encodes the peptide sequence at SEQ ID NO. 75982
  misc_feature (615)..(615): n is a, c, t, g, unknown, or other
  misc_feature (625)..(625): n is a, c, t, g, unknown, or other
  misc_feature (708)..(708): n is a, c, t, g, unknown, or other
  misc_feature (818)..(818): n is a, c, t, g, unknown, or other
ctccccgcggtggcggccgctctagaactagtggatcccccgggctgcaggaattcgtctcacccctagaaaaagcgccgcctgcgtccacctccgctcgccgctctccccgcgtatccctctcatacgcagctcgcccaggtaagatgtcgtccgtggcgtcgaaggtggcggtgccggagtctgtgctccgcaagcggaagcgcgaggaacagtgggccaccgagaagaaggagaaggccctagtcgagaagaagaagtccatcgagagccgcaagctcatcttcacccgcgcaaagcagtacgccgaggaatacgatgcccaggagaaggaactggtgcagcttaagcgtgaggcccgtttgaagggtggtttctatgtcagtcctgaagcaaagctgctctttgtggtccgcatccggggtattaacgccatgcaccctaagaccaggaagatcttgcagcttctgcgattgaggcagatcttcaatggtgtgttcctcaaagtcaacaaggcgactattaacatgctacgcagggttgagccatatgttgcatatgggtacccaaacttgaagagtgtcaggggagttgatctacaagaggggctatggnaagctgaacnagcagaggatccctctgtccaacaaccaagtcatcgaggaagggcttgggcaagcacaacatcatctgcattgaggatcttgntcacgagatcatgactgttgggcccacacttcaggaagcccaacaacttcctgtgggcatttcagttgaaaggcgcgcctgggagggctggagaaaaagaaggaacaccn

SEQ ID NO: 75982 - protein, 191 aa, Zea mays
  misc_feature: Ceres CLONE 1560528
  misc_feature (13)..(83): Pfam Name: Ribosomal_L30_N Pfam Description: Ribosomal L30 N-terminal domain
  misc_feature (85)..(136): Pfam Name: Ribosomal_L30 Pfam Description: Ribosomal protein L30p/L7e
  misc_feature (157)..(157): Xaa is any aa, unknown, or other
  misc_feature (160)..(160): Xaa is any aa, unknown, or other
  misc_feature (188)..(188): Xaa is any aa, unknown, or other
MSSVASKVAVPESVLRKRKREEQWATEKKEKALVEKKKSIESRKLIFTRAKQYAEEYDAQEKELVQLKREARLKGGFYVSPEAKLLFVVRIRGINAMHPKTRKILQLLRLRQIFNGVFLKVNKATINMLRRVEPYVAYGYPNLKSVRGVDLQEGLWXAEXAEDPSVQQPSHRGRAWASTTSSALRILXTRS

SEQ ID NO: 75983 - DNA, 836 bp, Zea mays
  misc_feature: Ceres CLONE 1560530
  misc_feature: Encodes the peptide sequence at SEQ ID NO. 75984
acccgcggtggcggccgctctagaactagtggatcccccgggctgcaggaattcgtctcacccctagaaaaaatcttgtcttgatcctctggtccgtggccatgcgcgtcgtctatggtctctcgctaccaccgtgccactccagcaggggggcggcctgtccgagttctccgggctcaggagctccgcgtcgctgcccatgcgccgaaatgccacctcccacaacttcatgtccgccgtctcctctcaggacacacgccgccagcacgagcggcagatctcggcgggggcccacagaggcgaatctgaaggtggccataaacgggttcggccgaatctcgcgctacttcctgcggtgctggcacgggcgcggcgacgcctcgcccctcgacgtcatctccatcaacgacaccggcggtgtcaagcaggcgtcccacctgctcgagtactactccacgctcggcatcttcgacaccgagttcaagcccatcggcgacaacaccatatgcgtctactgcaatgtcatcaacgtcgtgtccgacctcgaccacagcaacctgccgagtggctagctccgcatacacctactcatcgagggcacatgcgtcttcatcgaccgccagggctcggggaagcacatccaggacgagagcgataacgtgctcatcacggcgcccgacgagggcgacatacttacatacctcgtcggaatcaatgacgaccagtactaccccgtacgagcccatcatcatgcacgcctcctgtaacaaaaaaggaacaaggggccatttcttagaagttgctcaacccaaaattgcgggcataatcaagggcac

SEQ ID NO: 75984 - protein, 120 aa, Zea mays
  misc_feature: Ceres CLONE 1560530
  misc_feature (33)..(119): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MPPPTTSCPPSPLRTHAASTSGRSRRGPTEANLKVAINGFGRISRYFLRCWHGRGDASPLDVISINDTGGVKQASHLLEYYSTLGIFDTEFKPIGDNTICVYCNVINVVSDLDHSNLPSG

SEQ ID NO: 75985 - DNA, 809 bp, Zea mays
  misc_feature: Ceres CLONE 1560532
  misc_feature: Encodes the peptide sequence at SEQ ID NO. 75986
  misc_feature (629)..(629): n is a, c, t, g, unknown, or other
  misc_feature (703)..(703): n is a, c, t, g, unknown, or other
  misc_feature (782)..(782): n is a, c, t, g, unknown, or other
gcggtggcggccgctctagaactagtggatcccccgggctgcaggaattcgtctcacccctagaaaaaaaaaatgtgcttctgtttattgacaacattttccgtttcacccaggcaaattctgaggtgtctgctcttcttggacgtatcccatctgctgtgggataccagccaacccttgccactgatcttggaggactgcaagagcgtattacgacaacaaagaagggttctattacgtctgtccaggctatatatgtgcctgctgatgacttgacagatcctgctcctgctactacctttgcccatcttgatgctacaactgtgttgtcacggcagatctctgagcttggtatttatcctgctgtcgatccactggattccacatcaagaatgctttctccccacgtgctgggtgaggatcattacaatactgctcgtggtgttcagaaggttcttcagaactacaaaaatcttcaggatattattgctatcttgggtatggatgagctcagtgaggatgacaagttgacggtcgctcgtgcaagaaagattcagcgtttcctgagccagcctttccatgtcgctgaagttttcacaggtgctccagggaagtatgtggagctgaangaaagtgtgaagagtttccagggtgttttggatggcaagtatgatgacctccctgagcagtcattctacatggntgggagcatttgagtagtcattgctaaggccgagaaaatcgcctaggagtctgcttcataaggaggccttcttgcttgntgaatccggtacaatcaaagtcccatt

SEQ ID NO: 75986 - protein, 237 aa, Zea mays
  misc_feature: Ceres CLONE 1560532
  misc_feature (142)..(236): Pfam Name: ATP-synt_ab_C Pfam Description: ATP synthase alpha/beta chain, C terminal domain
  misc_feature (1)..(129): Pfam Name: ATP-synt_ab Pfam Description: ATP synthase alpha/beta family, nucleotide-binding domain
  misc_feature: SWISSPROT Homolog: EC 3.6.3.14 H(+)-transporting two-sector ATPase
  misc_feature (209)..(209): Xaa is any aa, unknown, or other
  misc_feature (234)..(234): Xaa is any aa, unknown, or other
GGGRSRTSGSPGLQEFVSPLEKKNVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEDDKLTVARARKIQRFLSQPFHVAEVFTGAPGKYVELXESVKSFQGVLDGKYDDLPEQSFYMXGSI

SEQ ID NO: 75987 - DNA, 729 bp, Zea mays
  misc_feature: Ceres CLONE 1560537
  misc_feature: Translation starting site: 142
  misc_feature (379)..(379): n is a, c, t, g, unknown, or other
ctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgaagttccccgggcgaactacngctgggacacgcggggctgtcggcggaccggagacgttcgcaagaacgggagctggagtgatcactccgctggggcatgctggggcgctcggctgcgtcttcccgagctgctcgcccgcacggcgtcaagtcggccaagccgtgttggttaaaggccgttcccaaaattttagccgagggcgggcttgacaacctcggggaacccaaaacctttcccccccccaaaaaaattccttggttaatttgggccctccccaggccgtggcccctagtggggcccccctcagaggggttaccccaatttcccggggggggcccccttttctgggaaagggggtctccaaaacccc

SEQ ID NO: 75988 - DNA, 808 bp, Zea mays
  misc_feature: Ceres CLONE 1560538
  misc_feature: Encodes the peptide sequence at SEQ ID NO. 75989
  misc_feature (496)..(496): n is a, c, t, g, unknown, or other
  misc_feature (564)..(564): n is a, c, t, g, unknown, or other
tccccgcggtggcggccgctctagaactagtggatcccccgggctgcaggaattcgtctcacccctagaaaaagcgccgcctgcgtccacctccgctcgccgctctccccgcgtatccctctcatacgcagctcgcccagatgtcgtccgtggcgtcgaaggtggcggtgccggagtctgtgctccgcaagcggaagcgcgaggaacagtgggccaccgagaagaaggagaaggccctagtcgagaagaagaagtccatcgagagccgcaagctcatcttcacccgcgcaaagcagtacgccgaggaatacgatgcccaggagaaggaactggtgcagcttaagcgtgaggcccgtttgaagggtggtttctatgtcagtcctgaagcaaagctgctctttgtggtccgcatccggggtattaacgccatgcaccctaagaccaggaagatcttgcagcttctgcgattgaggcagatcttcaatggtgtgttccntcaaagtcacaaggcgactaataacatgctacgcagggttgagccatatgttgcatatgggtaccccnaacttgagagtgtcagggagttgatctacaagaggggctatggaaggctgaaccaacagaggatccctctggtcaacaactaagtcatccagggaggcttggggcaaacccaacttcctctgccattggggattttggttcccaaaatcatgaccgttgggccccacctctcaggggaggccaaaaatttcccggggggccattcaaattaaaaaggcccccctggggaggcccctaaaaaaaa

SEQ ID NO: 75989 - protein, 168 aa, Zea mays
  misc_feature: Ceres CLONE 1560538
  misc_feature (13)..(83): Pfam Name: Ribosomal_L30_N Pfam Description: Ribosomal L30 N-terminal domain
  misc_feature (85)..(136): Pfam Name: Ribosomal_L30 Pfam Description: Ribosomal protein L30p/L7e
  misc_feature (119)..(119): Xaa is any aa, unknown, or other
  misc_feature (142)..(142): Xaa is any aa, unknown, or other
MSSVASKVAVPESVLRKRKREEQWATEKKEKALVEKKKSIESRKLIFTRAKQYAEEYDAQEKELVQLKREARLKGGFYVSPEAKLLFVVRIRGINAMHPKTRKILQLLRLRQIFNGVFXQSHKATNNMLRRVEPYVAYGYPXLESVRELIYKRGYGRLNQQRIPLVNN

SEQ ID NO: 75990 - DNA, 797 bp, Zea mays
  misc_feature: Ceres CLONE 1560543
  misc_feature: Translation starting site: 247
  misc_feature: SWISSPROT Homolog: EC 1.9.3.1 Cytochrome-c oxidase
  misc_feature (513)..(513): n is a, c, t, g, unknown, or other
ctccccgcggtggcggccgctctagaactagtggatcccccgggctgcaggaattcgtctcacccctagaaaaagccagccgttggattgcttcaacggtggagagcagctgactgcgtgctcctgccttcggtgggcgacggcaggcgatcccagtccagcaccccccctccctccctatctctctgatctctccctcgctctcgcagccgccactgtagaagcttcgaggctgctgctgcgcccatggccgcggaagccaagacgccgtccctcgctgaggaatattcacttccaccacaggaagttccagtggaaaaggcagctgaggagaagccctctagtggtactgagactgaatctgctccttcaaccaatgatgagactccttcatctgtagaagataagaatgaaacgtctgaagtacaagatgctgctgaaaagtcagacgcagaagaaactaacactgctgcagaggaagcaagtgagactgccgaaggaggagaggctgangaacctgagatcagattgaaacagctccagcagattttcgtttcctcacaacaaatcaaacgaggcattgtttcacacgctatgttgaataacacaggtgccccccctccaaaaagtgaggatgccccttgatgtgaataagttggccaagtactatcgatccctgtgcccacgtgaaagggtttaacccttgaaacaaccacccgtgaaaatggacccttcccgggacccttggtaatctctcaattgcaaaaaaaattgggaaactcccaaagttttggccg

SEQ ID NO: 75991 - DNA, 866 bp, Zea mays
  misc_feature: Ceres CLONE 1560547
  misc_feature: Encodes the peptide sequence at SEQ ID NO. 75992
  misc_feature (829)..(829): n is a, c, t, g, unknown, or other
  misc_feature (866)..(866): n is a, c, t, g, unknown, or other
tccccgcggtggcggccgctctagaactagtggatcccccgggctgcaggaattcgtctcacccctagaaaaaagcctggcgcctaccgcggtgtttctttcctctcctccaagccagcgcgcggcgccagcctccggcgaccggcacccgcctttcttttatacctccgccgcggcgacccacgccaaccttcgacccccctaaccctaccaaagcccgaactctcgagatcacaggacgcggatccaaaccagaggcccctgcctgccctctactcccccaccacaccacagcctaccgccatgtcggcgaccgctacggacgaggccgcggtggaggcgcgcctccaggagctgcgggggaggctcgggaagaagcagcacttcgaggaggccgtaaacgagctcgccgccgccgtccgggaccgctacgccggcgcctcccccgccctccgcaaagcgatgtattcaacggtttgccgcgttgcaacagtgcttcaaaccagatatacagctccaggattctggcatgttggtctgaacctcttcgttggaatagagaagctggtaagtaatcctgctgaaaaggagcacctgaagacctgcatttcgagggcccgtgagcatcttgatgaaaaggaaaatgaggattctgtgcctagcacagagaagcagacaccagatttcttttttgaagggcaccttactgtggggacaggaacctccaccttcagcatgggctggttgccccaaattttaacgaggggaattgagcatactaactggaatctcctgggtgattcaagaagggagcaaccaacagaaacantggcctaaagcccgaaggaaataacacctggctttan

SEQ ID NO: 75992 - protein, 177 aa, Zea mays
  misc_feature: Ceres CLONE 1560547
  misc_feature (176)..(176): Xaa is any aa, unknown, or other
MSATATDEAAVEARLQELRGRLGKKQHFEEAVNELAAAVRDRYAGASPALRKAMYSTVCRVATVLQTRYTAPGFWHVGLNLFVGIEKLVSNPAEKEHLKTCISRAREHLDEKENEDSVPSTEKQTPDFFFEGHLTVGTGTSTFSMGWLPQILTRGIEHTNWNLLGDSRREQPTETXA

SEQ ID NO: 75993 - DNA, 914 bp, Zea mays
  misc_feature: Ceres CLONE 1560548
  misc_feature: Encodes the peptide sequence at SEQ ID NO. 75994
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (405)..(405): n is a, c, t, g, unknown, or other
  misc_feature (406)..(406): n is a, c, t, g, unknown, or other
  misc_feature (409)..(409): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
aagctggagctccccgcggtggcggccgctctagaactagtggatcccccgggctgcaggaattcgtctcacccctagaaaaactggtgctgcgcgcgcctgcagccgtccacgcggcctcccggctgctccctccgccgcggcggcggcggcggcggctcgtggccgtcgcctcggcggcgtcctccgcgccgtccggcgaggtgtcgtcccagcacggcggcggcggcggcggctacggaatcgtgggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnccncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 75994 - protein, 84 aa, Zea mays
  misc_feature: Ceres CLONE 1560548
AGAPRGGGRSRTSGSPGLQEFVSPLEKLVLRAPAAVHAASRLLPPPRRRRRRLVAVASAASSAPSGEVSSQHGGGGGGYGIVGG

SEQ ID NO: 75995 - DNA, 826 bp, Zea mays
  misc_feature: Ceres CLONE 1560549
  misc_feature: Translation starting site: 230
  misc_feature (525)..(525): n is a, c, t, g, unknown, or other
  misc_feature (659)..(659): n is a, c, t, g, unknown, or other
ctccccgcggtggcggccgctctagaactagtggatcccccgggctgcaggaattcgtctcacccctagaaaaaagctgacaaccagacgcgccagggtttcaggcttccacgaatctccccgccgccctcaattcccctcggcgccgccgccctcaattcccctcggcgccgccgcctcctcccctcgcttcggtcctcggttagttaaccatccaggttctgtcaagatgtctgatagccatgggactgacaggaacattgagatttggaaaattaagaaactgatcaaggcattggaatcagccagaggcaatggcacaagcatgatctctctaatcatgcctccacgtgatcaggttgctcgagtggctaagatgttaggtgatgaatatggtactgcttcgaacatcaagagtagagttaatcgtcaatctgtgttggctgccatcacctcagctcagcagaggttgaagctctacaacaaagtgcctcctaacggattggttctgtacactggaactanttgtactgaagacggaaaagaaaaagaaagttactattgattttgagccattcaagcctatcaatgtgtcactctacctttgtgacaacaagttcacactgaggctttaaatgagctctgggatctgaatgacnagttggggttctttgtatgggaatgtaatgggaactctttttgcaccctaaggggcaaacccgggaagggctcccaaattcactgttgacccccaaaaaaaacatggtaaaaggaaggcaatctgccttgccttttggctcgggctccgaagggagaaaaccctatt

SEQ ID NO: 75996 - DNA, 914 bp, Zea mays
  misc_feature: Ceres CLONE 1560551
  misc_feature: Encodes the peptide sequence at SEQ ID NO. 75997
ggccgcatttcaacagtggatcccccgggctgcattactcgtctcacccctagaaaaacgccccacgcagctgaggagctgatcctcttcggcgtcgccatcgtaatcgccttggacagcggcaccagaacctctgcctccgcagggtgcttgctggtatcattacaatctggtagttttagtggttgggcttgacttcctactattcagaaacacagtaccgagaagtctttaggtggggtcaaagatggtgtcgctgaagttgcaaaagcgccttgccgcgagctacctcaagtgtgggaaaggcaaggtgtggcttgacccatatgaagttagtgagatctccatggcaaactcccgccagaatatccggaagattgttaacgatgggtttatcatcaagaagccttcatagaatccactctagatcccgtgccaagaagggcacattgacgccaagcaaaaagggaacgccactcaggaatttggttaagcctaaggggtaaccaagggaggcttaggctaacccccccaaggttttttgttgaataaagaaaagaatccttttttcttaaaagccccttttttccccaaagattttctggaagggcccaaagaaaattttggacaaccccctttgtttttcgtgaacttgttcccttaaagggtctaaagggtaaaccccctcttcaaaaaaaaaaagagggggtttttttgggaaaatattccccaaagtcccacaggcctaaaaaagggccaaaaaagaaaaaaatctttttccaaccccttttagaggccaaagccgcccaaaaaaaaaataagaaacccgataaaaaaaaatataccttggaggtggggcgcgcttctctacctcctctccttagaaaaataaaccacccgttcttgttttaggg

SEQ ID NO: 75997 - protein, 55 aa, Zea mays
  misc_feature: Ceres CLONE 1560551
  misc_feature (2)..(56): Pfam Name: Ribosomal_L19e Pfam Description: Ribosomal protein L19e
MVSLKLQKRLAASYLKCGKGKVWLDPYEVSEISMANSRQNIRKIVNDGFIIKKPS

SEQ ID NO: 75998 - DNA, 1287 bp, Zea mays
  misc_feature: Ceres CLONE 1560553
  misc_feature: Encodes the peptide sequence at SEQ ID NO. 75999
atcgtcttccattccagtacaccgcacgcacgcactcgcctccgacagcgaccgcgcaacgtccttctcccgcgccgcccggccggccggtccctgttccctctcctcccctcggagcagcaggagcaggagcagccgcgttcgtcctctgcgctgcgcggcccgccggcctgaccaagcaaagcttatcggccggagccggacgaacgaacgatgcagcaggacctcagaaactcagagagaagaaacccggaacaggcgcatccagtgatgtcggcgagctcgaccaactccgcggcttccccggccgtgtccggcctcgactacgacgacacggcgctcaccctcgcgctcccgggctcctccgccgagcccgccgccgatcgcaagcgcgcccacgccgaccacgacaagccgccatccccaaaggcgcgggccgtgggctggccgccggtccgcgcgtaccggcgcaacgcgctgcgcgacgaggccaggctcgtgaaggtggccgtggacggcgcgccgtacctgcggaaggtggacctcgcggcgcacgacgggtacgcggccctgctccgcgcgctccacggcatgttcgcctcctgcctcgttgccggagccggagccgacggggcggggcggatcgacaccgccgccgagtacatgcccacctacgaggacaaggacggcgactggatgctcgtcggagacgtccccttcaagatgttcgtggactcgtgcaagaggatccgcctcatgaagagctccgaggccgtcaacctatctccgaggacatcatcccggcagtgattgttgttggtgtggacgccatatgccctacgcggcttatctctccgaattagttcacagagtgtgtgctggaagaggcttggctgctcaggtcctccatgcacacgtcatacaccgtacgtagggtgagggttcagtctgttgctgtgtgttctgtacaggccacaccacacacgcccccatggaaaactttttcagtttcgagtgcccctccctctcggccggacggtttggtttttggacgacgccggcgaggaggcggcgctagcacactagtagctccgtttccgtgtgttctttcatacttggctttggtttccgtttcagtcttcggccctcggtcgtcttgtctcgactctcgagggatccatgtatacacgaacatggtacatgctgtgtgctgtttccattgtataaggtcaaagaatacaagtacgatctgtctctgttctaaaaaaataaaaaaaaaaaaaaaaa

SEQ ID NO: 75999 - protein, 198 aa, Zea mays
  misc_feature: Ceres CLONE 1560553
  misc_feature (13)..(194): Pfam Name: AUX_IAA Pfam Description: AUX/IAA family
MQQDLRNSERRNPEQAHPVMSASSTNSAASPAVSGLDYDDTALTLALPGSSAEPAADRKRAHADHDKPPSPKARAVGWPPVRAYRRNALRDEARLVKVAVDGAPYLRKVDLAAHDGYAALLRALHGMFASCLVAGAGADGAGRIDTAAEYMPTYEDKDGDWMLVGDVPFKMFVDSCKRIRLMKSSEAVNLSPRTSSRQ

SEQ ID NO: 76000 - DNA, 817 bp, Zea mays
  misc_feature: Ceres CLONE 1560556
  misc_feature: Encodes the peptide sequence at SEQ ID NO. 76001
  misc_feature (712)..(712): n is a, c, t, g, unknown, or other
ctccccgcggtggcggccgctctagaactagtggatcccccgggctgcaggaattcgtctcacccctagaaaaagtggttcaactcctaccactaccacagcaccagcgacggaccgggcaggcagagaaaaagcagaccagacgagacctctcgcgttccgtcctcctccctgcccctgctgccgttccccttcttcctcagttctcctgcccgctgctgccctccgtccgcgtccagatcccgccaccaaccgatccggcgccctccagcatggcgggggcgggagcggggacgaaggcggcgggagccctggctctggcgctcgtgctcgcgctcgcgggggccaactccgagggcgacgcgctctcggcgctgcgccggagcctcagggaccccggcggcgttctgcagagctgggaccccacgctcgtcaacccctgcacctggttccacgtcacctgcgaccgcgacaaccgcgtcacccgcctagatcttggtaatttgaacttatctggtcatctggtgcctgagcttgggaaactggagcatcttcagtatctggaactttataagaataacattcaaggaacaatcccttctgagcttggcaacttgaagaatctaataagcttcgacttgtacaagaacaacatttcggggaacatacctcctgcccttgggaagttgaaagtccttggtattcttgcgtncatggcaatcatttgactgggcccatcccaagggaactcgctgggatatctagtctcaaaggtgttgatggttcaagttaatgatttgtgcggggacatttccct

SEQ ID NO: 76001 - protein, 151 aa, Zea mays
  misc_feature: Ceres CLONE 1560556
  misc_feature (25)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature (147)..(147): Xaa is any aa, unknown, or other
MAGAGAGTKAAGALALALVLALAGANSEGDALSALRRSLRDPGGVLQSWDPTLVNPCTWFHVTCDRDNRVTRLDLGNLNLSGHLVPELGKLEHLQYLELYKNNIQGTIPSELGNLKNLISFDLYKNNISGNIPPALGKLKVLGILAXMAII

SEQ ID NO: 76002 - DNA, 888 bp, Zea mays
  misc_feature: Ceres CLONE 1560559
  misc_feature: Translation starting site: 184
  misc_feature: Pfam Name: AdoHcyase_NAD Pfam Description: S-adenosyl-L-homocysteine hydrolase, NAD binding domain
  misc_feature: SWISSPROT Homolog: EC 3.3.1.1 Adenosylhomocysteinase
  misc_feature (321)..(321): n is a, c, t, g, unknown, or other
  misc_feature (697)..(697): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (850)..(850): n is a, c, t, g, unknown, or other
  misc_feature (851)..(851): n is a, c, t, g, unknown, or other
  misc_feature (853)..(853): n is a, c, t, g, unknown, or other
ctggagctccccgcggtggcggccgctctagaactagtggatcccccgggctgcaggaattcgtctcacccctagaaaaatttgacaacctgtatggttgccgccactcactccctgatggtctgatgagggccaccgacgttatgatcgccggtaaggttgccgtggtctgcggataccgtgatgttggggaagggttgtgccgctgccccccacccagctggtggccccggtgtcattgtgaccgagatcgaccccatctgcgccctccaggctctgatggagggtcttcaggtccttccctttggaggacgttgtctncggaagctgacattcttcgtgagcaccactggcaacaaggatattcatcatggttgaccaccttgaggaagatgaaaaaaacaatgccattgtctggcaacattgggcaacttttgccaatgaaaattattatggctcgggcctggaaagaatactccccggggacaagccgttgtccatccatcccctcagcccagactgaccgctggggtgttccccccaaaacaaacttgggacactggtatcttgtctttgtgaggttcccacgtccctgaaaacctctggggggggtcttggggggccccccacaccttttttctttgcccggccgctttttcccaaacccatcatagcaggcatgcccacttaactgtgnaaggggaaaaaaaaatcccgcccctcaattttaaccctaaaaaaaaaaaaagggtttttttttttttctctccccacaacccttctttttataaaaaaagagagagggtgcttcccccctcccccgggaatggcaattgggggcagtnnnngnngngagaataaagccccaatttactagtggggggaaac

SEQ ID NO: 76003 - DNA, 804 bp, Zea mays
  misc_feature: Ceres CLONE 1560560
  misc_feature: Encodes the peptide sequence at SEQ ID NO. 76004
  misc_feature (574)..(574): n is a, c, t, g, unknown, or other
ctcaccgcggtggcggccgctctagaactagtggatcccccgggctgcaggaattcgtctcacccctagaaaaaacacccacacaagcccggacagacctgcctcgcttctcgtctcccgtctcctccgcgttcccgctttccacccgccgccgccgccgcccaccttaccgtcacctgctccttgcccagcatgtggggtagcaccgacggcggaacgccggaggtcaccctcgagacctccatgggcgctgtctctgttgagatgtactacaggcacgcgcccaagacttgccggaacttcgtcgagctcgcgcgacgtggctactacgacaacgttatcttccaccgcatcatcaaagatttcattgtgcaaggtggggatcctacaggaaccggcagaggtggcgagtccatctatggagcaaagtttgaggatgagataaagactgagttaaagcacactggggctggaattctgtccatggcaaacgctggcccaaacacgaatggaagccagttcttcataactcttgccccttgtcagtcacttgatgggaaacatacaatttttngggaggttatgcaaaggaatggaaaattgttaagccgccttgggaagtgtgcaaaactgacaaaaaatgaatagggcttattccttgaaaatgaaaaaatcttggcgtggccccttttttcaaaaaaactgaaaacccttttcccccaaaggttataccctcccaaaaggggtggggtttaaggggtttttataaaaaaaagggcgccctgttttttcttttgaataaaa

SEQ ID NO: 76004 - protein, 151 aa, Zea mays
  misc_feature: Ceres CLONE 1560560
  misc_feature (11)..(147): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
  misc_feature (128)..(128): Xaa is any aa, unknown, or other
MWGSTDGGTPEVTLETSMGAVSVEMYYRHAPKTCRNFVELARRGYYDNVIFHRIIKDFIVQGGDPTGTGRGGESIYGAKFEDEIKTELKHTGAGILSMANAGPNTNGSQFFITLAPCQSLDGKHTIFXEVMQRNGKLLSRLGKCAKLTKNE

SEQ ID NO: 76005 - DNA, 847 bp, Zea mays
  misc_feature: Ceres CLONE 1560561
  misc_feature: Translation starting site: 134
  misc_feature: SWISSPROT Homolog: EC 2.5.1.18 Glutathione transferase
  misc_feature (563)..(563): n is a, c, t, g, unknown, or other
tccccgcggtggcggccgctctagaactagtggatcccccgggctgcaggaattcgtctcacccctagaaaaaagccggcgtcgcgtttccaacaggccagtcccctcccactcccagtcccatctcgacgacatggccgcagccgcagggccatcaagctctgtgaaggagacgctcccgccggccctcggctccacctcccagccacctcccgtcttcgatggcaccaccaggctgtacatctgctacttctgcccgttcgctcagcgcgcctgggtcaccaggaacttgaagggtttgcaggacaagatggagctggtggccatcgatctgcaggacaaaccggcttggtacaaggacaaggtttacgcacagggcacggtgccttccctggagcacgacagcgaggtcaggggcgagagcttggacctgatcaggtacatcgacagcaactttgacggccccgcctgctcccagaggatgctgcgaagaggcagtttgctgacgaactgttcgcgtctgccaacgcgttcaccaaagccctctactcgccgttgctgtnccacgcggccgtgtcagacgaagttgttgcggctctggataaactcgaagctgacctatcccaagtcgacgacgggccccttcttcctaggccattcagcttggcggatgtagcgtacgttacgattctgaaaaggttcagatatactattcccatcttaggaactacgacatcgcccaaagccaggtccacctacaggaattcatcgacgaaatgaacaaaatcgagccgtatgcccagaacaaggaacgattctctggttcttgcttgaatctgccaagaac

SEQ ID NO: 76006 - DNA, 744 bp, Zea mays
  misc_feature: Ceres CLONE 1560565
  misc_feature: Encodes the peptide sequence at SEQ ID NO. 76007
  misc_feature (357)..(357): n is a, c, t, g, unknown, or other
tggagctccccgcggtggcggccgctctagaactagtggatcccccgggctgcaggaattcgtctcacccctagaaaaaaccagcaccgaggcaggagcggcgatccattccacacaaccaccactgctcttgccccagcccgccgcaggagttgccagatctgccccggtcacaggaactccgactccgagccctctccaatggcggttaaggtctacgtcgtgtactattccatgtatggacatgttggcaaactagctgaagagatccagaaaggtgcccctcgtctgttgaaggtgtttgaagctaaaaacatgggctggtccctgaaacccctcctttgagaagtgctttgnaaaggatgggcggcaccccctaaagccttgacctggccattcattcaccccccaagaaattcccaaaagccccacggaatcccttcttcgggtttcccaacaaagggttccgaaataattggcacccccaaaaaaaaagggcgtttttttcaaatgcccccggggggggggcctccggaaagggggaaaaaaaatcttttcccggggaaaaacccttccccggggtttcttttttttttggggcaccggggaacccccccccgggggggggggggccccccaaaaaaaaacaacaccccctttttttaaaaaacagggaaaacaccccccccgtttttgacaacccccccccccccggggtggggggggggttttcccccccccccc

SEQ ID NO: 76007 - protein, 47 aa, Zea mays
  misc_feature: Ceres CLONE 1560565
MAVKVYVVYYSMYGHVGKLAEEIQKGAPRLLKVFEAKNMGWSLKPLL

SEQ ID NO: 76008 - DNA, 875 bp, Zea mays
  misc_feature: Ceres CLONE 1560568
  misc_feature: Encodes the peptide sequence at SEQ ID NO. 76009
  misc_feature (533)..(533): n is a, c, t, g, unknown, or other
acccgcggtggcggccgctctagaactagtggatcccccgggctgcaggaattcgtctcacccctagaaaaaggctccagcatttccaccctcgcgcggcggtcgccggagcgagcagagctgccggaaggcccgtcggatccgccgccgccaagatgaatgacgccgatgtagccaagcagatccagcagatggtgcggttcatccgccaggaggccgacgagaaggccaacgagatctccgtctccgccgaggaggaattcaacattgagaagctgcagcttgttgaagctgagaaaaagaagattagacaagagtatgaacgcaaagagaagcaggttgaagtacggaagaaaattgagtactctatgcagttgaatgcttctcgcatcaaagttcttcaagctcaggatgatctagtaaacaaaatgaaagacgatgcgatgaaggaactcctccttgtcagccacaaccaccatgaatacaagaaccttttgaaagatctaaattgtcagggcttgctccgtttgaanagccagctgtattgctccgttgccgcaagaagatcaccatcatgtggaatcagtactgcattcagcaaagcacgagtatgcatcaaaagcagatgtccatgaaccagagatatttgttgcacatgatgtgtacctacacctgccccaagcatcatgatgctccacggcagtttgccctggaaggattgccttgcctttccaaatggaaaaattggttttaagatcaccttgccccccaatgggaaattgttttccccaaaaattggccaaaatccgggagctcttttttgggcgaaactgcccttaattggcccacccccccaaaagagggttgggtcccct

SEQ ID NO: 76009 - protein, 159 aa, Zea mays
  misc_feature: Ceres CLONE 1560568
  misc_feature (16)..(159): Pfam Name: vATP-synt_E Pfam Description: ATP synthase (E/31 kDa) subunit
  misc_feature: SWISSPROT Homolog: EC 3.6.3.14 H(+)-transporting two-sector ATPase
  misc_feature (126)..(126): Xaa is any aa, unknown, or other
MNDADVAKQIQQMVRFIRQEADEKANEISVSAEEEFNIEKLQLVEAEKKKIRQEYERKEKQVEVRKKIEYSMQLNASRIKVLQAQDDLVNKMKDDAMKELLLVSHNHHEYKNLLKDLNCQGLLRLXSQLYCSVAARRSPSCGISTAFSKARVCIKSRCP

SEQ ID NO: 76010 - DNA, 767 bp, Zea mays
  misc_feature: Ceres CLONE 1560569
  misc_feature: Encodes the peptide sequence at SEQ ID NO. 76011
ctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgcccggctgtccgccgaccccgagaccttcgccaacaaccgcgagctggaggtgatccactcccgctgggccatgctcggcgcgctcggctgcgtcttccccgagctgctctcccacaaacgcctcaagttcggcgaagcccgtctggttcaaggccggcttcccaaaacttcaacaaggggcgggcttgaacttacttgggaaacccccaaccctgaatccaccccccaaaaacttcccctccccatttgggccctgaccaggtccgggctcaaaaggggggccggccaaagggctcccgctattttgccggggggggccccccgggaaaaggtcttttaaccccccctttttcccccggggggggaacttttttaaacccccctcttgtcttgtgaccaaaaaaa

SEQ ID NO: 76011 - protein, 191 aa, Zea mays
  misc_feature: Ceres CLONE 1560569
  misc_feature (61)..(157): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTARLSADPETFANNRELEVIHSRWAMLGALGCVFPELLSHKRLKFGEARLVQGRLPKTSTRGGLELTWETPNPESTPQKLPLPIWALTRSGLKRGAGQRAPAILPGGAPREKVF

SEQ ID NO: 76012 - DNA, 849 bp, Zea mays
  misc_feature: Ceres CLONE 1560570
  misc_feature: Encodes the peptide sequence at SEQ ID NO. 76013
ccccgcggtggcggccgctctagaactagtggatcccccgggctgcaggaattcgtctcacccctagaaaaaaagcaacccaatccaaaccagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggcctccgcaagtcccggcgcgctctcctcagagaactcggggagtcggcgcacgaggcgcccgtgctccccaccgatggtctccccgacgatttcgactggagggaccacggcgccgtcggccccgtcaagaaccacggttcgtgcgggtcgtgctggtcgttcagcgcgtctggagcgctggagggggcgcactacctcgcaactggcaagctgggagtgctttcggagcagcagttcgtcgactgtgaccacgaatgtgattcctcggagcctgattcatgtgattccggtttgcattgttgggctaatgacgacgggctttcagttatctccgaaaggccgggggcctttaaaatggaggaagatttacccttccctggggagggagggccaatggcagtttttaa

SEQ ID NO: 76013 - protein, 245 aa, Zea mays
  misc_feature: Ceres CLONE 1560570
  misc_feature (48)..(104): Pfam Name: Inhibitor_I29 Pfam Description: Cathepsin propeptide inhibitor domain (I29)
  misc_feature (137)..(245): Pfam Name: Peptidase_C1 Pfam Description: Papain family cysteine protease
  misc_feature: SWISSPROT Homolog: EC 3.4.22.41 Cathepsin F
MAHRVLLLLSLASAAAVAAAVDAEDPLIRQVVPGGDDNDLELNAESHFLSFVQRFGKSYKDADEHAYRLSVFKANLRRARRHQLLDPSAEHGVTKFSDLTPAEFRRTYLGLRKSRRALLRELGESAHEAPVLPTDGLPDDFDWRDHGAVGPVKNHGSCGSCWSFSASGALEGAHYLATGKLGVLSEQQFVDCDHECDSSEPDSCDSGLHCWANDDGLSVISERPGAFKMEEDLPFPGEGGPMAVF

SEQ ID NO: 76014 - DNA, 909 bp, Zea mays
  misc_feature: Ceres CLONE 1560572
  misc_feature: Encodes the peptide sequence at SEQ ID NO. 76015
ggagctccccgcggtggcggccgctctagaactagtggatcccccgggctgcaggaattcgtctcacccctagaaaaacgggtgatgctagagccaagagagaggactacgtgcatgtccgggcaaagcgcggccaagccaccaacagccacagccttgcagaaagatttcgaagggaaaaagataaatgaaaggatgaagctttcttcagaccttgtcccaggttgcaacaagattacaggcaaggccatgatgcttgatgagatcataaactatgtgcaatctctgcagcgacagattgaggttctttcgatgaaactctcaacgatcgggcctgggctcaacttggacttccaactacaaaaattctcctgacaccaaaaagctagctctgccttttcaggatacaacccgcaaaccaaacaagtgggttttttaatctgtttcacagacactttaaaaaaggtttttccccccgggaaaaggggacttcccttttccccccaaaagttttccctggacaaaaaaaaaccccccccattttgcgtttttccccccgggtttttatttttaccccccccttaaaaaaacttccaggggggttttcctctggggcgaaaaaaaaaaaaaatttttccccccggcgggaaaaaaaaagattttttttggaaaaaaagaaaaattttttctccaccccccttctctaaaaaaaaaaaaaatggggggcccccccgcaacacaaaaaaaatatttttctgggccgcttataaatttcaccacacccccccgcgccaggtgtttaaacccaccccccccccggcggggggcccaactcttttggtgggaagatttattaagcgcccccccttttttttgtttccggaagatccaggagaagagggagggggg

SEQ ID NO: 76015 - protein, 86 aa, Zea mays
  misc_feature: Ceres CLONE 1560572
MSGQSAAKPPTATALQKDFEGKKINERMKLSSDLVPGCNKITGKAMMLDEIINYVQSLQRQIEVLSMKLSTIGPGLNLDFQLQKFS

SEQ ID NO: 76016 - DNA, 880 bp, Zea mays
  misc_feature: Ceres CLONE 1560573
  misc_feature: Encodes the peptide sequence at SEQ ID NO. 76017
  misc_feature (498)..(498): n is a, c, t, g, unknown, or other
  misc_feature (528)..(528): n is a, c, t, g, unknown, or other
aaagctggagctccccgcggtggcggccgctctagaactagtggatcccccgggctgcaggaattcgtctcacccctagaaaaaacccttgggctcgcagtcgcagcaacgatggggaggtcgccgtgctgcgagaaggcgcacacgaacaagggcgcgtggaccaaggaggaggacgaccgtctggtggcgtacatcaaggcgcacggcgaagggtgctggcgctcccttcccaaggccgccggacttgtgcgctgcggcaagagctgccgcctccggtggatcaactacctgcggcccgacctcaagcgcggcaacttcacggaggaggaggacgagctcatcatcaagctccacagcctactcggcaacaaatggtccctgatcgctggaaggctgccgggcaggaccgacaacgagatcaagaactactggaacacgcacatccggcggaagctgctgagcagggggatcgacccggtgacacaccgccccatncacgagcacacgtcccaacataccatatcngtcgaggactggggccagggggaagcccctcagttgcccccacctgaacctggactttgcatcaccgccctgggccgggaggaagaaagaggcattccttcttaagcccgttaacccggaaggaggccgggtttttcttttaatggaaccgggggctccccaaaagccggaaattaaatggaaaaactttcccgggtctaggacccccctgtttctttttaaaaaacccgaaaaaaaaagaagcttccccccctccggggtggttcctccgggaaactcccccccgaaacccccggggaagaatcccccccccgttttggccccccaaaaaagggcccccctcccccccccc

SEQ ID NO: 76017 - protein, 173 aa, Zea mays
  misc_feature: Ceres CLONE 1560573
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature (129)..(129): Xaa is any aa, unknown, or other
MGRSPCCEKAHTNKGAWTKEEDDRLVAYIKAHGEGCWRSLPKAAGLVRCGKSCRLRWINYLRPDLKRGNFTEEEDELIIKLHSLLGNKWSLIAGRLPGRTDNEIKNYWNTHIRRKLLSRGIDPVTHRPXHEHTSQHTISVEDWGQGEAPQLPPPEPGLCITALGREEERGIPS

SEQ ID NO: 76018 - DNA, 716 bp, Zea mays
  misc_feature: Ceres CLONE 1560575
  misc_feature: Translation starting site: 111
  misc_feature (318)..(318): n is a, c, t, g, unknown, or other
  misc_feature (392)..(392): n is a, c, t, g, unknown, or other
ctggagctccccgcggtggcggccgctctagaactagtggatcccccgggctgcaggaattcgtctcacccctagaaaaaggatctctctgcccgtttcttggagcagagatggccgaaatgaccgtgactgtcgcggccgccaaaagcaccctccggacgtgccccggcgcccgccgtgctgcggttcttggtcggtggatgcctcttgcaccagcggcgcccgccaacttgaaattgttctctccagctgtgagggttccaagggctacttcccctgcggcggttgaggatgggagcaacactgatatagtccctnatcccgaaagttataatagaccaagactcagatccggatgcaaccattgtagaaataacctttggggtgatcgntcttggcgatctcccttgatacgatgagtgcgctaaagaacttgggggctaaatgttgttaaaagctagtgtctgtctcgattctactgggcagcatattaagtttgctataaactagagcgttcactgggccgtaaaaatgatgattccgaagtgtttagagccagttcgactgacggatctttaacaacctgatacagtattcttccagagtccccgccagtcaatttggctattgggggcaaactttttggggccaaaagcccccttcccgaaaaaaggtttaaatttttggaaatttaccaaccccccccattggaattc

SEQ ID NO: 76019 - DNA, 805 bp, Zea mays
  misc_feature: Ceres CLONE 1560576
  misc_feature: Encodes the peptide sequence at SEQ ID NO. 76020
  misc_feature (641)..(641): n is a, c, t, g, unknown, or other
  misc_feature (663)..(663): n is a, c, t, g, unknown, or other
ctccccgcggtggcggccgctctagaatagtggatcccccgggctgcaggaattcgtctcacccctagaaaaaaaggaaggagaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatgntgccgggggatcaaggtggacnagggccctgtcccgctcgccggctccaacaacgagtcgtggtgccagggcctgaaacgggctgggcgtccccgcgagccgccctactacagcaagggcgcgccgggtcgcccaggggggcgcaccggtcgtcagcattccct

SEQ ID NO: 76020 - protein, 186 aa, Zea mays
  misc_feature: Ceres CLONE 1560576
  misc_feature (44)..(185): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (132)..(132): Xaa is any aa, unknown, or other
  misc_feature (139)..(139): Xaa is any aa, unknown, or other
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILAEQGMXPGDQGGXGPCPARRLQQRVVVPGPETGWASPRAALLQQGRAGSPRGAHRSSAFP

SEQ ID NO: 76021 - DNA, 801 bp, Zea mays
  misc_feature: Ceres CLONE 1560581
  misc_feature: Translation starting site: 136
  misc_feature (538)..(538): n is a, c, t, g, unknown, or other
  misc_feature (644)..(644): n is a, c, t, g, unknown, or other
  misc_feature (662)..(662): n is a, c, t, g, unknown, or other
  misc_feature (668)..(668): n is a, c, t, g, unknown, or other
  misc_feature (690)..(690): n is a, c, t, g, unknown, or other
  misc_feature (691)..(691): n is a, c, t, g, unknown, or other
  misc_feature (764)..(764): n is a, c, t, g, unknown, or other
  misc_feature (775)..(775): n is a, c, t, g, unknown, or other
tggcggccgctctagaactagtggatcccccgggctgcaggaattcgtctcacccctagaaaaagcagagcagccgacaactctctaccgtccgagaccccaagcaccagcgcggcggcggcggcggcggcgaccatggctgtcgggaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaattgaggtccctagtgaagaagtggcagacattaatcgaagcccatgttgatgtcaagacaaccgacaactacatgnttgcgtttgttctgcatcggcttcaccaagaggcgcccaaaccaggtcaagagaacctgctatgctcaggcatcccagatccgtcagatccgccgtaagatggttngagattatgatcaaccanggctcntacatgtgaccctgaaagaccnnttgttgcgaagttcattcccagaagttattgggtaagaaagaattgagaagtctaccctccagcatcttcccnacttcaaaacngtcttcatcccgcaaggtgaagatcc

SEQ ID NO: 76022 - DNA, 839 bp, Zea mays
  misc_feature: Ceres CLONE 1560583
  misc_feature: Encodes the peptide sequence at SEQ ID NO. 76023
  misc_feature (809)..(809): n is a, c, t, g, unknown, or other
ctccccgcggtggcggccgctctagaactagtggatcccccgggctgcaggaattcgtctcacccctagaaaaagtgggtgtcgggcgggccagcagctggacaagcaagcaagcaagcaagccaataatggcgtctcactctcatcggtcccggtctcccacggcgccctgtcccagctgggggcacgcccacgcgccgcggtgccggcggcggctcgtccgggcactgctgctcgtagcggcgctggcgctggcggcggcaggtggtggtggtcgtggctccgcggccgccgccgccgccgccacccagcagaggatcccggccatcttcatgttcggcgactccatcgtggacccgggcaacaacaacaaccggctgacggaggccaaggccaacttcccgccgtacgggcaggacttccccggcggcgtcgccacggggaggttctccaacggcttggtccccggggacctcctagcttccaagctgggcatcaaggagctgctgccgccgttcatcggcaccgacctgcagctcgaggacctgctcaccggcgtggccttcgcctgcggcggcagtggctacgatccgctcacgtccaagctcgcggtaacttaacacgtcgtccggaagctagctgcattaacacactcactcctacgtactgactactgaagatgttatctgagactgagaagaaaaaaccgttactactactacgtacgtaacaattgagaccgttggtgccgcggccggtgcagacgaccctgtcgagcgccgaacagctccagctgtttcaggactacnaagataagctggcggcccttgggcggggaa

SEQ ID NO: 76023 - protein, 163 aa, Zea mays
  misc_feature: Ceres CLONE 1560583
  misc_feature: SWISSPROT Homolog: EC 3.2.1.51 Alpha-L-fucosidase
MASHSHRSRSPTAPCPSWGHAHAPRCRRRLVRALLLVAALALAAAGGGGRGSAAAAAAATQQRIPAIFMFGDSIVDPGNNNNRLTEAKANFPPYGQDFPGGVATGRFSNGLVPGDLLASKLGIKELLPPFIGTDLQLEDLLTGVAFACGGSGYDPLTSKLAVT

SEQ ID NO: 76024 - DNA, 922 bp, Zea mays
  misc_feature: Ceres CLONE 1560584
  misc_feature: Encodes the peptide sequence at SEQ ID NO. 76025
  misc_feature (922)..(922): n is a, c, t, g, unknown, or other
ctccccgcggtggcggccgctctagaactagtggatcccccgggctgcaggaattcgtctcacccctagaaaaaacagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtccgcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggtttcaagccgggttcgcaaatcttcagcgaagggtgggcttggactacctcggcaaccccgagccctgatccaccgcgcaaagcatccttcgccattctggggcctgcccaggtcctgcctcatggggcgccattcaaaggggaaaccggtttccccggggggcccccttccgaaaagggtttttaaacccgtttttacccccggggggaggtttttaaacccgtttgggctctcccaaaaaaaccttgaagggcctttcggggaacttcagggggaagagggcccttaagaaacgggcccccccccccaagttgtttccacggtgtggggggttttttctctcgggggctattgttcacccgggaggagggcccctcttccaaaaaaacaccn

SEQ ID NO: 76025 - protein, 152 aa, Zea mays
  misc_feature: Ceres CLONE 1560584
  misc_feature (64)..(151): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFQAGFANLQRRVGLDYLGNPEP

SEQ ID NO: 76026 - DNA, 895 bp, Zea mays
  misc_feature: Ceres CLONE 1560585
  misc_feature: Encodes the peptide sequence at SEQ ID NO. 76027
  misc_feature (870)..(870): n is a, c, t, g, unknown, or other
ctcaccgcggtggcggccgctctagaactagtggatcccccgggctgcaggaattcgtctcacccctagaaaaagccaaaccagcacccgccgccgacagggaacatcgccggccgagatcggctgcacatctgtgctgcttcagggcgccggagttcgcgtcgtcgttcggtaacttgcggggtcaatgggaggagggaaagacaagcatgacgagagcgacaaggggctcttctcgaacatgatgcacggcgttgccggtggtcatgggtacccccaccagggataccctccgcagggctacccaccgcaaccaggagcatacccgcctcccccaggggcgtatcctcctcctccaggggcatatcctcctccacctggggcatacccaccacaatatgggtaccctcagccaggtggctacccacctcaaggtggatatcctcctgcaggctaccccggctcatctcaccagggttatgggagcagccacggcgggggccacgggggccacatggggacgggggcaatgctagcaggaggtgctgccgcggccgctgccgcttatggagcacacaagctttctcatggccatagcggacacggtggacatggggcctttggaggctatggtcacggtggttacggccacgggtatgggtggcacggcaagttcaagcatggtcacggccaccacggcaaagtcaagcacgggcacggcaaggttcagcatggcaagcacgggcacggcatgttttgggcggcggcaagttcaagaagtggaagtgatgtgcctttcaagggttgaaacgaagcttaacctcaggccttccaggaacaagtgttgcctgttattacctttttcagcgntaactcaatcctttcaccggaattt

SEQ ID NO: 76027 - protein, 206 aa, Zea mays
  misc_feature: Ceres CLONE 1560585
MGGGKDKHDESDKGLFSNMMHGVAGGHGYPHQGYPPQGYPPQPGAYPPPPGAYPPPPGAYPPPPGAYPPQYGYPQPGGYPPQGGYPPAGYPGSSHQGYGSSHGGGHGGHMGTGAMLAGGAAAAAAAYGAHKLSHGHSGHGGHGAFGGYGHGGYGHGYGWHGKFKHGHGHHGKVKHGHGKVQHGKHGHGMFWAAASSRSGSDVPFKG

SEQ ID NO: 76028 - DNA, 847 bp, Zea mays
  misc_feature: Ceres CLONE 1560589
  misc_feature: Translation starting site: 161
  misc_feature: SWISSPROT Homolog: EC 1.10.99.1 Plastoquinol--plastocyanin reductase
ctccccgcggtggcggccgctctagaactagtggatcccccgggctgcaggaattcgtctcacccctagaaaaaatccgcaagcctgtggacgcgagtgagtgaacaccagccgtattgtcccgactcctgacccctaccgatcctcgcctgctgcagccatggcgacctccgcggcgctctccaccgccgccaatcccacccagctctaccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgcccgcatggtcgtcccctacggcgccttcttcgtccctgccggctccgggaacgccggcggcgggacctacgcgaaggacaagctgggcaacgacatcacggtggaggcgtggctcaacacgcacggtcccaacgaccgcacgctcgcgcaggggctcaagggtgaccccacgtacctggtgggggagcaggacaagacgctggccacctacgggatcaacgccgtgtgcactcacctcggctgcgtcgtgccggggaaccgcgctaaaaaaaattcatctgcccctgccacggatcccagtacaacaaccagggcaaggggggtccgtggacccgccccccctgtcgctggcccccgggttcacgccccaacgtcaaaaaacgggaagggcccctcttccgtccccgggggggggggaaccgcactttacgggacccggccaaggaaccctaga

SEQ ID NO: 76029 - DNA, 900 bp, Zea mays
  misc_feature: Ceres CLONE 1560591
  misc_feature: Encodes the peptide sequence at SEQ ID NO. 76030
  misc_feature (398)..(398): n is a, c, t, g, unknown, or other
  misc_feature (401)..(401): n is a, c, t, g, unknown, or other
ctccccgcggtggcggccgctctagaactagtggatcccccgggctgcaggaattcgtctcacccctagaaaacatcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccccaccccncangtggaggagttctacgtcatcacgtggacgtcccccaaggagcaggtgttcgagatgcccaccggcggcgccgccatcatgcgggagggccccaacctcttgaagctggcgcgcaaggagcagtgcctggcgctcggcaccaggttgcgctccaagtacaagatcacctaccagttctacggcgtcttcccaaacggcgaggtgcagtacctcccacccaaggacagggtctacccggaaaaaggtcaaccccggcagggagggcgtcggccaaaaatttcgcaacatcggtcaagaacgtcaaacccaatcgacgttcaagttaaccggcaaggccacctttccacaaaaccaactttacgttagccggaaagccccagccggggattcaaattaaagaaacttcttctttccaataaaatccaggaaaattggaaatatggccctgccgggacacgggggggggccttaaattttagaaatgtgcccagagaaaatt

SEQ ID NO: 76030 - protein, 206 aa, Zea mays
  misc_feature: Ceres CLONE 1560591
  misc_feature (62)..(202): Pfam Name: PsaD Pfam Description: PsaD
  misc_feature (85)..(85): Xaa is any aa, unknown, or other
MAMATQASAATRHLLAAAWAPAAKPRQLSSQLALPSSSSRGPAPLRASTEEAVEAPKGFVAPQLDPSTPSPIFGGSTGGLLPTPXVEEFYVITWTSPKEQVFEMPTGGAAIMREGPNLLKLARKEQCLALGTRLRSKYKITYQFYGVFPNGEVQYLPPKDRVYPEKGQPRQGGRRPKISQHRSRTSNPIDVQVNRQGHLSTKPTLR

SEQ ID NO: 76031 - DNA, 851 bp, Zea mays
  misc_feature: Ceres CLONE 1560594
  misc_feature: Encodes the peptide sequence at SEQ ID NO. 76032
  misc_feature (740)..(740): n is a, c, t, g, unknown, or other
  misc_feature (754)..(754): n is a, c, t, g, unknown, or other
  misc_feature (768)..(768): n is a, c, t, g, unknown, or other
  misc_feature (817)..(817): n is a, c, t, g, unknown, or other
ccccgcggtggcggccgctctagaactagtggatcccccgggctgcaggaattcgtctcacccctagaaaaaaaggaagaaagaaagaaagaaagcaaccatggcggcaaccgcaatgtgcccctccccctcggccgcaataactcgccacatccatgctcgtcgctcctgtgctgctgcttccttgtccctccgccgctcgggcttcctggggcgcgtcgtgctggccgcggtgccggtggccgtggacgccacccggcgccgccgcgtctccgtgtcggtgcggatggcctgggacggtccgctctcgtcggtgcgcctcatcatgcagagcaggaacgcgaagctgagcgagaagctcaaggagcacatcgaggacaaggtgggtcgggcggtgtccaagcactgccacctggtccgggaggtagacgtgcgcctctccgcgcgcggcggcgagctcggccggggccccaagacgtcgcgctgcgagatcaccctcttcaccaagcgccatggcgtcctgcgcgccgaggaggacgccgagtccacctacgccagcatcgacctcgccgccgccatcgtcaagcgcaagctccgcaagatcaaggagaaggagacggaggtgcgccgcggcggagacgctgacggcgtctgggacgagatcccgccggccgacctgctgccccccgccgaagccgacgacctggaggcggccgtgggcgctgaagacgaaagagacngtgctccccaaggntggtgcgcaccaanggtgttcgagatgccgcccgctcaacgtgggaaggagcgctggaagcancttgaagaacttggaccacgaccttctactgcta

SEQ ID NO: 76032 - protein, 250 aa, Zea mays
  misc_feature: Ceres CLONE 1560594
  misc_feature (73)..(175): Pfam Name: Ribosomal_S30AE Pfam Description: Sigma 54 modulation protein / S30EA ribosomal protein
  misc_feature (214)..(214): Xaa is any aa, unknown, or other
  misc_feature (223)..(223): Xaa is any aa, unknown, or other
  misc_feature (239)..(239): Xaa is any aa, unknown, or other
MAATAMCPSPSAAITRHIHARRSCAAASLSLRRSGFLGRVVLAAVPVAVDATRRRRVSVSVRMAWDGPLSSVRLIMQSRNAKLSEKLKEHIEDKVGRAVSKHCHLVREVDVRLSARGGELGRGPKTSRCEITLFTKRHGVLRAEEDAESTYASIDLAAAIVKRKLRKIKEKETEVRRGGDADGVWDEIPPADLLPPAEADDLEAAVGAEDERDXAPQGWCAPXVFEMPPAQRGKERWKXLEELGPRPSTA

SEQ ID NO: 76033 - DNA, 968 bp, Zea mays
  misc_feature: Ceres CLONE 1560595
  misc_feature: Encodes the peptide sequence at SEQ ID NO. 76034
ggagctcaccgcggtggcggccgctctagaactagtggatcccccgggctgcaggaattcgtctcacccctagaaaaagttagttgagctctttcccttcctcgcttggaaccaaatcaaatcggagcggcggagcaatacgatccctcgcctcgcttccattcgaatcatctcgaacggggcactaatcgggaagctaatgtcgcgcaattcgcgagatctgtagcgccactcggcttcaccggcggcgcggcgggcatggaagcgcagaacggctccggcgtaggggcgcccgtggtgctcaacgtgtacgaccttacgcccatgaaacactacctctactggttcggcctcggtatttttccactccggaatcgaaatccacgggcatggagtacggatatgggagcacaccaagtttccaaccagttgggggaatttgaaggtggaaaccaaagaagttgtccctgggttccaccctacaaaaaaaattggttttggatgggggcccaacctgaactttgtccagaagacaaaaattccccccctcttttctttgaaaaaacctttgcggggaaaagttccaattgggcaccccacaaccccattttggattttccaaaagaaccgccccacccccctttttaacaaaaaagaatttctttgagaaaaaatttttctcccgcgaaaaaaccaacccccccggggggggggggggaaaaccccgccccccacaaagagggggggtcccttttttattaacgtgggttgttccccccaaaaaagcactcctccggtttttccccacaaaaaaacaaggagcccaaaatattatccgggatatttttctgaaaaagaagaaaaaggaactcccgatactctcctctccgttttttgtggagaaacaggttcttctggaaaagggtgggggaaaaccctctttgtccccaaaggtggtggagggcctt

SEQ ID NO: 76034 - protein, 129 aa, Zea mays
  misc_feature: Ceres CLONE 1560595
MEAQNGSGVGAPVVLNVYDLTPMKHYLYWFGLGIFPLRNRNPRAWSTDMGAHQVSNQLGEFEGGNQRSCPWVPPYKKNWFWMGAQPELCPEDKNSPPLFFEKTFAGKSSNWAPHNPILDFPKEPPHPPF

SEQ ID NO: 76035 - DNA, 882 bp, Zea mays
  misc_feature: Ceres CLONE 1560596
  misc_feature: Translation starting site: 168
ggagctccccgcggtggcggccgctctagaactagtggatcccccgggctgcaggaattcgtctcacccctagaaaaagcctgatctccctcccaataagcacgtctgtttctccccagctccaagccggacgacgcagcgtagcagcagagagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgttctccgccgcgctggcgctgtcgtcggtgctgctgtcctcggccgccacctcccctccgcccgcggccgccgacatcgcggggctgaccccgtgcaaggaccccaacgcgttcgcgaagcgcgagaagaactcgatcaagaagctcaccgcgtcgctgaagaagacgcgcccgacagcgcccccgcgctcgccatcaacgccaccatcgagaagaccaagcgccggttcgagaactacggcaagttcgggctgctgtgcggcgccgacggcctgccgcaccttttcgtcagcggcgaccaggcggcactggggcgaagttcgtcaccccgggggctgctcttcccctacatttccggcttggatccggggtgggccggcagggaactaactttatttggcctttaggggggaaaaaaaaaacccccgccttgggggggggaattcttttttcgagggttcaagggttgggaaaccgggctttttttttccccagggggggtttcattttgtgggcccggttttccccgcctctatacggggggagggttcttatataagaggggggaacacctctttttgtgttgtga

SEQ ID NO: 76036 - DNA, 951 bp, Zea mays
  misc_feature: Ceres CLONE 1560597
  misc_feature: Translation starting site: 842
  misc_feature (410)..(410): n is a, c, t, g, unknown, or other
aaagctggagctcaccgcggtggcggccgctctagaactagtggatcccccgggctgcaggaattcgtctcacccctagaaaaaagccagaaccaaaacccaagccccagccagagtaccactctccaactccaacatatgggtcgcccacaccgatctaccaccctccggctaggcatttgtttgataagaagcccttgctagatcacttccataaggaccatgactatcaccacttcttagaccacttccacaagaaacccgtgccacaaaagccaaagctagaacccaagccacagcctaagcccgagtaccaccctccgacacccacatatgtttctccaactcccatctatcacccgcccgctgagacagaaatgaagtatgacaagaagcactttccccacccncacaaggatcatgactaccaccacttctttgaccacttccacaagaagcctgtgccacccaagccaaaaaccgaagccagagccaaagccaaagccacaacctaagccagagtacaagccccccatgcccacatacgggtctccaactcctatctaccatcctccaaccaaaaaagaagtggcatttgaacaaaaaacacttcccttgaacaccttccccaaaaaaccatgaactacccaccccttcctttgaaccactttccacaaaaaaaccctgtgccccccaaaaaccctaagcccggaaaccccaagcccagaagcccaaacccacaaccctggagccttgaataaccacccccacctacaccggaactattggaatcaccgaaattccatttttaccacccctcctggccaaaacattagaatccatgggaaatttaaatgggtggtccaaagggaaccaaattcccccaactaaaaaaattcaactgtgtgggcctcaaccaacggggggttatgcagacccgccatttttttt

SEQ ID NO: 76037 - DNA, 825 bp, Zea mays
  misc_feature: Ceres CLONE 1560605
  misc_feature: Encodes the peptide sequence at SEQ ID NO. 76038
  misc_feature (428)..(428): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
ttccccgcgggggcggccgctctagaactagtggatcccccgggctgcaggaattcgtctcacccctagaaaaactcgccgtttcgtcgcacccaccaacacgagagatgagctccggcggcgcggacaagcccggcagtggcggcggcgcggtgaagacgccgtcggacttcctcaagtccatcaggggccgccccgtagtcgtaaagctcaactccggcgtcgactacagaggtatattggcttgtctggatggttatatgaacatcgcaatggagcagaccgaggagtacgtgaatggccagttgaagaacaagtatggcgatgccttcataaggggcaacaacgttctgtacatcagcacgacgaagcggacccttgccgatggcgcgtagccggattggattccctctgtcctcctcccgtgntgtgtgccgtgcaacttcgaagccgttagcttcggttgcgctctgactctgatgcatcccttcaatccgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 76038 - protein, 95 aa, Zea mays
  misc_feature: Ceres CLONE 1560605
  misc_feature (21)..(86): Pfam Name: LSM Pfam Description: LSM domain
MSSGGADKPGSGGGAVKTPSDFLKSIRGRPVVVKLNSGVDYRGILACLDGYMNIAMEQTEEYVNGQLKNKYGDAFIRGNNVLYISTTKRTLADGA

SEQ ID NO: 76039 - DNA, 880 bp, Zea mays
  misc_feature: Ceres CLONE 1560607
  misc_feature: Translation starting site: 239
  misc_feature (399)..(399): n is a, c, t, g, unknown, or other
  misc_feature (412)..(412): n is a, c, t, g, unknown, or other
  misc_feature (413)..(413): n is a, c, t, g, unknown, or other
  misc_feature (427)..(427): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (856)..(856): n is a, c, t, g, unknown, or other
  misc_feature (857)..(857): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (874)..(874): n is a, c, t, g, unknown, or other
  misc_feature (878)..(878): n is a, c, t, g, unknown, or other
gcggtggcggccgctctagactagtggatcccccgggctgcaggaattcgtctcacccctagaaaaaccgttgtagtctagctggtcaggatattcggctctcacccgaaagacccgggttcgggtcccggcaacggaaccaagttgttgaaccttgagactactagctagagagacaaatatccaggccgaaggcgagagaggtctgagcggggagacgacgcccgcggcccgcgccatggcaggcgccagcgccaccaacggcggaggcaacggcggagcgggaaggggcagcatgccgctgcagtacttctgcgtgctggcggcggtggtggtggccgtgatggtgctgtcgctgtcgttcatgtcgccggcgggcatggtggccccgtcgcaaancctcagctctgtnncccccccccccccngtggcagcagcaacaacaacgggcggcggcgtccggaaccgggaagcgcccgcccggtctgggccgaaggcgttccccgtcccggccggccttggaagaggaaaaagaaaaagggccccggcgggccccccccctggggggctgtttcaaatttttggggggaatttccaaatttctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnngnngggggnnnnnnnnntgngtgngg

SEQ ID NO: 76040 - DNA, 817 bp, Zea mays
  misc_feature: Ceres CLONE 1560609
  misc_feature: Encodes the peptide sequence at SEQ ID NO. 76041
  misc_feature (576)..(576): n is a, c, t, g, unknown, or other
ctccccgcggtggcggccgctctagaactagtggatcccccgggctgcaggaattcgtctcacccctagaaaaaaaaacatttccttcctcctcccacctcggcggccggcctcctcttctcttcacccacacgctggtcatagagatgtcggctgcagaggcgaaggcggcggcggtcccggagtctgtgctgcggaagcgcaagcgggaggagcaatgggcagcggacaagaaggagaaggcgctcgcggacaggaagaaggcgctcgagagccgcaagatcatcttcgcccgcgccaagcagtacgccgaggagtaccacgcccaggagaaggagcttgtgcagctcaagcgtgaggcccggttgaagggtgggttctatgtgagcccagaggccaagcttctgtttgtggttcgcatccgtggtatcaatgccatgcaccccaagacccgcaagatcttgcagctcctgcgattgaggcagatcttcaacggtgtcttcctcaaggttaacaaggcaaccattaacatgctgcgcagggtggagccatatgttgcgtacggataccccaccntgaaagagcgtaggggagttgatctacaagagaggttacgggaagctgaactagcagaggattccactttagcacacagtgtcatcgaagaagggctcggggaagcacatatcatctgcattgaggacttgtccacgagatcatgacggtgggccccacctcaaggagccaaacaacttcctctggccgttcaagctgagggcccccttgggcgcctccaaagaaaaggaaccctttcgtt

SEQ ID NO: 76041 - protein, 191 aa, Zea mays
  misc_feature: Ceres CLONE 1560609
  misc_feature (14)..(84): Pfam Name: Ribosomal_L30_N Pfam Description: Ribosomal L30 N-terminal domain
  misc_feature (86)..(137): Pfam Name: Ribosomal_L30 Pfam Description: Ribosomal protein L30p/L7e
  misc_feature (144)..(144): Xaa is any aa, unknown, or other
MSAAEAKAAAVPESVLRKRKREEQWAADKKEKALADRKKALESRKIIFARAKQYAEEYHAQEKELVQLKREARLKGGFYVSPEAKLLFVVRIRGINAMHPKTRKILQLLRLRQIFNGVFLKVNKATINMLRRVEPYVAYGYPTXKERRGVDLQERLREAELAEDSTLAHSVIEEGLGEAHIICIEDLSTRS

SEQ ID NO: 76042 - DNA, 847 bp, Zea mays
  misc_feature: Ceres CLONE 1560616
  misc_feature: Encodes the peptide sequence at SEQ ID NO. 76043
ctccccgcggtggcggccgctctagaactagtggatcccccgggctgcaggaattcgtctcacccctagaaaaagcgccatgaagtgctggtgcgtgcacgcgccaaggggagcaatggcgacgccgctctccagccccttggctcccaccgccctccgctcccctctccggcaccgcgccctgctgctgctgctgccgttccctccccgtgcggcctcctccggcgaggacaccgccgcagcagccgaccaggagccggccccggcggccaccaagacggccaccgcggacgacgacttcgaggagcgcgtgctacggatcaagtcccgcgtcgggcccaagaagcgcggcgcgcgcaagaagaaggccgcggcgtccgcgtcagccagcgccgtgacgctcccgcccgtgccgctgcgggagccccggtcggcgctcggcgcgcccgtcgagctcggcttcaccgcgtacagcgagaggctcaacggcgcgctggccgcgctggggctcgccgcggtgctgctcgtggagctgggctccgggcaggccctggtgaagtaccaccagccggccacgctgttcctgcaggcgtacaccgtcgctgcggccgccgcgctgttcatcaagtacgagaaggagcgaatcagcacgtggccggggccgccggcaaagtgagataaatgggcgtgtctcggtcgcggaatctttactgtacttttaccctcttgatgatggcactgcagggatatatatgtggtcgttgtgagactggggaaaatctcagaagagagaagagcttgattttaacagccctttaacgccaaaaggttcatttcatttcttcgc

SEQ ID NO: 76043 - protein, 198 aa, Zea mays
  misc_feature: Ceres CLONE 1560616
MKCWCVHAPRGAMATPLSSPLAPTALRSPLRHRALLLLLPFPPRAASSGEDTAAAADQEPAPAATKTATADDDFEERVLRIKSRVGPKKRGARKKKAAASASASAVTLPPVPLREPRSALGAPVELGFTAYSERLNGALAALGLAAVLLVELGSGQALVKYHQPATLFLQAYTVAAAAALFIKYEKERISTWPGPPAK

SEQ ID NO: 76044 - DNA, 836 bp, Zea mays
  misc_feature: Ceres CLONE 1560618
  misc_feature: Encodes the peptide sequence at SEQ ID NO. 76045
  misc_feature (786)..(786): n is a, c, t, g, unknown, or other
  misc_feature (787)..(787): n is a, c, t, g, unknown, or other
acccgcggtggcggccgctctagaactagtggatcccccgggctgcaggaattcgtctcacccctagaaaaaaggcataaatcgtttgccgaatcaacaccagcaacagcaaagcgactgcagagagtaggagatgcttactctccacacacattcagtcatgcccctcgctgcgcagatcctctctgttccggcggtgctctgctaggcaggaagagatctttcatttctgccagcagttctgaggatgccgaatccggcactcccccgccgcttggtggcgacaaacaccagcaggaggttcttgcacagatcgccatgcttcagacgcagaaggtgcgcatcacagacttcttggacgagcgctctgcttacctgaccaagttcgccaaggacgccgactcggagttcgacctgattgggcagaacgctatgaaagaacttgatgccgatggtgaccagatactggagaggctcgacagcaacatgcaagccttcgaggagacggctgacgtgcaacggacagagatacaaatgaacgataaggtgttagaggacttcgaagactggatcgaaaaggagaaagaccaatggatgttcttcataagccttggacaggtcaaacctcggaacaagatggcaataaacgtgcaagccaatgtggaagcacagacggtcaaagagatcgcagatgacagtgcacgatcaaaaactcggatggacatctacctggggctgatggggatactccggatgacaattgcgaatgccatcttgcaacaccannagtgcgactggaagaaggtacctgctccggagtctgattatccatggac

SEQ ID NO: 76045 - protein, 278 aa, Zea mays
  misc_feature: Ceres CLONE 1560618
  misc_feature (262)..(262): Xaa is any aa, unknown, or other
  misc_feature (263)..(263): Xaa is any aa, unknown, or other
TRGGGRSRTSGSPGLQEFVSPLEKRHKSFAESTPATAKRLQRVGDAYSPHTFSHAPRCADPLCSGGALLGRKRSFISASSSEDAESGTPPPLGGDKHQQEVLAQIAMLQTQKVRITDFLDERSAYLTKFAKDADSEFDLIGQNAMKELDADGDQILERLDSNMQAFEETADVQRTEIQMNDKVLEDFEDWIEKEKDQWMFFISLGQVKPRNKMAINVQANVEAQTVKEIADDSARSKTRMDIYLGLMGILRMTIANAILQHXXCDWKKVPAPESDYPW

SEQ ID NO: 76046 - DNA, 828 bp, Zea mays
  misc_feature: Ceres CLONE 1560619
  misc_feature: Encodes the peptide sequence at SEQ ID NO. 76047
  misc_feature (790)..(790): n is a, c, t, g, unknown, or other
acccgcggtggcggccgctctagaactagtggatcccccgggctgcaggaattcgtctcacccctagaaaaaagagcgacccacgcaccacgccatgcgcccgggcggcctcccgacccagcagcccggcacgccgggccgcgcgcgccgccgcccggatctcaccctccccatgccccagcgcgaggtcgccacctccctcgccgtcccgctccctctcccgccagccgccgcctccgccggggggcccaccccgccgggcgtcaccgcgcccgcccccgcggcgcagcagcagcagcagccgcccccgctcgcggagctggagcgcgtgcgccgcgtcggcagcggcgcgggcgggacggtgtggatggtgcggcaccgcggcaccccccccccctacgcgctcaaggtgttgtacgggaaccacgacgacgcggtgcggcggcagatcgcgcgcgagatcgccatcctccgcaccgccgagcacccggccgtggtgcggtgccacggcatgtacgagcgcggcggggagctccagatcctggctgagtacatggacggggggtcgctcaacggccgccgcaatcgccgccaagccgttccctcgcccgacgttgcggcgccaaggttcctggtccgggaaactccgtaactttcaaccggccggccaaaaatttgggaaaccccgggaaaaaattaaaaggccccttccaaaccctccccttaaattaaaaaattggggggcggcccgcctctttttaaaaaaaattcctccagaatattttgtggngggtgtgtgagggcgccccgcattttatccattagaaa

SEQ ID NO: 76047 - protein, 185 aa, Zea mays
  misc_feature: Ceres CLONE 1560619
  misc_feature: SWISSPROT Homolog: EC 2.7.12.2 Mitogen-activated protein kinase kinase
MRPGGLPTQQPGTPGRARRRPDLTLPMPQREVATSLAVPLPLPPAAASAGGPTPPGVTAPAPAAQQQQQPPPLAELERVRRVGSGAGGTVWMVRHRGTPPPYALKVLYGNHDDAVRRQIAREIAILRTAEHPAVVRCHGMYERGGELQILAEYMDGGSLNGRRNRRQAVPSPDVAAPRFLVRETP

SEQ ID NO: 76048 - DNA, 844 bp, Zea mays
  misc_feature: Ceres CLONE 1560620
  misc_feature: Translation starting site: 80
gcggtggcggccgctctagaactagtggatcccccgggctgcaggaattcgtctcacccctagaaaaacaactaagaaaatgtgcgatcagcttgctcgtggcattggtcgcaactttaatgctgtaagcattcatggtgataaatcacaggccgaaagagataatgttctcaatcagtttcgaactggcagggcttcagtattagtagccacagatgttgctgctcgtggacttgatatcaaagatattagagtggtaatcaattatgactttccaactgggatagaggactatgtgcatcgcatagggcgtacaggaagagctggcgctactggagtctcgtacacatttttctcagaacaagattggaaatatgcttgtgatttccccaaactcttgcaaggtgccaaccagcttgtcccctccgcagctgcaagacatgggctgcacgcagtgcttctggaggtccaagaaaccaggctttctgggatgagtcgctgggatgggcctggtggtcgtggttttgaacctggtgttggtggccctgttggttatggtggtgttagggagggtcctggaggttttggtggtcgtgaaggcccaggtggaactgggtgttcgagaaagcccagccatgtttggggggcccccgggggctttcggggaaccggaaaaaggccccggggggctttcccgtggccctgaaggggcccttgggggctttttgggggcccgggaaacgggaagggtcctggggggtctttttttggcaaaaaaagggccccatgtgggttttttgggggaaagggaaatggcccctgggcacaaaggggtttcccgggg

SEQ ID NO: 76049 - DNA, 858 bp, Zea mays
  misc_feature: Ceres CLONE 1560622
  misc_feature: Pfam Name: PsaA_PsaB Pfam Description: Photosystem I psaA/psaB protein
  misc_feature (660)..(660): n is a, c, t, g, unknown, or other
  misc_feature (683)..(683): n is a, c, t, g, unknown, or other
ctccccgcggtggcggccgctctagaactagtggatcccccgggctgcaggaattcgtctcacccctagaaaaaagacgacatatgggttcgatatactcttatcttcaacgaatggccccgctttcaatgcaggtcgaaacatatggttgcccggatggttgaatgctgttaatgagaatagtaattcgcttttcttaacaataggacctggggatttcttggttcatcatgctattgctctaggtttgcatacaactacattgattttagtaaagggtgctttagatgcacgcggttccaaattaatgccggataaaaaggatttcgggtatagttttccttgcgacggcccagggcgcggcggtacttgtgatatttctgcttgggacgcgttttatttggcagttttctggatgttaaataccattggatgggttactttttattggcattggaaacacattacattatggcagggcaacgtttcacaatttaatgaatcctccacttatttgatgggatggttaagagattacctatggttaaactcttcacaacttattaatggatataatccttttgggatgaatagtttatcagtatggggcttggatgttcttatttggacatcttgtttgggctacaggatttatgttcntaatttccctggcgtggatattnggcaggaattaattgaaactttagcatggcctcataaccggacacttttggctaattaaatcccctggaaaaataaacccgtggctcttttcacttgtcaagccaaaatggcccgataacccccctttttccgggggtttaaattcccttaggccactttcttgaattccccaac

SEQ ID NO: 76050 - DNA, 862 bp, Zea mays
  misc_feature: Ceres CLONE 1560623
  misc_feature: Encodes the peptide sequence at SEQ ID NO. 76051
  misc_feature (506)..(506): n is a, c, t, g, unknown, or other
  misc_feature (538)..(538): n is a, c, t, g, unknown, or other
ctggagctcaccgcggtggcggccgctctagaactagtggatcccccgggctgcaggaattcgtctcacccctagaaaaacccatttcgaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcttctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagcccggttgtgctggggcagcacacgtagtagctgttgccccagttgagtttgcaaacatgaacgtgcagcagccccgctgatggtgccggaaccagcgagggggtggcnggcaatctccaaagggggggaaggtagggccnaaacggttggcaccccctgcaggaaaaaggttgggacttaccgggattcaacggcgggggggggaaacttgtaatgggacactcaaccgtttttcccaaaaagccaaattggaaatttccactaccggaattggttcccgggaccccctttccaagggttatccggggggggaagggaaaacatccccaaaaatctgggggggggcccccccgggtgggattccgaaaaattttaaacccggggaaccttttttggagaaagttttttttccccccccccctttttttacagggggggggcccaaaatttgggggggggggacg

SEQ ID NO: 76051 - protein, 92 aa, Zea mays
  misc_feature: Ceres CLONE 1560623
  misc_feature (14)..(38): Pfam Name: zf-A20 Pfam Description: A20-like zinc finger
MEHKEAGCQAPEGPIFCINNCGFFGSAATMNMCSKCHKEMITKQDQAKLAASSIDSIVNGSDAVMEPGCAGAAHVVAVAPVEFANMNVQQPR

SEQ ID NO: 76052 - DNA, 759 bp, Zea mays
  misc_feature: Ceres CLONE 1560626
  misc_feature: Encodes the peptide sequence at SEQ ID NO. 76053
  misc_feature (623)..(623): n is a, c, t, g, unknown, or other
gtggcggccgctctagaactagtggatcccccgggctgcaggaattcgtctcacccctagaaaaagtatacctgtcactcacgctaccgccgtgaccgatcatctctcactctctcgtcagatcctctcggctagctagctagctaggacagaggagggaggggaaggcgctggctatggcgactgcggcggcggcggcggcggcggccatggaggagccggacgtcgtcaacggccgcgacgtggtgagctgggtggcgtccggggtggtgctgtggtcgaccgccttcttgctggtgcgggcgctgttccccaagcgctcctacgacttctgcaaccgcgccgtctccaccatgcacgccgtcgccgccgtgtgcctcgcctgcctctccgtcgacgactggtcgtgccccgtctgcccgctcgccgccgcatcctcccgtcgccagatgaaggcgctggcggttacgctggcgtacatggtgtacgacgcggcgtgctgccacctcaacggcgacacgcggctggacaacgccgtgcaccacctggtcagcatcgtcggcatcggcgcggggctcgcctaccagaggtgcggggacggagatggtggccagcatgctcgntgacggagatgtcccagccccgctgctgcaccttgcggggagatgctccaaggaactggggcgtgccgggaaaccggagctggaccctccctcttcgaactggctcctttcggccgcccccccttttcccgcccgt

SEQ ID NO: 76053 - protein, 149 aa, Zea mays
  misc_feature: Ceres CLONE 1560626
MATAAAAAAAAMEEPDVVNGRDVVSWVASGVVLWSTAFLLVRALFPKRSYDFCNRAVSTMHAVAAVCLACLSVDDWSCPVCPLAAASSRRQMKALAVTLAYMVYDAACCHLNGDTRLDNAVHHLVSIVGIGAGLAYQRCGDGDGGQHAR

SEQ ID NO: 76054 - DNA, 889 bp, Zea mays
  misc_feature: Ceres CLONE 1560633
  misc_feature: Encodes the peptide sequence at SEQ ID NO. 76055
ctccccgcggtggcggccgctctagaactagtggatcccccgggctgcaggaattcgtctcacccctagaaaaaccccgcccagcgccaccatggcctcctccgtcgcggtgtccctccgcgccctcgctgccgccccgctccccaagtccagccccgccacttcctgccccttcttcgtgctccttgcgccggcgctgccccgacgcctgctccgcctccgctccgcacgccgcctgccgctcgccccgctcgccgcctccgattccgccttcgagtcctccgtcggagttaactacgcggagcccgacgactcggagaaggataaggaggtggagttgttcggatcgggtgacgacgagggggcgggtgagttggtggatgaccattccgtacacgtctcagccgctgtcgaggacgaggtggaggaggaggtcggggagtacgttgagccgcccgaggaggccaaggtctacgtcggaaacctgccctacgacgtcgacagcgagcgcctcgctcagctcttcgaccaggccggcgtcgtcgaggtcgcagaggtcatttacaacagagaaacagatcaaagtcgtgggtttgggtttgtcactatgagcactgtcgaggaggctgagaaggctgtggagatgttccatcgctatgatgtcaatggaaggcttctgactgtaaataaagcagctcctagaggctctcgtgtggacagacctcccaaacaatctgggccttctctcaaaatttatgttgggcacctggcttgggcaagtgaatgaatctagattggtggaagtgtttcgccaagcatgggaaagtaagttgatgccaaaagttgtttttgaacgaaaaaactggggcgtttcccggggaatttggtt

SEQ ID NO: 76055 - protein, 231 aa, Zea mays
  misc_feature: Ceres CLONE 1560633
  misc_feature (127)..(198): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MASSVAVSLRALAAAPLPKSSPATSCPFFVLLAPALPRRLLRLRSARRLPLAPLAASDSAFESSVGVNYAEPDDSEKDKEVELFGSGDDEGAGELVDDHSVHVSAAVEDEVEEEVGEYVEPPEEAKVYVGNLPYDVDSERLAQLFDQAGVVEVAEVIYNRETDQSRGFGFVTMSTVEEAEKAVEMFHRYDVNGRLLTVNKAAPRGSRVDRPPKQSGPSLKIYVGHLAWASE

SEQ ID NO: 76056 - DNA, 831 bp, Zea mays
  misc_feature: Ceres CLONE 1560634
  misc_feature (337)..(337): n is a, c, t, g, unknown, or other
tccccgcggtggcggccgctctagaactagtggatcccccgggctgcaggaattcgtctcacccctagaaaaaaatgcaaatagatcccactcatacactccagtagctagtagtagtcgacccatctgcatctgtatgtgtgcttgcccccggccggccacctttccggccgatccatcatctagagctagctagctcatcatcagtctttcgcgtgtgtgtatgtatatggtggtgaccagagcagctagctagctaggagcagggtggttgttctatagttcgttcctatggttatggtggcggcggcggcggtactgctcgctctggccgccngtggcgacggaggtggccgcgggcagggaccaacgtacacgggggggccgcgccggaacgggctcccgggacatgcagacgaactacccgcagtggggtgaaaagaagaactttcccccccggcgaacaccatcacgttccacgtactccccggaacttccaccacattggtggaaggtaaacaagggccgggttaaaaatccctgtttcaaggcccaaaaaaattttccccctttcccaaccgggaaaaaaaccccgtgcccctaaccccccgttgggacccccgaaatttttttttgggggctccaagggggccacttttggaaaacacgaaataaaataaccccgttttaaaataattttcccccccccggggatctttcccctttccccccccgggggcccccccccttttttcccccccggggggccccccccaaaaaaacctttttctccccccttaaaaaagagggagaaatcctctccccccccct

SEQ ID NO: 76057 - DNA, 852 bp, Zea mays
  misc_feature: Ceres CLONE 1560635
  misc_feature: Encodes the peptide sequence at SEQ ID NO. 76058
  misc_feature (406)..(406): n is a, c, t, g, unknown, or other
ggagctccccgcggtggcggccgctctagaactagtggatcccccgggctgcaggaattcgtctcacccctagaaaaagctcgcacggtgtcctcctcccgctaccggcaggccacccccatacggccagtcggccatacgctgtccccaacagcctcctcgttcgtctcctcctcgaccgcaggtcagcagcgcccgagctctgcgagcgatggactactcgggcaccaaggagccgcctccctccggggcttggtggtcgagggagacggtggccgtggtgaccggcgcgaaccgcggcatcggccacgcgctcgccgcgcgcctggccgagcacggcctcaccgtggtgctcaccgcgcgggacggcgagcgcggggaggccgccgcggccccgctccccccncgcgggctcgccgtcgtcttccgcaggctcgacgtctccgacgccgcctccgtcgccgagttcgccgcctggctccgcgacgccgtcgggggcctcgacatcctggtgaacaacgccgccgtgtcgttcaacgagatcgacaccaactcggtggagcacgccgagactgtcctcaggaccaacttctacggggccaagatgctcaccgaagcgctcctgccgctgttccggcagtcgtcggcgaccagcaggatcctcaacatccactcgaagctgggccttctcaacaaggtgggcgacccgtccctgaaggcactgctcctggacaaagagcggctgaacgaggcggggaaaaaaagcaatggtgtccccggttcctggccccaggtgaaagaacggaacatgggggtaagccaggggtggccccacgggggtggaagggactt

SEQ ID NO: 76058 - protein, 213 aa, Zea mays
  misc_feature: Ceres CLONE 1560635
  misc_feature (20)..(173): Pfam Name: adh_short Pfam Description: short chain dehydrogenase
  misc_feature (17)..(207): SWISSPROT Homolog: EC 1.1.1.184 Carbonyl reductase (NADPH)
  misc_feature (13)..(46): SWISSPROT Homolog: EC 1.1.1.206 Tropine dehydrogenase
MDYSGTKEPPPSGAWWSRETVAVVTGANRGIGHALAARLAEHGLTVVLTARDGERGEAAAAPLPPRGLAVVFRRLDVSDAASVAEFAAWLRDAVGGLDILVNNAAVSFNEIDTNSVEHAETVLRTNFYGAKMLTEALLPLFRQSSATSRILNIHSKLGLLNKVGDPSLKALLLDKERLNEAGKKSNGVPGSWPQVKERNMGVSQGWPHGGGRD

SEQ ID NO: 76059 - DNA, 854 bp, Zea mays
  misc_feature: Ceres CLONE 1560636
  misc_feature: Encodes the peptide sequence at SEQ ID NO. 76060
gcggtggcggccgctctagaactagtggatcccccgggctgcaggaattcgtctcacccctagaaaaagctctgtctccggctctccgctctctctctctctctcttcccctcctcgttctcccattctctctctcctctcccgagtccctccccctatccccccccctctccgcctccgtcgctagggctccattcccctgcgcatccgccgccgccggatcccgcctcgcctccgccgcagcttcggcatcagaatcaccggattcggtggtgtttctcggctgcctcagcttccgccggcggaaggccccaggcggcgctccctgcagccctccggccttcactgagtcctccagaagccaaacatcgttgatacttcgaaggcagctgagtatatggtatttgtgggccattgtgctgtccatgcgagcggagagcatgcgtggcacctgtgcttcgggtgatgcccctgaccagagtagctgccgatgcattcggtgtgctgacaatcgcactgtttgctctgtttgctgctctgggcctcttctgcatcttccagtcggtctacttcaggtgtcggattcggagaggaccctccttccttccgcttggttattttaacggcccatgggtgactcgcattgctctgattctgatcacaatttggtggggagtaggtgagaaagtgagattgagcttcttgaagaaaagttgttcttcaacttaacatggcaaaagaacatatgtgatgggtacatacttttccacctaagggtttgcaaaaccaggggacctccctttgcggttggctttttctgctcccagggctcgtttacaaaaaagggaggcggg

SEQ ID NO: 76060 - protein, 87 aa, Zea mays
  misc_feature: Ceres CLONE 1560636
MPLTRVAADAFGVLTIALFALFAALGLFCIFQSVYFRCRIRRGPSFLPLGYFNGPWVTRIALILITIWWGVGEKVRLSFLKKSCSST

SEQ ID NO: 76061 - DNA, 1087 bp, Zea mays
  misc_feature: Ceres CLONE 1560637
  misc_feature: Encodes the peptide sequence at SEQ ID NO. 76062
  misc_feature (57)..(57): n is a, c, t, g, unknown, or other
  misc_feature (59)..(59): n is a, c, t, g, unknown, or other
  misc_feature (60)..(60): n is a, c, t, g, unknown, or other
  misc_feature (75)..(75): n is a, c, t, g, unknown, or other
  misc_feature (76)..(76): n is a, c, t, g, unknown, or other
tatgtgggggaaggcgggaacagagccgcggggccgagcccgcgcgggcgccgaccntnnagaaaacccaacacnnctgcgactccccgcggtggcggccgctctagaactagtggatcccccgggctgcaggaattcgtctcaccactagaaaaagtggactgaaaagacaacagtcaaggaaatttctgacgacgaagacgaggaagagaagaaagatgctgaggaaggaaaggttgaggatgttgatgagaaggaagagaaagaaaagaagaaaaagaagatcaaggaggtttctcatgagtggtcattggtcaacaagcagaagcccatatggatgaggaagccagaagaaatcacaaaagaagaatatgctgccttctataagagcttgacaaatgactgggaggagcatctggctgtgaagcacttctctgtggagggtcaactggagttcaaggctgttctctttgtgggccccccacccccccctttgatctctttgacaccaagaagaagcaaaacaacatcaaggctctatgtgcgcaggggtgttcatcattggacaacctgcgaagagctggatcccctgagtggccggagctttcgtttaaggggtattgtttgaactcttgaaggaaccttgccccctcaaaaatcctctcccgggagggacttctttcaaccaagaaacaaaggatcccttgaaagggtgaattccagggaaagaaacccccttgttgaaaaaaaagaggtgggtttggaagccccctttccctcttgagaaaaatttcgcctgaaaaaacccaggggggggggacttacccacctcgggtttttttaccggaggggttttttcctcctaaaaaaaccctctacaggctttgggggattccccgtggaagggaaatccccgaagaaaacgggcgcccaagaaacgcgcccgaagctttcttgaagaagaccaccctcccccccaagaaggggggtgtaaaggaggccttccccgcccctccaagggaccccgcttgtacccccccttgtgcagaggaggggccaaccaaaaggaccttctgccctatatgtt

SEQ ID NO: 76062 - protein, 49 aa, Zea mays
  misc_feature: Ceres CLONE 1560637
  misc_feature (19)..(19): Xaa is any aa, unknown, or other
  misc_feature (20)..(20): Xaa is any aa, unknown, or other
  misc_feature (25)..(25): Xaa is any aa, unknown, or other
MWGKAGTEPRGRARAGADXXENPTXLRLPAVAAALELVDPPGCRNSSHH

SEQ ID NO: 76063 - DNA, 805 bp, Zea mays
  misc_feature: Ceres CLONE 1560642
  misc_feature: Translation starting site: 161
ctccccgcggtggcggccgctctagaactagtggatcccccgggctgcaggaattcgtctcacccctagaaaaaagcagaggcagcgacacgatcgcgagcgcacgcacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtcccctctcctacctcgatggcacgctgcccgggcgactatggcttcgacccgctgggcctctcggaccccgagggcaccgggggcttcatcgagccccagtggctggcctacggcgaagtgatcaacgggccgctacgccatgctggggcccggggggcgcccatccccccgggaaatcttcggcaaaaagggcatcattccgccggaaaaccccccttccctgggttaaaaaagggggtcatccggcccgcgggaccttaaaaataagggggcaaatcccaaaaagtctttttgtttttaaaaaagggggtctaaggggttttcccaaaaacccccccccccccgggaaaggggaaaaaccccggggttcccgggggggaaagaaaaatttctcccgcggcccccaaaagaaatttcctcccggggggttcggggagaacacctttttatacccccggggggggggccccttcttaaa

SEQ ID NO: 76064 - DNA, 857 bp, Zea mays
  misc_feature: Ceres CLONE 1560643
  misc_feature: Encodes the peptide sequence at SEQ ID NO. 76065
  misc_feature (425)..(425): n is a, c, t, g, unknown, or other
  misc_feature (431)..(431): n is a, c, t, g, unknown, or other
  misc_feature (712)..(712): n is a, c, t, g, unknown, or other
ctccccgcggtggcggccgctctagaactagtggatcccccgggctgcaggaattcgtctcacccctagaaaaactcgttcccacacccctcaccgcgtccgcctcccctaccatctagggtttctagggttttcgaggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtggggcgaggcngatacngcggcggcgaccgcggttacggcggcggcggtgacggcgggctacggggggaagaagccaccgtggctaccggggccgcgaccgtggttaccgggggagtggccaaccgcgcttcgggcggcgacggtggctaccggggaaagcggcgctaatgccgttgggtaccgtgggagcccgccgttggaagccgcccccgcttgctcaaatgcggggaaggaaggccccatggcaaggggattgttcccagggggggggctttgggaaggggaaaggggggggcnccccccgcaaaaaaaattttaaaattgtgggcccggaaggggccattttccccggggaatgcccccaaaaaaaagggttttgggggggggggcccccccatgctctgtgaaaaccggggggagacccccctagggccccctcccg

SEQ ID NO: 76065 - protein, 105 aa, Zea mays
  misc_feature: Ceres CLONE 1560643
  misc_feature (5)..(72): Pfam Name: CSD Pfam Description: 'Cold-shock' DNA-binding domain
  misc_feature (93)..(93): Xaa is any aa, unknown, or other
  misc_feature (95)..(95): Xaa is any aa, unknown, or other
MASDRVLGTVKWFNGTKGFGFITPDDGSEDLFVHQSSIKSDGYRSLNDGDAVEYTVGSGNDGRAKALDVTAPGGGPLAGGERPDGGNGGGARXIXRRRPRLRRRR

SEQ ID NO: 76066 - DNA, 850 bp, Zea mays
  misc_feature: Ceres CLONE 1560644
  misc_feature: Encodes the peptide sequence at SEQ ID NO. 76067
  misc_feature (583)..(583): n is a, c, t, g, unknown, or other
  misc_feature (604)..(604): n is a, c, t, g, unknown, or other
  misc_feature (633)..(633): n is a, c, t, g, unknown, or other
ctccccgcggtggcggccgctctagaactagtggatcccccgggctgcaggaattcgtctcacccctagaaaaaagccgtagacagagcagtgacggtcgtcgtacacagatcacgatgctgctcccacactcttcgtcagcctctgcaactgctaccactcgtgggctagcactagcagcagcagcagcagcaccgccgcgtccgaccgctcgcccccggcgcgcgcgcctcctgcctccacgcgcgcgggccgagacgcatgcgacgggcgttggcgccgaccgcgcggccgaggcgcttctccaaagcgggctgcgccgtgagtcgctgccgcggcacgtcgcggtggtgatggacgggaactcgcggtgggcgcgcgagcgggggctgacgcccgcggacggccacaaggccggcggccgcaacctgaagcgggtcgttgcgctgtcgcgcgccctgggcatccgcgcgctcaccgccttcgtctgctcccgcgagaacttgagccgcccaaggccgaagtcgactacatgatgggcttgtccgagtggctgataagcgacaacatcgacaagctctcngagcaggggatcccgctgcangtgatcggcgacccccccaaaaatgcagnctctctgcggagcgcaacggcccaaggcgaccaggcccccaagcacaactcccagctgccctggatgctgccatctgctacagcgggcaagggacatggtccaagcctgccgggaactgccccgggaggccagggaaaccggcttattccgaacaaataaaaaaattgtttattcccggaaaattccaaaaaacccccccgggaaattctcctttcc

SEQ ID NO: 76067 - protein, 139 aa, Zea mays
  misc_feature: Ceres CLONE 1560644
  misc_feature: SWISSPROT Homolog: EC 2.5.1.31 Di-trans,poly-cis-decaprenylcistransferase
MLLPHSSSASATATTRGLALAAAAAAPPRPTARPRRARLLPPRARAETHATGVGADRAAEALLQSGLRRESLPRHVAVVMDGNSRWARERGLTPADGHKAGGRNLKRVVALSRALGIRALTAFVCSRENLSRPRPKSTT

SEQ ID NO: 76068 - DNA, 822 bp, Zea mays
  misc_feature: Ceres CLONE 1560648
ctggagctccccgcggtggcggccgctctagaactagtggatcccccgggctgcaggaattcgtctcacccctagaaaaaccaaccagcgaaaagaaatcggctgtcgagtcgtcgcaaggtgttgctcgccgtatctcctttccccctcctccctgcgtcccccggctccggcgatccgccgcacctgaacccttctccacgtcgcctcgccggttgggttgaggtgagccgatcagatccgatcggggccggtccttgcgccactgctgcgtgagctcatctcggtcgaccgcctgcttggctcgatcggccggggacggcggcggccagatctgcaatggagggcaacaaggacgacgcggccaagtgcctgcgcatctggcaagggcgcgctcgacgccggcgaccgcgcgcgcgccatcaagttcctgtccaaggcaaagcgcctggacccctcgctgcccatcgacgacctcctcacctcccttctcaaccccgaaggcgactcccaggcttcttcgcccccgccgtcttcaccaccgcaaactgccgcagcaggggcatcggaggcagttgaggctgatgggctgagagagaggaagcacaagggcaagaatagggaggaggaggcgactcgggagtacaccgcagagcaactcgaggttgtgcgccaggtcaaaaagcacaccagggactactaccagatcctcggcttggaaaaggactgcagtgtcgaggacgtgcgcaaggcctaccggaagctctcgctcaaggtgcaccccgataatgacaatgcccctggcgcagaggacgccttcaa

SEQ ID NO: 76069 - DNA, 804 bp, Zea mays
  misc_feature: Ceres CLONE 1560649
  misc_feature: Encodes the peptide sequence at SEQ ID NO. 76070
ggagctccccgcggtggcggccgctctagaactagtggatcccccgggctgcaggaattcgtctcacccctagaaaaaattccattccattccagtactcgctcatcttgctccgccttctgcttctgcgcatcctccaaggatcgtgatggccatggccacgcaagcctccgctgccacgcgccacctggtggccgcctccgcctgggcgccgtcggcgaagccgcggcagccgagctcacagctcgcgctgctgccgtcgtcctcccgcgcgccggccccgctccgcgcgaccgccggggaggcggtgaccgaggaggcgcccaaggggttcgtggccccgcagctggaccccagcacgccgtccccgatcttcgggggcagcacgggcgggctgctccgcaaggcgcaggtggaggagttctacgtcatcacgtgggtgtcccccaaggagcaggtgttcgagatgcccaccggcggcgccgccatcatgcgggaggggcccaacctcctgaagctggcgcgcaaggagcagtgcctcgcgctcggcaccaggctgcgctccaagtacaagatcacctaccagttctaccgcgtcttccccaacggcgaggtgcagtacctccaccccaaggacggcgtctacccggagaaggtcaaccccggcagggagggcgtcggccagaacttccgcagcatcggcaagaacgtcaaccccatcgacgtcaagttcaccggcaagagcaccttcgactaatcacacatcacgccgcccgcccggccggtgatccaaatcaaaggatt

SEQ ID NO: 76070 - protein, 202 aa, Zea mays
  misc_feature: Ceres CLONE 1560649
  misc_feature (65)..(202): Pfam Name: PsaD Pfam Description: PsaD
MAMATQASAATRHLVAASAWAPSAKPRQPSSQLALLPSSSRAPAPLRATAGEAVTEEAPKGFVAPQLDPSTPSPIFGGSTGGLLRKAQVEEFYVITWVSPKEQVFEMPTGGAAIMREGPNLLKLARKEQCLALGTRLRSKYKITYQFYRVFPNGEVQYLHPKDGVYPEKVNPGREGVGQNFRSIGKNVNPIDVKFTGKSTFD

SEQ ID NO: 76071 - DNA, 815 bp, Zea mays
  misc_feature: Ceres CLONE 1560651
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (190)..(190): n is a, c, t, g, unknown, or other
  misc_feature (222)..(222): n is a, c, t, g, unknown, or other
  misc_feature (223)..(223): n is a, c, t, g, unknown, or other
  misc_feature (351)..(351): n is a, c, t, g, unknown, or other
  misc_feature (362)..(362): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnccaaagctgggactccccgcggtggcggccgctctagaactagtggatcccccgggctgcaggaattcgtctcacccctagaaaaaaagcggcactcgcacgatcaatgtacacanttgcccgtccgtgccaccacatccagcatcgnntcgccagcctcgccacccccgcgccgtcctcctcctccggctccggccgccccaggctcaggctcatcccggaacgcccccgtcttcgccgccccccgcccacgtcgtgtaaacgggaacggcgggcncctgaggagtncaaaccaaaagagatcggagagagaaaaaaaagggaagggcattccacccaacccggggggggaaaaaaaaaaggggggggggggggggaaataaaaaaaagagggcccccccaaaaaaaaaaagggggggggggggggggggaaaaaaaaaaaaaaataaaaaaaaaagggggcccctcttggccttttaaaaaaaaaaaaaaaaaaaaagggggggcccccccaaaaaaaaaaaaaaaacaccccccccaaaaaaaaaatcccccccccccccccccggggggggaaccccccttaaaaaaaaaaaaaaaaaaaaaaaaacccccccaccaaaaaaaaaagcgccccccttttttttttttttttagaagaaagagaggttttcctcccccccgggggggggggggggggaacggcccccccccccccccccgcgcaaagaagagggtgtt

SEQ ID NO: 76072 - DNA, 862 bp, Zea mays
  misc_feature: Ceres CLONE 1560653
  misc_feature: Encodes the peptide sequence at SEQ ID NO. 76073
  misc_feature (671)..(671): n is a, c, t, g, unknown, or other
  misc_feature (691)..(691): n is a, c, t, g, unknown, or other
  misc_feature (815)..(815): n is a, c, t, g, unknown, or other
ggagctccccgcggtggcggccgctctagaactagtggatcccccgggctgcaggaattcgtctcacccctagaaaaaatagtgcagcaagcaactgcaaagcagcaagctctactcttcttctgtactgaacgtgtgactagataacaataagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggcggtggctacaacaagtccggcggcggcgatgactacggccgtagcggcggcgacgactacggccgtggcaccggcggtggcgggtacaacaagtccggaaacgacggctacgacagcgggtacaacagatcgggcaccaccaacgacgacgaatacggccgtggcaccggcggcgggtacggcagcaagccctctggcgacgacgcgtacgccggcggcggcgggtggcgggtacggcaagcagtccggtggaggcgcggacgaaggcggagagtacggctcctcccgggacactcganaaaattacaggaaaggaggnagaaggagcacaagcacaaggagcacctcggcgaagatggggcggccctcgcccgcgggcgccctttcgccttggtacgaagaggcacgtagcccgaagaagggaaccccggagcacgcgcagncggcacaaagattccaaggagggcttttgtccggcccggtgggccgc

SEQ ID NO: 76073 - protein, 206 aa, Zea mays
  misc_feature: Ceres CLONE 1560653
  misc_feature (170)..(170): Xaa is any aa, unknown, or other
  misc_feature (177)..(177): Xaa is any aa, unknown, or other
MADEYGRSGYGRSGAGDDYDSGYNSKSGTDDYGRGEGGYNKSGGDDDYGRSGGDGYGRSGGDDYGRGTGGGGYNKSGGGDDYGRSGGDDYGRGTGGGGYNKSGNDGYDSGYNRSGTTNDDEYGRGTGGGYGSKPSGDDAYAGGGGWRVRQAVRWRRGRRRRVRLLPGHSXKLQERRXKEHKHKEHLGEDGAALARGRPFALVRRGT

SEQ ID NO: 76074 - DNA, 840 bp, Zea mays
  misc_feature: Ceres CLONE 1560656
  misc_feature: Translation starting site: 95
  misc_feature: SWISSPROT Homolog: EC 4.4.1.5 Lactoylglutathione lyase
  misc_feature (756)..(756): n is a, c, t, g, unknown, or other
  misc_feature (784)..(784): n is a, c, t, g, unknown, or other
tggagctccccgcggtggcggccgctctagaactagtggatcccccgggctgcaggaattcgtctcacccctagaaaaaagctagctggctagcatggccgggaaagagcttacgctgctggggttatgggcgagcccgttcgtgctccgggcgcgcatcgcgctcagcctcaaaggcctcacctacgcttactccgaggagaacctcgacgacaagagcgagcttctcctcagctccaaccccgtgctcaagaaggtgcccgtgctcatccaccacggcaagcccgtctgcgagtcccagatcatcgtgcagtacgtcgacgaggctttcccggccgccacacctaatttccttccatccgacccctacgaccgcgccattgctcgcttctgggcctcctacgtcgacgacaagttctacagcgcgtggatacccgtgttcaggggcaggacggcggaggagatggcggaggcggcgaggcaggccgtcgcggcgctggagacgctggagcaggcgttcagggagtgctccaaggggaaggccttcttcggaggggacagcgtggggctcgtcgacgtcgtgctcggcgcctttgttggggtggctgtacgccaccgaggccatctgcggggtgaacgccctcgacgccggcaggacgccgctgctggcggcgtggggcggagcggttctgcgcgctggaaggtgtcaaggggctgatcccggacgtggacagggcttctggagtataccaaggnccaggcgggcccgtattttggctgccgnccgctcccgtcttaggcatagcataaccgtggacatgtttccttttcctttttttt

SEQ ID NO: 76075 - DNA, 814 bp, Zea mays
  misc_feature: Ceres CLONE 1560657
  misc_feature: Encodes the peptide sequence at SEQ ID NO. 76076
  misc_feature (119)..(119): n is a, c, t, g, unknown, or other
  misc_feature (390)..(390): n is a, c, t, g, unknown, or other
ggagtccccgcggtggcggccgctctagaactagtggatcccccgggctgcaggaattcgtctcacccctagaaaaacttcgctgcgccgccgcctccgacatcgtctcttcgtccccnacgagcaaccgataatccgccggcgctgagatgttggtttatcaagacctcctatctggcgacgagctcctgtcggattcattcacctacaaggagctcgagaacggcgtcctgtgggaggtcgagggaaagtgggtcacccaaggtcctgttgatgtagacattggtgccaatccatccgccgagggtggtgaggatgaaagcgttgatgacacagccgtgaaggtggttgatattgttgacacattccgtctacaggagcaaccctccnttttgacagaaatcattttggtctctttacataaaaaaataccatcaagaatcctcaactgctggtggttggaagccagagaaaaggcggaatgaagttccaaaaaaaagggtgtgtccaaggggtgcaaacccagttttcttccttaagcaaggctgaggggaccctccaattggaaagttcctttccaaaaaaaacattgggaatttttttttattagccctaaaaaaagggctttgggaaaaagtcccccccggcgagatttctttaccccaaaaccctttgggggaaaaaaaatttttccaaccccttggggggacactttttttaaggggaggggggcgggggagaaaaaaaaaaaaaaacacttttttttaaaaaaagaaaaaaaaaaaaacgtggggtttttctttataacaaaaag

SEQ ID NO: 76076 - protein, 111 aa, Zea mays
  misc_feature: Ceres CLONE 1560657
  misc_feature (1)..(109): Pfam Name: TCTP Pfam Description: Translationally controlled tumour protein
  misc_feature (81)..(81): Xaa is any aa, unknown, or other
MLVYQDLLSGDELLSDSFTYKELENGVLWEVEGKWVTQGPVDVDIGANPSAEGGEDESVDDTAVKVVDIVDTFRLQEQPSXLTEIILVSLHKKIPSRILNCWWLEAREKAE

SEQ ID NO: 76077 - DNA, 797 bp, Zea mays
  misc_feature: Ceres CLONE 1560658
  misc_feature: Translation starting site: 115
  misc_feature (47)..(47): n is a, c, t, g, unknown, or other
  misc_feature (61)..(61): n is a, c, t, g, unknown, or other
  misc_feature (62)..(62): n is a, c, t, g, unknown, or other
  misc_feature (528)..(528): n is a, c, t, g, unknown, or other
  misc_feature (582)..(582): n is a, c, t, g, unknown, or other
  misc_feature (584)..(584): n is a, c, t, g, unknown, or other
  misc_feature (585)..(585): n is a, c, t, g, unknown, or other
  misc_feature (699)..(699): n is a, c, t, g, unknown, or other
tggagctccccgcggtggcggccgctctagaactagtggatcccccngggctgcaggaatnntcgtctcacccctagaaaaaagcctcagccaccgaccgttgcaccagctcgcatggcgctccacgccgtctcccccgcggcggtctcctccccgctgcgcgccctctcgcgcagattcccccagcgctcaggctgtggttgtttaccaaagcagtccgtcacaatttgctcctctacgaactttgcaagaaaacttcaggatggaccagtggacttcgctgccaggcgactggttcttggacactcggacaagagagcagttttgacgcatgccactattgaagaaatcgaagcggagaaatccctcatcgaagaccaagctaaagaaaagatggagaaggcgatcgaaacagtccaaactaacttcaacactgtgaggacagggcgtgcaagcccggcaatgcttgaccggatcgaggtcgagtactacggaactccagtgaacttgaaagagcatgcacagatnagcactccagatgcaacttctctttctatcaaccatatgataagtcaagcctcnanngctatgagaaaactatagttgccgcaaatcttggttgtgacaccaagcatgaccgagaaatgataccagtgactgtcccaacgttgaacatctgatccccaaaaggatttagcnaagaacgggggctaaattgggctgaaaaatggcaaggttggcctttaggagaccttagaaaaaatggcctttcaagctttccgataaacatcaaaaaa

SEQ ID NO: 76078 - DNA, 851 bp, Zea mays
  misc_feature: Ceres CLONE 1560659
  misc_feature: Encodes the peptide sequence at SEQ ID NO. 76079
  misc_feature (729)..(729): n is a, c, t, g, unknown, or other
  misc_feature (730)..(730): n is a, c, t, g, unknown, or other
  misc_feature (769)..(769): n is a, c, t, g, unknown, or other
  misc_feature (778)..(778): n is a, c, t, g, unknown, or other
  misc_feature (780)..(780): n is a, c, t, g, unknown, or other
  misc_feature (813)..(813): n is a, c, t, g, unknown, or other
  misc_feature (814)..(814): n is a, c, t, g, unknown, or other
ctggagctccccgcggtggcggccgctctagaactagtggatcccccgggctgcaggaattcgtctcacccctagaaaaagttaaaccaacaaaatgttgttcgaggcgttcccctcctccacgcaaccttctcccctccagatccaggattgccgggctccttgactcgttacctcgcgcgccctcggtgagctactttgtttcgatttagcgacaaatcagtttgcttcatgttgcgcaggcttagatctgttcttcgtcttacggcttgaatcgagctgggaggccgtggatctgagcacgggagatacaacaaatccgcgtgtatgacgagttggatcggcaccggttagtctctgaccgcaagattttgttgttgtgttgggctgatctgccgcgttgttttgcttcaggttctagagctagcgaaatcgcaaggctattagggttccgttcggagcgcgtctgaagcgatgatggctgaagacggcggcgggatcgggatgatgaatctgctgcgctgataattattggatgaatttcgataattattagatctaagagatgcgccgacttgaagaggcgaggtaaggtgcaacatgtataagacgtgacatgctatagaggcctttgcccatggtgggtgcgctcgcatggcaggccacggtaataaaagaagatatttttgtgtcctgggggggtggagatcgcaccgggggaattgtttnntttggccccccgggtctccctccctcagtggtggttcgntgtccctgngntgcattgggtcctttggcgttggtttggcgatnnctcagctcacctacacggctttcggattttttgcatt

SEQ ID NO: 76079 - protein, 71 aa, Zea mays
  misc_feature: Ceres CLONE 1560659
  misc_feature (31)..(31): Xaa is any aa, unknown, or other
  misc_feature (47)..(47): Xaa is any aa, unknown, or other
  misc_feature (48)..(48): Xaa is any aa, unknown, or other
  misc_feature (59)..(59): Xaa is any aa, unknown, or other
MVGALAWQATVIKEDIFVSWGGGDRTGGIVXFGPPGLPPSVVVRCPXXALGPLALVWRXLSSPTRLSDFLH

SEQ ID NO: 76080 - DNA, 884 bp, Zea mays
  misc_feature: Ceres CLONE 1560662
  misc_feature: Encodes the peptide sequence at SEQ ID NO. 76081
  misc_feature (254)..(254): n is a, c, t, g, unknown, or other
  misc_feature (265)..(265): n is a, c, t, g, unknown, or other
  misc_feature (297)..(297): n is a, c, t, g, unknown, or other
  misc_feature (362)..(362): n is a, c, t, g, unknown, or other
  misc_feature (478)..(478): n is a, c, t, g, unknown, or other
agctccccgcggtggcggccgctctagaactagtggatcccccgggctgcaggaattcgtctcacccctagaaaaaacggagtacgtcagaaaccggcaggaagcaggaaacgggaggcaggcatgtcgtcgtccaaggacgctcctctcagccctcgatcccagctggcgctcagttgcttcgaggagctcctcgactgcgccgtggcggacgtcgcgtcggagtgccaccgcatcgcgcgcctcggcctggnacgcagcgtcnacggcgaagaggaagagctccgcgtctgggcngcacgtgcggcggcccgccgccgctggaggtgaccaccacccaccctggagtagccgggcccccnaggtagggtgggaacaaagggccggggtccaaactgttccggcaaaaccaacccccgccattgccccccaaatatcctcccaagtgtttaaaactgggggtccccctttttttttnccccggccccttttcccccccaaccctctaaaaaaattccttggggcaaaggggccgggaaaccccccccaaccaaaatatttccagggggggcctttccggggggggggcccccttaaaaaaacaccattgggggaggggtttgccccccccccccaccttccccttatttccccccccggggggaaaccccttttaaggggggggacccccccctcctttgggtgggtatcttcgaccccgggcggccggcggctatggggggggagattaactcccccccccccccccccccccccggggggggggggggagagaaaccccctccacccaaaattttttgtttgggtgcccccacaaagaggggggggtgggggggggtaaaaccccccgttttttctttttt

SEQ ID NO: 76081 - protein, 68 aa, Zea mays
  misc_feature: Ceres CLONE 1560662
  misc_feature (44)..(44): Xaa is any aa, unknown, or other
  misc_feature (48)..(48): Xaa is any aa, unknown, or other
MSSSKDAPLSPRSQLALSCFEELLDCAVADVASECHRIARLGLXRSVXGEEEELRVWAARAAARRRWR

SEQ ID NO: 76082 - DNA, 822 bp, Zea mays
  misc_feature: Ceres CLONE 1560664
  misc_feature: Translation starting site: 98
  misc_feature: SWISSPROT Homolog: EC 4.4.1.5 Lactoylglutathione lyase
  misc_feature (767)..(767): n is a, c, t, g, unknown, or other
  misc_feature (768)..(768): n is a, c, t, g, unknown, or other
ctggagctccccgcggtggcggccgctctagaactagtggatcccccgggctgcaggaattcgtctcacccctagaaaaaaaagctagctggctagcatggccgggaaagagcttacgctgctggggttatgggcgagcccgttcgtgctccgggcgcgcatcgcgctcagcctcaaaggcctcacctacgcttactccgagaagaacctcgacgacaagagcgagcttctcctcagctccaaccccgtgctcaagaaggtgcccgtgctcatccaccacggcaagcccgtctgcgagtcccagatcatcgtgcagtacgtcgacgaggctttcccggccgccacacctaatttccttccatccgacccctacgaccgcgccattgctcgcttctgggcctcctacgtcgacgacaagttctacagcgcgtggatacccgtgttcaggggcaggacggcggaggagatggcggaggcggcgaggcaggccgtcgcggcgctggagacgctggagcaggcgttcagggagtgctccaaggggaaggccttcttcggaggggacagcgtggggctcgtcgacgtcgtgctcggcggccttgtgtggggtggctgtacgccaccgaggccatctgcggggtgaacgccctcgacgccggcaggacgccgctgctggcggcgtggggcggagcggttctgcgcgctggaaggtgtcaaggggctggatcccggacgtggacagggcttctggagtataccaagggccagcnnggccgtatttggccttgccgcccgcctccgtccttaggccatagcataacgggg

SEQ ID NO: 76083 - DNA, 780 bp, Zea mays
  misc_feature: Ceres CLONE 1560668
  misc_feature (686)..(686): n is a, c, t, g, unknown, or other
  misc_feature (710)..(710): n is a, c, t, g, unknown, or other
ctcaccgcggtggcggccgctctagaactagtggatcccccgggctgcaggaattcgtctcacccctagaaaaaacctcacacaaacacacataccgaatccagccccgctacccaccgttgcgcccgccgcccgagtcgccgtggccgccgcggcagcgccctcccggccgtgagcgcggcccagcgtcgcgcgccgtcgggccaacggccgggcccttggaaggggccccaaaaatctgggggcccctaaggggcccccctcccccccaatagggcctttccccggtggaattgccatgggggggggttccccggtgggggggggaaaaaaaaggggggccccccccaacccccccccccgggggttgtggccccccccccccccccccccgtttcccccccccccaaaggggggggcggggggggggggaccaaatcggggaaaaaaccgggtttagaaaaaacccccaaaaaaaagggtcttcccaacgggtgtggttgccccccccctttttggagaaaaccccccgggggggggggggtgttttttcctggggggggaaaaaaaaagggggccctcccccttggggggggggagggggtggttgatttttttttctttctttcccccccccaagaagagggggggggggggagatttttttttttggggggggggggatntatatttattttttctttttccgnggcgggggggggggggggggcgccccctcctctttttttttcttggattgaaaagagaagaaggaagaat

SEQ ID NO: 76084 - DNA, 775 bp, Zea mays
  misc_feature: Ceres CLONE 1560669
  misc_feature (43)..(43): n is a, c, t, g, unknown, or other
  misc_feature (44)..(44): n is a, c, t, g, unknown, or other
  misc_feature (195)..(195): n is a, c, t, g, unknown, or other
  misc_feature (196)..(196): n is a, c, t, g, unknown, or other
  misc_feature (251)..(251): n is a, c, t, g, unknown, or other
  misc_feature (252)..(252): n is a, c, t, g, unknown, or other
  misc_feature (261)..(261): n is a, c, t, g, unknown, or other
  misc_feature (262)..(262): n is a, c, t, g, unknown, or other
aaagctggagctccaccgcggtggcggccgctctagaaactanngtggaatcccccggggctgcaggaattcgtctcacccctagaaaaactcatcccctcagtcctcagtccctcacacactcactatacactgctctgctgcagcaagaaggaagaagctagcgcctccctagctctcgttgtcagcaatggnnccacacggcgcgtccagcctcctcaagtcctccttcgcgggctccgggctccttnnggcacgcgnnacacaacccgttgttcgtggccctggccaccccgggggccggggggggccccattcgggggttaattttctcttccccaacccggcccaagaacctgaagtcccttccgggtcaacccccctaaagaaatccactttggtccccccaaaaaaaacccccgggccccctttgggggaaaggtttccccccccccccaaaaaaaaaaaatgtttttttttttggggcccccggggtcccccggggcttttttctccgcggaaaaaaaaaattttcaaaaaaaaacccccccccgggggggggggggcccccctggagaaaaaaaatattttttttccccccgggggggggggccctttttggttggggggggaaaaatttttttttcctcccacacagaaggggggggggaagaaaaaagagcccccccccttttttttttttttaaaaaaaaaaaaaagaggggaggggggggggtccctccaaaaagggggaggagatatataaaattttggg

SEQ ID NO: 76085 - DNA, 846 bp, Zea mays
  misc_feature: Ceres CLONE 1560671
  misc_feature: Encodes the peptide sequence at SEQ ID NO. 76086
  misc_feature (705)..(705): n is a, c, t, g, unknown, or other
ctggagctccccgcggtggcggccgctctagaactagtggatcccccgggctgcaggaattcgtctcacccctagaaaaaaaaatccccaaatcgaaaggggccgtccggctcagggtttctcgacggctccttgccctctccgccatggacgcacagcgagccctccttgacgagctcatgggcacaggtaagtacccaccagattagccctcgcccgaacggcgccgccccataccctaaccttcccctaatcgcgccgcaagtactgtcgtttgcagctcgcaacctaacggaggaggagaagaaggggcacaaagagctgaagtgggacgatccggacgtgtgcggcccttacatggttcggttctgtcctcacgaccttttcgtcaacaccaagagcaatatcgggccgtgctcgaggatccacgatccgaagctcaaggaaagctttgagaagtctcctaggcacgatacttatatgcaaaggtttgaggcagagcttgcacaacaatgtgagaaattggtaatggacttagatagaaagataaggcgtggtcgagaaaggctggctcacgattctgctgtgccaatgccaatccctggaaaattagctgagctgctttcagtgcgaaaaagacaggtgaagaagctgctggagcaaattgaggagcttggtgaggctggtaaagtggatgaagctgangcacttaatgagaagggttgacattttaaacgctgagaagacagctttagctaacgaagcagaacacaaagtagctatgctttgagaagaagatggactttgtgaaaacatgtggatcattctttagttgcctgatgatgc

SEQ ID NO: 76086 - protein, 122 aa, Zea mays
  misc_feature: Ceres CLONE 1560671
  misc_feature (1)..(123): Pfam Name: LUC7 Pfam Description: LUC7 N_terminus
  misc_feature (116)..(116): Xaa is any aa, unknown, or other
MVRFCPHDLFVNTKSNIGPCSRIHDPKLKESFEKSPRHDTYMQRFEAELAQQCEKLVMDLDRKIRRGRERLAHDSAVPMPIPGKLAELLSVRKRQVKKLLEQIEELGEAGKVDEAXALNEKG

SEQ ID NO: 76087 - DNA, 1170 bp, Zea mays
  misc_feature: Ceres CLONE 1560673
  misc_feature: Encodes the peptide sequence at SEQ ID NO. 76088
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
tttatataatgagaggacagagaggggcgtggggcctcttccgcccccctgtgtttttaaaaatnnnnnggaagatggagctcaccgcggtggcggccgctctagaactagtggatcccccgggctgcaggaattcgtctcacccctagaaaaactgttcctgaagcttccgacatccgaccgcctcctcctcctcggtctactcgccgccccttctaagatcatccggacgcgtgccggtgaacctccagagctgtgcaggcatggcgatgccgactggggtcgcgacctccaaggtcctcctcctcctgccgcgcatcgcatgacgggcttgatgctgttgtcatatggcccattatctgatttgctagcaaaactccaggagattatgaacggagtaactcccggagctgctccaggcccctatgcagtattacttatggaagcccacattcggaaacagacccatgatagggactgcccccccatcctcaaatccattttaccatactttatgacgaatctggactcggctaggtgagtgtttgtttccagacgcactggccgacgaggcctccccttgtggagcattgagtaattctcatacctctgtctgtaatgttaaacggggtctgttctgccatatctgtttcgcagatgtttgggatcaagagctatggggccgtcccgtgggggaatatgctgctcttccacaagctataatattccccatgccatgcaacacatgtccgcacggtttatgatatgataataacatatgctaattttggactgtttcatcagagataacacaaaaataaatacaatcccctacattctcacctcaccgacatcatacaataagagatcttcctcttcccttactgtggtagcgaagtataataagaacatagcactacatactggtatcaccatgttttcctctctcatgaatgttcctcgctgctcatagaataatgtcacagtgtatctccgcagtcatcgccgaacacaattcccggtgctgacctcccgcaagcaacaaacaaagtacttaatcgtaaatagttacaaagacatcgacagcctagtatctggcgcacgaggtatctttcttctcactctagtcatatctggctcacccgcactaatctaccgacattgctgacg

SEQ ID NO: 76088 - protein, 72 aa, Zea mays
  misc_feature: Ceres CLONE 1560673
MTGLMLLSYGPLSDLLAKLQEIMNGVTPGAAPGPYAVLLMEAHIRKQTHDRDCPPILKSILPYFMTNLDSAR

SEQ ID NO: 76089 - DNA, 813 bp, Zea mays
  misc_feature: Ceres CLONE 1560675
  misc_feature: Encodes the peptide sequence at SEQ ID NO. 76090
  misc_feature (658)..(658): n is a, c, t, g, unknown, or other
ccccgcggtggcggccgctctagaactagtggatcccccgggctgcaggaattcgtctcacccctagaaaaaaatcccatatcgccccacaattccaaacttcgcctcgccgctccccctccctacacaagcttcctccccctccgcgccgctcctccaggctccagccatggcgatcgccaccgagtcgcgcggcagcgaggacagggcttcagcccatgcaaacgaggagaagcggtgggtgctgtctgatttcgaggttgggaagcctcttgggaggggcaaattcggccacgtatatcttgccagagaaaagaggagcaatcaaattgtggctttgaaagttcttttcaagagccagcttaagcaatcacaggtagagcatcagctgcgacgcgaagtggagattcagagtcatcttcgtcatcctaatattcttcgcctgtatgggtacttctatgatcagacccgggtttacctaatcctggaatatgctgccaagggtgagctgtataaggaactgacaaggtgtaaacatttttctgagagacgttcagcaacttatattgcatcattggctagagctctgatctacctgcatgggaagcatgttatccatcgggacattaaaccagaaaatcttttggttggagcccanggcgagatcaaaatcgccgactttggctggtctgtgcataccttcaacagaagaaggactatgtgcggaactctggattacctgccacctgaaatggtggagaagacagaacatgatttacatgttgacatatggagccctgggtattctgtgtt

SEQ ID NO: 76090 - protein, 214 aa, Zea mays
  misc_feature: Ceres CLONE 1560675
  misc_feature (29)..(214): Pfam Name: Pkinase Pfam Description: Protein kinase domain
  misc_feature: SWISSPROT Homolog: EC 2.7.11.1 Non-specific serine/threonine protein kinase
  misc_feature (163)..(163): Xaa is any aa, unknown, or other
MAIATESRGSEDRASAHANEEKRWVLSDFEVGKPLGRGKFGHVYLAREKRSNQIVALKVLFKSQLKQSQVEHQLRREVEIQSHLRHPNILRLYGYFYDQTRVYLILEYAAKGELYKELTRCKHFSERRSATYIASLARALIYLHGKHVIHRDIKPENLLVGAXGEIKIADFGWSVHTFNRRRTMCGTLDYLPPEMVEKTEHDLHVDIWSPGYSV

SEQ ID NO: 76091 - DNA, 841 bp, Zea mays
  misc_feature: Ceres CLONE 1560677
ctccccgcggtggcggccgctctagaactagtggatcccccgggctgcaggaattcgtctcacccctaaaaaagataatgcgcaaggaagtgctaaacgccgaggtcttgtcttctgcggtgctgaacgtatgcactaggttacagtaatcgtgaaccatgtgatgacgagtacggcctcagcggctacggcaggtccggcgccggcgacgactacgactgcggctacaacagctactccggcactgatgactacggccgtggcgaaggctgctacaacaactcgagcaactgatgacgactacccccgcagcgcaagttattgggtccgctagtcgagtggcaacgactaccgcagtggttacgttggcggtggctacaacaagtgcggcggatgcgaccactacgagccgtaggggcggctacgactactgccatggcaccggcggtggcgggtacaacaagtccggaaactacggctacaacaactgctacaacatatatggcacctaccaccatcacgattactgcctgggcacccgcagcggatacagcaaaatccctctggctacgatgcccacacctgcgctagagtgggcgggacagccagccttcctgtggaggcgctgtaccagggcggagagtaccactcccccgggggagacccactaaaattcctggaaggaggataacggtttccaccgcatgggagcactatcggaaaaaattgggcaccctatccccctgtcccatttgtctcctgtaccaaaaagagagaaagtggaaaatagggacccggttcaacttttcttgttaaaaaataaccctaaaaatggttttgg

SEQ ID NO: 76092 - DNA, 932 bp, Zea mays
  misc_feature: Ceres CLONE 1560680
  misc_feature: Encodes the peptide sequence at SEQ ID NO. 76093
aaaatttcgcaggtggaaagaagaggaagcgaacgagaggcaacggtggccggtcgcgggacgggtggggccacgcctggcctgacgcgggaagccggccggaaccatccaactccgccgcgtcgtcgtcgccttcgtctcgcgtgctcaccaagagaacaaaacgcgagcagccaagaattcaacgtccacggtccgcccaccctccgtttccgcttcctccctccacgtcgtctcggtcttcctctcctgtaatcccgtgacacgggtggctgcgacggcgaatcagatccctacccgtggcgttggtcgtgaattggcgccgtctccccctgccagccggattccctgctttgttctcaggcaacattttgttcactagtgtggtagctttgttgattggagtgcgcaatgggaggctgtgcgggaaaggtacgtcgtgatgacgaagaaaagcttgattttaaaggtggaaatgttcatattataacaagcaatgagggctgggaccagaagattgcagaagcaaacagagatgggaaaactgttgttgcaaatttcagcgcttcctggtgtgggccatgccgtgtcattgctcctgtctatgctgaaatgtcaaagacttatcctcaactcatgttcttgacaatagacgttgatgacgtgatggacttcagctcttcatgggacatccgtgcaaccccgacattcttcttcctcaagaacgggcagcagatcgacaagctcgtgggcgcgaacaaacctgagctcgagaagaaagtgctagcagccgctgatgccagtacgtcctagtgacacaagtggaagtgggcaaacgatctgtgatggcttcccggtgtatagtttccatggttcatttgtgtgcttgtcccatgtttgcctggggacgatgacgttttacaattttggcc

SEQ ID NO: 76093 - protein, 133 aa, Zea mays
  misc_feature: Ceres CLONE 1560680
  misc_feature (23)..(127): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MGGCAGKVRRDDEEKLDFKGGNVHIITSNEGWDQKIAEANRDGKTVVANFSASWCGPCRVIAPVYAEMSKTYPQLMFLTIDVDDVMDFSSSWDIRATPTFFFLKNGQQIDKLVGANKPELEKKVLAAADASTS

SEQ ID NO: 76094 - DNA, 970 bp, Zea mays
  misc_feature: Ceres CLONE 1560686
  misc_feature: Encodes the peptide sequence at SEQ ID NO. 76095
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (380)..(380): n is a, c, t, g, unknown, or other
  misc_feature (381)..(381): n is a, c, t, g, unknown, or other
  misc_feature (412)..(412): n is a, c, t, g, unknown, or other
  misc_feature (641)..(641): n is a, c, t, g, unknown, or other
  misc_feature (893)..(893): n is a, c, t, g, unknown, or other
  misc_feature (894)..(894): n is a, c, t, g, unknown, or other
nnnnnnnnnnnnnnnnnnnnnnnnnnnnnnnnnnnnnnnnnnccccnnnnnnnnnggggnnnnnnnnnnnnnnnnnnnnntttaaagctggtgctccccgcggtggcggccgctctagactagtggatcccccgggctgcaggaattcgtctcacccctagaaaaaaagccggacgacgcagcgtagcagcagagagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgtttctcgccgcgctggcgctgtcgtcggtgctggctgtctcggnncgcacctccccctcggccgggggcggcgaanttcgcgggggctgaacccgttgcaaggaatcccaaggcctttcccgaaaggcccaagaagaaccccgatcaaagaaaggccccccccgctcccccttaaaaaaaataaaggcgcccccaaaaaggggccccccccgcggggtttggcgcattaaaaaggcgcccacatgtggggaaaaaaaaaaaaaaaaggcccggggtgttcaaaaaaaaccccgcgaaaaatttcnggggggtttttttgtggggggggggcccaaaaaagggggttttcccccccccctcttattttgtttggggggggggggaaacacccggggggacactggggggggggggagttatttttttttccccccccggggggggggggggggggctctttcctccaaaaaaaaatcccccccggggggggaaaaataggggggggggtgtggccgccccaaaaaaaaaaaaacctctctttttttgcggttcttttnnggggggggggagaagaaaaaaaacaaaccccccccccccgcggggggggggggaatataactttcctcctccccct

SEQ ID NO: 76095 - protein, 71 aa, Zea mays
  misc_feature: Ceres CLONE 1560686
  misc_feature (57)..(57): Xaa is any aa, unknown, or other
  misc_feature (68)..(68): Xaa is any aa, unknown, or other
MAALAAASTAAFAAKPRARLSVACSAATGDSSSVSLASSVKTFLAALALSSVLAVSXRTSPSAGGGEXRGG

SEQ ID NO: 76096 - DNA, 664 bp, Zea mays
  misc_feature: Ceres CLONE 1560689
  misc_feature (208)..(208): n is a, c, t, g, unknown, or other
  misc_feature (210)..(210): n is a, c, t, g, unknown, or other
  misc_feature (211)..(211): n is a, c, t, g, unknown, or other
  misc_feature (263)..(263): n is a, c, t, g, unknown, or other
  misc_feature (264)..(264): n is a, c, t, g, unknown, or other
  misc_feature (314)..(314): n is a, c, t, g, unknown, or other
  misc_feature (315)..(315): n is a, c, t, g, unknown, or other
  misc_feature (501)..(501): n is a, c, t, g, unknown, or other
  misc_feature (528)..(528): n is a, c, t, g, unknown, or other
  misc_feature (529)..(529): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (642)..(642): n is a, c, t, g, unknown, or other
tggagtccccgcggtggcggccgctctagaatagtggatcccccgggctgcaggaattcgtctccccctagaaaaagtcaaagcagagtctgcccctccccgcgccgttctttttggttccccactccccagtccccgccgccgtccgtaaacccgcagaatggaggtcgtcgtcgccgcgaagcagaaggcgaagaaacacatacancnnctcttctacttgctcaagaaatggcgagggaagctcgcccctcaaagatcgnncggcccaggcttccgaacgcccattcgaagccttccaattccccatttcnnaaacctgggcgggaacctttccaacaaaaggggggtttccccccgaaaaaccccgtgttttcttctcacaaaaggggggggggacaaaaaaaaaaatcccccgggggggggggaaaaccaacaaggggggggggggggttttttccgtgggggggcccccccttttttaaaatcctccccccccgntggggggtttttttttttttcgaaaannaaaaaaaaaaaaatctccccccccccccgaaannnnttttttttttttgggggggggggggggggccccccaccaaaaaattttttttttttttttgttgggggccccccccncttttttttatctacccccccc

SEQ ID NO: 76097 - DNA, 782 bp, Zea mays
  misc_feature: Ceres CLONE 1560692
  misc_feature: Encodes the peptide sequence at SEQ ID NO. 76098
  misc_feature (96)..(96): n is a, c, t, g, unknown, or other
  misc_feature (110)..(110): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
ctccccgcggtggcggccgctctagaactagtggatcccccgggctgcaggaattcgtctcacccctagaaaaagcaagcaaacctaaccaagccntctgcggctcttcnttcgaatccagactgccgcccgcgatccccaaaatcgaacccaagtcgaaaccctaacctcggccttctcgatgtcggccgccacaaccgccccaacccctgcggtggccaccccgatggcgccgcctccgtcgtacccggcctcctccacgatctccgcctccgtggccgcgtcggtcgaggaagaggacgacctctatggccgcctcaagtcgctccagcgcccacatggagttcggtcgaaagatcccccggaggaggacgttaaggacaaccaaaaaccctcagggccgaacccttccgtgcgcaggaaggaggtcaagcgggaaccccgtccgtaacccctttgtttttgggcaatttttttgggaaaatgggccaaaagggaaacaaaaggggttttggggggggtgtccaacagggggggagaaaaaaaaaattagggggggggggatcctctagaacccccttaataaacccgggagggtggtgtttaaaagcgcggggggaaaaaatttgtgtggggggggggttgtttatattttcccacccccaaaaaaacattttttttaaattaaaaaaagagggggggcgcccccccccccgcggggggggggaaaaaaccccccccccnnnnttttttcttctttttttttagggggggggggaggg

SEQ ID NO: 76098 - protein, 89 aa, Zea mays
  misc_feature: Ceres CLONE 1560692
MSAATTAPTPAVATPMAPPPSYPASSTISASVAASVEEEDDLYGRLKSLQRPHGVRSKDPPEEDVKDNQKPSGPNPSVRRKEVKREPRP

SEQ ID NO: 76099 - DNA, 796 bp, Zea mays
  misc_feature: Ceres CLONE 1560694
  misc_feature: Translation starting site: 215
  misc_feature (290)..(290): n is a, c, t, g, unknown, or other
  misc_feature (301)..(301): n is a, c, t, g, unknown, or other
ctggagctccccgcggtggcggccgctctagaactagtggatcccccgggctgcaggaattcgtctcacccctagaaaaaccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaactgcccccgggcttccnggtcacccgancgacgaggagctggtggcgcactacctctgcgcgcgcgccgcggggcgcccgcccgccggtgtcatcattcgcgaggtcgacctgtaccgcttcgaccccctgggaactgcgggatcgcgccctcttcggccgccgcgaagtggtacttctttcacgccccggggaacgcaagtaccccaaaagggtcccgccccaaaaccgggccccccggggcggggcttactgaaagggccacgggggcccggaaaaaaaccccctggaaaaacccgggggcgcccgaaaacggggggagaaaaaaaaaaggggccctcggtttttttcccaccgggaaaaccccccccccccgggggggtccaaaaacggggggggtgtaaattttgccccaaaattctccccccccctcccccggggggaacacccccaaaaaaaaaatttgcgggggggccgggggggggccccttattaaggggtggggaaagataaaaccggcgggt

SEQ ID NO: 76100 - DNA, 847 bp, Zea mays
  misc_feature: Ceres CLONE 1560695
  misc_feature: Translation starting site: 147
  misc_feature: Pfam Name: S1 Pfam Description: S1 RNA binding domain
ctggagctccccgcggtggcggccgctctagaactagtggatcccccgggctgcaggaattcgtctcacccctagaaaaaactggcactgccattcccgtttcctcgctcgaacacacaccgaagagagagacagagcgagagaggatggcgtccctggcgcagcacgtcgcgggcctaccgtgcccccctctatccggcgcgtcgcgccgtcgccccgcggcgcagaggcggcctccgtcggcgcttgtgtgcggtacctatgcgctgaccaaggacgagcgggagcgggagcggatgcgccaggtgttcgacgacgcctccgagcgctgccgcaccgcgcccatggagggcgtcgccttctcccccgacgacctcgacaccgccgtcgagtccaccgacatagacacggagatcggctcgctcattaaaggaacagtatttatgactacctcaaatggtgcatatatcgacatccaatccaagtctactgcttttttgcccttagatgaggcatgtcttcttgatatcgataatgttgaagaggctggcattcgtcctggggtagtagaagaattcatggataattgatgagaacccagggtgatgaaaactttgattctaagtttgcaagcaattcagcaagaacttgcatgggaaaaggtgccggcaacttcaggccgaagatgtcgttgtcacgggtaaagtaattggtgaaaccaagggaagtgtagtagcccctggggaatgggcttaaaggggttccgttccattttccccaaggggcatccaaaaacaaccccccaaaaaaactgcttgagaaaaaaaattgccccctcgaaaagttt

SEQ ID NO: 76101 - DNA, 829 bp, Zea mays
  misc_feature: Ceres CLONE 1560700
  misc_feature: Encodes the peptide sequence at SEQ ID NO. 76102
ctcaccgcggtggcggccgctctagaactagtggatcccccgggctgcaggaattcgtctcacccctagaaaaaatcccctcagtcctcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctccctccccaccccgccctacgacctgacgtccttccggttcagccccatcaaggagtccatcgtgtcccgcgagatgaccccgcgctacatgacggacatgatcacccacgccgaccccgacctggtgaacgtgggcgccggggtccgggggcctgtcctggcccttaccaaccttccaaagaacccacccggaagcgggggcctcggggaaaattcctgtgtccccgggcggggggcccttggcttgggcggcacccttttttcccgcccatgggggggggcccggggccggggccccctgtttccctggaaaaaactggggggggggggctcaacaaaaggcccaggagaaaacccggggggggaaaaaaaacccgggggcgtgttttcccctccccccccggttaaagaacggggtctctttggggggggggccccaaaagttaaaaattttttttaaaacccccctgggggggtgtgggagagaaaccctataaattggggcggggggg

SEQ ID NO: 76102 - protein, 201 aa, Zea mays
  misc_feature: Ceres CLONE 1560700
MATTAASSLLKSSFAGSRLPSATRTTTPSSVAVATPRAGGGPIRASISSLPTPPYDLTSFRFSPIKESIVSREMTPRYMTDMITHADPDLVNVGAGVRGPVLALTNLPKNPPGSGGLGENSCVPGRGALGLGGTLFSRPWGGARGRGPLFPWKKLGGGGSTKGPGENPGGEKKPGGVFSPPPPVKERGLFGGGAPKVKNFF

SEQ ID NO: 76103 - DNA, 853 bp, Zea mays
  misc_feature: Ceres CLONE 1560704
  misc_feature: Encodes the peptide sequence at SEQ ID NO. 76104
agctccccgcggtggcggccgctctagaactagtggatcccccgggctgcaggaattcgtctcacccctagaaaaaggtaccgcaatgtcgctgctgctgctgctgctcgtgctcgccgcgtcgccattgcagcatgccagggcggttggcggcggcaggccgcgggtgccggccatcctggtgttcggcgactccatcgtggacacgggcaacaacaacgccgtcctcacgctcaccaagtccaacttcaggccatacggcaaggacctcaacggcggcgtccccaccggacgcttctccaacggcaggattccgacggacttcgtagcttcacggctcggcttgaaagatctggttccggcgtatctcggcaccgacctcagcgacgacgacctctgcacgggcgtcagcttcgcgtctgggggcaccggctacgacccgctcacctccactctcgtggcagttctgccgatgcaggaggagctcaacatgttcgcggagtacaaggagaggctcgcaggggtcgtccgagacgaggccgccgccgcatgcatcgtggccgaaagcctgttccttgtctgcgccgggtcggacgacatcgccaacaactactacctcgcccccgtcagacctctgcagtacgacatctccgcgtacgtggatttccttgtggagcaggcctgcgacttcatgaggcaactgtaccagcaagtggccaggatgatcgcggttcttggggatgcccccgggtcggggtgcgtgcccatcacagcgggacccctcaccgggcggccttggccagggaactgtcgaccccgcctccgcaaccatcgcaggggcagcttggtacca

SEQ ID NO: 76104 - protein, 256 aa, Zea mays
  misc_feature: Ceres CLONE 1560704
  misc_feature (31)..(255): Pfam Name: Lipase_GDSL Pfam Description: GDSL-like Lipase/Acylhydrolase
  misc_feature: SWISSPROT Homolog: EC 3.2.1.51 Alpha-L-fucosidase
MSLLLLLLVLAASPLQHARAVGGGRPRVPAILVFGDSIVDTGNNNAVLTLTKSNFRPYGKDLNGGVPTGRFSNGRIPTDFVASRLGLKDLVPAYLGTDLSDDDLCTGVSFASGGTGYDPLTSTLVAVLPMQEELNMFAEYKERLAGVVRDEAAAACIVAESLFLVCAGSDDIANNYYLAPVRPLQYDISAYVDFLVEQACDFMRQLYQQVARMIAVLGDAPGSGCVPITAGPLTGRPWPGNCRPRLRNHRRGSLVP

SEQ ID NO: 76105 - DNA, 779 bp, Zea mays
  misc_feature: Ceres CLONE 1560706
  misc_feature: Translation starting site: 163
  misc_feature (547)..(547): n is a, c, t, g, unknown, or other
  misc_feature (767)..(767): n is a, c, t, g, unknown, or other
  misc_feature (768)..(768): n is a, c, t, g, unknown, or other
ctccccgcggtggcggccgctctagaactagtggatcccccgggctgcaggaattcgtctcacccctagaaaaaacgccgctgctccaagaaaccaccgccgagcccaaccgcacaagcgcgcgaggcaggagagagagagagagaggcggggagcaaaacaatggaggggaaagaggaggacgtgcgcctgggcgccaacaagttctctgagcgccagcccatctggacggcggcgcagggcgccgctgactacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggaggaatgatcttcgcgctcgtctactgcaccgcccgcatctcccggagacacatcaaccccagctgtgactttccggctgttctcgcccagnaagctgtcccctgactaggccctcttctacattatcatgcaatgcctgggtgccatctgtggagctggagtggtgaagggcttccagcagggactttacatgggcaacggtggtggcgccaatgttgtcgcacctggctacaccaagggtgatggccttggcgctgagattgttggcaccttcatcctagtctacaccgtcttctcggccaccgatgccnnagagaatgccc

SEQ ID NO: 76106 - DNA, 1141 bp, Zea mays
  misc_feature: Ceres CLONE 1560707
  misc_feature (752)..(752): n is a, c, t, g, unknown, or other
  misc_feature (844)..(844): n is a, c, t, g, unknown, or other
  misc_feature (1036)..(1036): n is a, c, t, g, unknown, or other
  misc_feature (1060)..(1060): n is a, c, t, g, unknown, or other
  misc_feature (1141)..(1141): n is a, c, t, g, unknown, or other
cgagtgagaaagaggtcacaaaaagtacgataaaaaggagccccgaccgagatataagtaaggacagggaagaggaggccgcacccgggggcggccgctctagagtagagggtcccccgggctgcgagagtacgtctcacccctacaaaaatagtcgtaaccgactggtcaccgcgtgatgctttggccgcctttcatgagagctccattgggagatccacccctgggggccgggggcgtggaatttcggctctcacgctccctagggagtttagctttggcgatcattggacagcccacaaacactaatcccgaggaagacagaccctgaacccgaaggagctgccgatgccgggcgggctcccgggtacaagcccgtggaaccgctccgtgcgaagattgagaccggagttcacggggggcgcgtgtggccgcccactatggtctccggtagggaggagttttgccgaggaacccccgcgttggtgggtatatgggtctaggtctcttgggtgagagatgactgcttctctggatataatacttttatcggaaaaaatcatagtgcaaaagtcctagatgatgaaacatgtccctctgatggcgaaactaattaatgacgatgatatatcatgaatgaaaaagccatgggcgatcagtcccatgagtagtatcatgaacgattgtctacagagaaaggcctgaatcaatttcgatgcacaaaaatgtattaccttaatcaatccgtactnaaaaatgtttctgtgataccctacccaaaacaggacacccttcttattacctagtctcatgccttgccagtcacagaaagacaaaaaaagtntagatgccctgggtggtggcctaaacctgagactaattcttctgctctggacgagtggctgtctcctaaacctctgaagggaggatggactgaaggctcaggtctcacctgagtgtaagactggttgtgtgccgcaggaggcgtgggtgtattgttggtgggctgtggtggtgcatggactgtggtctgccnctgtgtgcactgctgtatgtgggnctgctgtgtcgtggtgtgtcgacacggttgcctgtgctggctcctggctggcgcgctggggtgactggccgggcgctgcgn

SEQ ID NO: 76107 - DNA, 859 bp, Zea mays
  misc_feature: Ceres CLONE 1560708
  misc_feature: Encodes the peptide sequence at SEQ ID NO. 76108
  misc_feature (859)..(859): n is a, c, t, g, unknown, or other
ctcaccgcggtggcggccgctctagaactagtggatcccccgggctgcaggaattcgtctcacccctagaaaaaggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgaatccacgcgcaaagcaatcctccccatctgggcctggccagggcgtgctccatgggtgccggtcaaggggctacctcattggccggggggccgactcggcgaggtccctcaaccaccctgtaaccctgggcgggatgattcgaaccccctccgggcttggccggacataaccccaaggccctttccccagagactaaaaggtgaaaggaagctcaaagaaaacggccggaccgtcggcaattggttgtcccagagttgccagggttatcgttcggaaaaagggtgaatacgtcn

SEQ ID NO: 76108 - protein, 204 aa, Zea mays
  misc_feature: Ceres CLONE 1560708
  misc_feature (61)..(204): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLNPRAKQSSPSGPGQGVLHGCRSRGYLIGRGADSARSLNHPVTLGGMIRTPSGLGRT

SEQ ID NO: 76109 - DNA, 840 bp, Zea mays
  misc_feature: Ceres CLONE 1560710
  misc_feature: Encodes the peptide sequence at SEQ ID NO. 76110
  misc_feature (705)..(705): n is a, c, t, g, unknown, or other
ctccccgcggtggcggccgctctagaactagtggatcccccgggctgcaggaattcgtctcacccctagaaaaatagaaaaaatcatcagtcatcacataccaccaagaccacatcggcacatcgacgtgagctcgtgcgtgagtgccctggtcgacgaccgctcgcgcgccatggactcaacgacgacggcgccgctgctgcagccgtccgccgcctcgagcaaggaggggccggggccggcgccggctcagcacggtgagggcagccgggagctggaggcgatcctggccgacgcgtccaagccgtgggcttggcgggcctgggaaggcgcccgcctggagctgccgctgctgctgcgggtggcgctgccggcggtggccgtctacatgatcaacttcgtcatgtccatgtccacgcagatcttctgcggccagctcggcaacctcgagctcgccgcctcctcgctcggcaacaccggcatccagcccttggcctacggcctcatgctgggcatgggcagcgcggtggagacgctgtgcgggcaggcgtacggcgcgcacaagcaccgcatgctgggggtgtacctgcagcgctcgacggtgctgctcatggccaccgccgtgccgctgaccgtcgtctacgccttctcggagcgcatcctggtcctcctcggcgagtcggagcgcatctccagggcccgccngccgtcttcgtctacgggctcatcccgcaagatcttcgcgtacgcggccaacttccccatcccagaagttcctgcaggcgcagagcatcgtggcgcccagcgctttacatctcgttggccacgctgggcgctgca

SEQ ID NO: 76110 - protein, 222 aa, Zea mays
  misc_feature: Ceres CLONE 1560710
  misc_feature (67)..(222): Pfam Name: MatE Pfam Description: MatE
  misc_feature (178)..(178): Xaa is any aa, unknown, or other
MDSTTTAPLLQPSAASSKEGPGPAPAQHGEGSRELEAILADASKPWAWRAWEGARLELPLLLRVALPAVAVYMINFVMSMSTQIFCGQLGNLELAASSLGNTGIQPLAYGLMLGMGSAVETLCGQAYGAHKHRMLGVYLQRSTVLLMATAVPLTVVYAFSERILVLLGESERISRARXPSSSTGSSRKIFAYAANFPIPEVPAGAEHRGAQRFTSRWPRWAL

SEQ ID NO: 76111 - DNA, 866 bp, Zea mays
  misc_feature: Ceres CLONE 1560714
  misc_feature: Encodes the peptide sequence at SEQ ID NO. 76112
ggagctccccgcggtggcggccgctctagaactagtggatcccccgggctgcaggaattcgtctcacccctagaaaaaagggttcgcggatcccccacgacacctataagcaccaaccctagcccaaaaccccgcttccacttcacagcctctccgcctccgctcctcgcgccgccgccgcgtctcctcctgtacaggtaaggagaggaagagggcgaaatggtgaagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccccgcccgactgctggtcctctacgccccattgttcaatgccagactttaaagtacaacatgaagtcaagggctgggagaggctttacccttgaggagctgaaggctgctggcatcccaaagaagcttgctccaaccattggtatttctgttgatcaccgccgcaagaacaaatcccttgagggactgcaggccaatgtccagagggctaagaaataccaagccaagctgggtttttttcccaagggggggaccaaagggttaaggggggggggacccccaccccgaagggagattgtgccccgctaatcacaagaggccagggggggaaacacgagcgccctttttccccccgggggggaagaaaaaaaacccctatattagggaagttgtgtaaaagaacgggccgcccacaaaaatatatgtagggaaagaagtgtgtcttttctgaccgccatcccatgggcgtgaggaaaaaaaagagacccccccgcttgagttgtgtggac

SEQ ID NO: 76112 - protein, 148 aa, Zea mays
  misc_feature: Ceres CLONE 1560714
  misc_feature (6)..(144): Pfam Name: Ribosomal_L13e Pfam Description: Ribosomal protein L13e
MVKHNNVIPNGHFKKHWQNYVKTWFNQPARKQRRRIARQKKAVKIFPRPTAGPLRPIVQCQTLKYNMKSRAGRGFTLEELKAAGIPKKLAPTIGISVDHRRKNKSLEGLQANVQRAKKYQAKLGFFPKGGTKGLRGGGPPPRREIVPR

SEQ ID NO: 76113 - DNA, 868 bp, Zea mays
  misc_feature: Ceres CLONE 1560716
  misc_feature (265)..(265): n is a, c, t, g, unknown, or other
  misc_feature (485)..(485): n is a, c, t, g, unknown, or other
  misc_feature (512)..(512): n is a, c, t, g, unknown, or other
  misc_feature (618)..(618): n is a, c, t, g, unknown, or other
agctccccgcggtggcggccgctctagaactagtggatcccccgggctgcaggaattcgtctcacccctagaaaaaaccaaaagttcaaaaccccatccaattccaaatcccacttctcgccagttcacctccgcctccgctcctcccactccccctcccgtcctgccatggccaccgcagcacgcgccctcgtcgccgcacgcccggcacggccgctgctgccgtctcggcgcctcccggtccctccctcttttccaatgcccnttttcccccgccggaaactgcttggcccggggggtccccttcaagggtcggggggcggattcccccctttttcccccgtttttttgggggcaggggggggaaactgggacccaaataaaaagggggcccccttttccccggtgggggggaaacaaaaaaaggggtgttttttttttgggaaaaaaacccgggggggggggggggggcccccccagcggcngcaaagggggaggaggggtgtcttcancaaaaacaacctttctcaaagccggggggggggggggggaaaaaaaagaagggggccccaaaaaaaaaaagaaatttaaaattgtgggggccgggcgcacgagaanatttttttttgttggcggcggcgggggcaaattttttgggaggagagagagacaccccccccaaaccaaataataaggggcgcccccgcgggggggggggtgttgtttgttttgttctcggcgcccacccaccccccagtagatgggtggaggaaaagaaagaaaaaaaaaagggggcggggggggtgggttttattttttgaggaggagggaaagaaaaacatgaacctctcggctcaaaaaaaagaaa

SEQ ID NO: 76114 - DNA, 869 bp, Zea mays
  misc_feature: Ceres CLONE 1560720
  misc_feature (763)..(763): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (838)..(838): n is a, c, t, g, unknown, or other
  misc_feature (839)..(839): n is a, c, t, g, unknown, or other
  misc_feature (843)..(843): n is a, c, t, g, unknown, or other
  misc_feature (844)..(844): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (864)..(864): n is a, c, t, g, unknown, or other
ctggagctccccgcggtggcggccgctctagaactagtggatcccccgggctgcaggaattcgtctcacccctagaaaaacttctccagcgatgtgccccgcgcctagaacacaccagctagcaagcgcgctcgatcgaataccgctaccgtgtctccatgggcgccaccgcgtctctgtgatccgtctgggcgccgctgtcagtgcccgggctcaagaagccgctcagcttgtctgctctccggcccctgcatccgagggcggcgaggatgacaacgacggccgtgcgggcgtcggcttctccctcgtccacgtccatcaaggaataatgctgcggactggctgacagctgcggccctgtcggccgctctggtggtgccggacgtctctgatgccgcgcattacggggggaatctctccagaactaaagaacttcgctcctcaccatactgtccgggggggtcgtgcccgataggtattgaacagagccaaatggctgcctctctctcacctcatacacatgtacagagggccatgatactgaatccaatcgtgaatgatcaccatcacaatgtgttcccgtcactgttgcgatgtgcttgctcagtactcgaaagaagagtgctgtgctccacacgtgagtgcaatggattgtcggagaatgaccggtacttatatctatcgttaaaaacatggagttcgtcgttccttaaaaggagagtgttttccaatgcttgaacttttgtagtaagggtgtgctacntcaatatccgcgtgtttaggatactgctagtacatgaagagtactctaggttgattgcaaagnnnnnnnnnnntnnttgnnggggtgtgnnnnncnnnncnttttt

SEQ ID NO: 76115 - DNA, 809 bp, Zea mays
  misc_feature: Ceres CLONE 1560721
  misc_feature: Encodes the peptide sequence at SEQ ID NO. 76116
aagctggagctccccgcggtggcggccgctctagaactagtggatcccccgggctgcaggaattcgtctcacccctagaaaaaaaaacccaccccacagcagccaaaaccgcgtccactttcaataacgagcggccaacccaacccaacccaacccaccactgcctccctccccgttccccagtccccaccccgaccggctggtcctcctcctttccccgcgccatcctcgaggcatcgccggcgccgcaacttcgttcaggaggaagcccgcacccggccccgatccgatggccaacagcaacctcccgcggcgtatcatcaaggagacacagcgactgctcagcgagccagcgccggggatcagcgcgtcgccctcggaggagaacatgcgctacttcaacgttatgatccttgggccggcgcagtcgccctatgaaggtggagtttttaagcttgaactctttttacctgaggaatatcccatggctgccccaaaggttaggtttctgaccaagatttatcatcccaacattgacaagcttggtaggatatgcctcgacattctcaaggacaaatggagcccagcacttcagattcgaacagttcttttgagtatacaggctctactgagtgcaccaaatccagatgaccctctctccgataacattgcaaagcactggaaatccaatgaggtagaagctgttgaaacagccaaggagtggactcgcctgtatgcgagcggtgcatgagagcgcagtgctgttctttgtgtaataccccatcatacttcagtcctaatacgttgca

SEQ ID NO: 76116 - protein, 153 aa, Zea mays
  misc_feature: Ceres CLONE 1560721
  misc_feature (9)..(146): Pfam Name: UQ_con Pfam Description: Ubiquitin-conjugating enzyme
  misc_feature: SWISSPROT Homolog: EC 6.3.2.19 Ubiquitin--protein ligase
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKSNEVEAVETAKEWTRLYASGA

SEQ ID NO: 76117 - DNA, 835 bp, Zea mays
  misc_feature: Ceres CLONE 1560722
  misc_feature: Encodes the peptide sequence at SEQ ID NO. 76118
ctggagctccccgcggtggcggccgctctagaactagtggatcccccgggctgcaggaattcgtctcacccctagaaaaaagttgctcgcttcacctgctctgtcgccgccgaacaccgccgccaggctccccctcctcactgaactgaacgaaaaacggcagcaagccgcccgcccaccaacccgacaaaatgccggggatgttggcggcgcatgttacggctgctctctctatcccagtcaccttcgccacagtacagcttacgccttgccatccgcccttcgctggcggcgagggcccgctctgtcgctccgcggacagcagcctctgcggccgccgtatccgctaaaacggcggcggcttcgtctcccctagttgaggaccgcactgtcgaccgtatcgggctccccagcaagggccgcatgggcgaccaaaccctaagcctcctcaagagttgccagttgtcggtgaggcagctcaacccgcggcagaactgggcagatatcccgctgattccaaatttggaggtttggtttcaaaggcctaaggacattgttcgtaaacttcagtcaggcgatcttgaccttggtgttgtgggttttgacatagttagtgaatacggaaacggcaatgaggatttagtggttgttcatgatgctcttgagtttggacattgtcgtttgtcccttgcggtacctaaggaaggcatttttgagaacatacatactatgggagatttactaaagatgtctgaatggacagaagaaagccactacgtgttgttactggatttggaatctaggtgaataattcctaagagaagaaaggttttag

SEQ ID NO: 76118 - protein, 127 aa, Zea mays
  misc_feature: Ceres CLONE 1560722
  misc_feature: SWISSPROT Homolog: EC 2.4.2.17 ATP phosphoribosyltransferase
MGDQTLSLLKSCQLSVRQLNPRQNWADIPLIPNLEVWFQRPKDIVRKLQSGDLDLGVVGFDIVSEYGNGNEDLVVVHDALEFGHCRLSLAVPKEGIFENIHTMGDLLKMSEWTEESHYVLLLDLESR

SEQ ID NO: 76119 - DNA, 863 bp, Zea mays
  misc_feature: Ceres CLONE 1560726
  misc_feature: Translation starting site: 152
ctccccgcggtggcggccgctctagaactagtggatcccccgggctgcaggaattcgtctcacccctagaaaaaacttgtgtagcccaacgagaagagcggcggcgcgggcggacaaggagcaggcggaggaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctggccccattcaagcagtggtacctcactcactatggagttgacattggtaggaagaagaaacccccgctgcaaagaaagataatgctgagggacaagaggtttgggcagcaacctgaggaaacgaaaaaagagcctccctgtcacgaggaaacttgagaaacgcaagggagggacgtaccccttgacccacaccttgaggaagcaatttggcagtggaaccggtggctggcatgaaatttccttcccccccctggaaaagggtgggcccaaacgtgtgtgggtacaccccctggagggggaaaaagaacttggagttctctcccggaaaaaaagctccccgggaggaaaaaaaggtgcgaacacccgccctttgtactttaataactttcg

SEQ ID NO: 76120 - DNA, 831 bp, Zea mays
  misc_feature: Ceres CLONE 1560728
  misc_feature: Encodes the peptide sequence at SEQ ID NO. 76121
  misc_feature (809)..(809): n is a, c, t, g, unknown, or other
ggagctccccgcggtggcggccgctctagaactagtggatcccccgggctgcaggaattcgtctcacccctagaaaaaggtcggggagacggggactcggggtagcgactagcgagccgaggagcgcgcgcgcgcgatggcggccgctgccgtggcgaccgtggcctccccatcccccgctgcctggtccgggggccgagggtgaggcggcggttccggggaggctggaggagcagcgggacgagccgctggcgggaagccagctcgacatcggagggctcgccttccagggcgacgtcggcgggggcttcaccggcggcggagcgggcggcgacggcaacaagatgctggaccggggcatcaatacggccatcgttctcgcggccagcacctacgcgctcaccaagctgctcaccgtcgaccaggactactggcacgggtggacgatcttcgagatcctgcgctatatgccggagcacaactggtccgcgtacgaggaggccctcaaagctaacccggttctagccaagatgatgatcagtggtgtcgtctactcccttggtgactggattgcacagtgctacgaaggcaagccaatctttgatttcgaccgtgctcggatgttccggtctggtcttgttgggttcactcttcatgggtcactttcacattactactaccatatctgtgaggcactattcccattcaaggatttggtgggttgtccctgcaaaggttgcagtcgatcagaacgtttggtctgcaatctggaacagtatctacttcgtggtcctagggttgccttcggntggaatcacctaccactatcta

SEQ ID NO: 76121 - protein, 162 aa, Zea mays
  misc_feature: Ceres CLONE 1560728
MLDRGINTAIVLAASTYALTKLLTVDQDYWHGWTIFEILRYMPEHNWSAYEEALKANPVLAKMMISGVVYSLGDWIAQCYEGKPIFDFDRARMFRSGLVGFTLHGSLSHYYYHICEALFPFKDLVGCPCKGCSRSERLVCNLEQYLLRGPRVAFGWNHLPLS

SEQ ID NO: 76122 - DNA, 817 bp, Zea mays
  misc_feature: Ceres CLONE 1560732
  misc_feature: Encodes the peptide sequence at SEQ ID NO. 76123
ctccccgcggtggcggccgctctagaactagtggatcccccgggctgcaggaattcgtctcacccctagaaaaacccactcttggtgctcttgcttgaatatagtccccctcctctctctctcacacacctgttcttcgatctcggcctagctagctagctagcgagcaagctatagcttagctcggctagccgggtgtgtcgccggtcggctaggcaacgccgctagcgatcgcaaaatggcagatgcgggggaggggcggcgggtgtgcggcatgccggagaaggcgcagctgcacgttgcgatgctggcgctgcagttcggctacgcgggcttccacgtggtgtcgcggctggcgctcaacatgggcatcagcaagctcgtcttccccgtctaccgcaacatcatcgcgctctgcctcctcgtgcccttcgcctactttctagagaagaaagacaggccgcagctgaccctcaacttcgtcgtccagtttttctttctcgcgctctgcggcatcacggcgaaccaagggttttacctcctgggcctggacaacacgtcgccgacgttcgcgtccgccatccagaactcggtcccggccatcaccttcgccatggccgcggcgctgcggatcgagaaggtccggctggaccgccgcgacggcgtagccaaggtggcgggcacactggcgtgcgtggcgggggcatccgtcatcacgctttacaggggccccacattcttcggtcacagcgccagcggcgagctcgagctggctgcaaccagcaaggcggtggcaggcgacaagtactggacgctg

SEQ ID NO: 76123 - protein, 193 aa, Zea mays
  misc_feature: Ceres CLONE 1560732
  misc_feature (28)..(161): Pfam Name: DUF6 Pfam Description: Integral membrane protein DUF6
MADAGEGRRVCGMPEKAQLHVAMLALQFGYAGFHVVSRLALNMGISKLVFPVYRNIIALCLLVPFAYFLEKKDRPQLTLNFVVQFFFLALCGITANQGFYLLGLDNTSPTFASAIQNSVPAITFAMAAALRIEKVRLDRRDGVAKVAGTLACVAGASVITLYRGPTFFGHSASGELELAATSKAVAGDKYWTL

SEQ ID NO: 76124 - DNA, 812 bp, Zea mays
  misc_feature: Ceres CLONE 1560733
  misc_feature: Encodes the peptide sequence at SEQ ID NO. 76125
ggagctccccgcggtggcggccgctctagaactagtggatcccccgggctgcaggaattcgtctcacccctagaaaaagaagcattcgatccgttcccttgccctaagacccacccctgatttcatttccccaatcatggcggcggctctgtcggggacggcggtgtccacggcagcgcttctagccccaatccgagctccaaccagcgcgtttatccggcgctcccagctcacctgtcatcgcctccactcactaaaatgccgccgcgctgggcccatcgtccccgcggccgctgctgccgcgtcgggcagcagctcgccgtcgtcagccgttttccacggcgagtgcttcgtggtgggcgacaatatcgacaccgaccagatcatccccgccgagcacctcactctggtgccctccaagccggacgagtaccgcaagctcggttccttcgccttcgcggggctcccatccgaggcctacccgacgccgttcgtcgctccgggtgaggagtcctcccgctacgccatcattgtcagcggagccaacttcgggtgcggttcctctcgcgagcacgcgcccgtcgcgcttggggccgctggcgcacgcgccattgttgcggagggctacgcgcgcatcttttatcgcaactccgtggccactgaaggaagtgtaccactctggagctcacggacgttggggccctggaaggagtgcaagacagggggatgtggtcagcgcgggacctttgctaaactccgtgttttattaacccacaccttctgggcaaggagtacaagcctgaaaccaagtc

SEQ ID NO: 76125 - protein, 225 aa, Zea mays
  misc_feature: Ceres CLONE 1560733
  misc_feature (64)..(186): Pfam Name: Aconitase_C Pfam Description: Aconitase C-terminal domain
  misc_feature: SWISSPROT Homolog: EC 4.2.1.33 3-isopropylmalate dehydratase
MAAALSGTAVSTAALLAPIRAPTSAFIRRSQLTCHRLHSLKCRRAGPIVPAAAAAASGSSSPSSAVFHGECFVVGDNIDTDQIIPAEHLTLVPSKPDEYRKLGSFAFAGLPSEAYPTPFVAPGEESSRYAIIVSGANFGCGSSREHAPVALGAAGARAIVAEGYARIFYRNSVATEGSVPLWSSRTLGPWKECKTGGCGQRGTFAKLRVLLTHTFWARSTSLKPS

SEQ ID NO: 76126 - DNA, 731 bp, Zea mays
  misc_feature: Ceres CLONE 1560735
  misc_feature (292)..(292): n is a, c, t, g, unknown, or other
  misc_feature (307)..(307): n is a, c, t, g, unknown, or other
  misc_feature (327)..(327): n is a, c, t, g, unknown, or other
tggagctccccgcggtggcggccgctctagaactagtggatcccccgggctgcaggaattcgtctcacccctagaaaaacccccttccctctcttccgcctccgattgagtggctcaccttctttcccagccagcacgagcttgcaagcaagcgagctcctgagatttcagctcgcttctcctccagaggtcgagcagaccagactcctccgaccgaagctctaccacttcccagttagcctgtccaggaactgcttggccggagatccaaacaaacctctgtggttggggnttctccggggttccnttgcgctggagggaggtttncgttctcgctggccatgggtttggctgagaagcagcagcggcagcatctttgatgccaaatctctgagctttatgaagaatcgcactcactgcggcgctcctgcttcctcactcttgctcggtgtctcctctaccgttttagtgacccataactgcctccccggatccgcattccccgtgcctctttcggccctaacctttccctcttttttgtttcctcaaaatcgccaaataaacccctagcggaacggggaaaggaacttttcaaggtaaaataggccggccgttccctggggggaaaaaaaaaaaaaagggcccctgcttgaatttttggaaaaaacccttgttcccaaaaggggggggaaaaatccccgggggggagagagggaaaacctgggggggga

SEQ ID NO: 76127 - DNA, 844 bp, Zea mays
  misc_feature: Ceres CLONE 1560737
  misc_feature: Translation starting site: 390
  misc_feature (802)..(802): n is a, c, t, g, unknown, or other
tggagctccccgcggtggcggccgctctagaactagtggatcccccgggctgcaggaattcgtctcacccctagaaaaaagcggaggccattctctacgcctgcttgattgcttgagtcagatctgatccagtcttgcggcacccagaacctaggaggagaacatggcgcggtgacggccacggccacgcggagcttccccggatccccgtgatcggcgcccgactctttgctcgcactcagtacatcccgtggctccgcgagatcgcgacacctccccgtcctcaaagccttctggagccgcacccagaaatctgcaaaggcggccgcggagcttgctcgggacttcgcgcctgacatctagtgcaaatggcgtgatagctgggctggatgagatcatgggacatagttcaatcatgggcgttgctatatgctctcgctgggcaagtccaggttgagctttccctgaagatgctcaaggctggaaaacacgttattcaagagaaacctgcttctggatctacaaccgaagcagaaactgcgctgtcaatctgccactcatttcaaaacctgttcccgcataaacccatttgggcagtcggagagaactacacatttgagcctgcctttattgagtccagtaagctgatcaatgatatcggtggatatgatgcacatccaacttatcatccaaggctcaatgaacagtccatatccatatgtcaatagcacctgcagacagaatttttgtgggatggattcatgctgggacatggagtgttcactgtcattgcaggactacnaaatgccttgtacgttcagaaatcaggagcgtattcttcgtt

SEQ ID NO: 76128 - DNA, 809 bp, Zea mays
  misc_feature: Ceres CLONE 1560739
ctccccgcggtggcggccgctctagaactagtggatcccccgggctgcaggaattcgtctcacccctagaaaaaaccgaaccaaaaggcacatgcttcgcccctccatccctccctttgcaatcctcataaccgataaacgggacacgatagaagttacgagcttctccttgtcccgtgtcttttcaggatagcccgggcgcagccgcagcatttcttggcgtcggtgtccgctggctggctactaaacaatggcgaagaggaaccaccgcggcgctgccgctccttagccggtcgaaagatgtgccgcgcaggtcgccaggaaacagaatgccgccgccgccgccgcctggacacgacgagccctcggtgacattggcaacgtcgtctccgatgccctcgacgggcaagacggtagaaatcgtcctggccggtctctttcttctatatcgtcgtctgacacttgtactgcgtcgcagtacagggcgatcaagctgccggaggggatgcaatagccgatcagcaggagcttccgagccaagctcatggaggccgctttggggaaataaaccgccgaaggctcctaaacccctggaaaacctggtggggggcgcgcccttaccgaaaccaggtgggaaattggactccaaaaaactccccttggcccggcccctgggaagggtccccagggaaaaaaataaaccctcccctaatggggcccgcgaaccgcaaaggggacctctggggtttaaaaaaactggggggaaaaaacccccgagtggaggccttctgaaaggtcctttttggggg

SEQ ID NO: 76129 - DNA, 884 bp, Zea mays
  misc_feature: Ceres CLONE 1560742
  misc_feature: Translation starting site: 452
ctggagctccccgcggtggcggccgctctagaactagtggatcccccgggctgcaggaattcgtctcacccctagaaaaaatctccggtctcacactgtaacctgaagcaaactaaacgcagagcctgcctgaccacagctaactgatctactgccaacaccagcctggtctgactgacatatccaaagacctcgaggcgtaggcgccctaggaccggctgagttctcctgtcaaggactacaccaacactccgccggcgactctggtcgacgcgtaggagctcctcagtggcgctgtaccgcgcgtctatcgccgatgtcatagccacgctgctcttcctgtacatcaccgtggccaccgtgatcgggtacaagcaccatgaccgtactcgtccgcatccagcccccgacaccggcttgcggcgagcatcgggcatcctgcaggatcacgatggggccttgggaagaactgatgcttaaatcctcggtctacttgaaccaccctgcattctcggggtgggggaccattcagccccgggccggtgacccttcccgcctggtttcccggggccaaggaaaagggtgtccccttggttccggggggaacctcctcttaaactcttggggggccaatggcccgtgggccccccatttttttttggggagggggcccttgcctaaaagaggcctttctccaagaggcccctttttaaatgggggcctctaggggggggggggggccccaacacaaattttgtggggagaggggtgttttccctatgggggaaccccggggcccttgcgcgcccgagaaatatatattggcccacccttttggggggggggcccctcccaccccaagattttttcccggcccccccccc

SEQ ID NO: 76130 - DNA, 838 bp, Zea mays
  misc_feature: Ceres CLONE 1560746
  misc_feature: Encodes the peptide sequence at SEQ ID NO. 76131
tggagctccccgcggtggcggccgctctagaactagtggatcccccgggctgcaggaattcgtctcacccctagaaaaaaccaacctcagcacaccaaggagagtacgtggaggagcagccatggcttcatcggtggccgccgcggcgagcacattcctgggcacccgcctggcggacccggcgccacagaacgggcgcatcgcggcccggttcgggttctggttgggcggcaaggcgaagcctgctccgaagaaggtggcgaagacatcgacctcctctgaccggccgctgtggttccccggcgccatggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcaaccctacagcgaggtgttcggcctccagcggttccgcgagtgcgagctcatccacggccgctgggccatgctcgccaccctcggcgccctctccgtcgagtggctcaccggcgtcacctggcacgacgcctgcaacgtggagctggtggacgggtcctcctacctgggccagccgctgccgttctccatctcgacgctcatctggatcgaggtgctcgtgatcagctacatcgagttccagcacaacgccaatctcgactcggaggataggctgtaccgctgcgctcctacttcgatccgctcggactggcgagcgaccctgagaagaatgagcggctgcagt

SEQ ID NO: 76131 - protein, 239 aa, Zea mays
  misc_feature: Ceres CLONE 1560746
  misc_feature (63)..(232): Pfam Name: Chloroa_b-bind Pfam Description: Chlorophyll A-B binding protein
MASSVAAAASTFLGTRLADPAPQNGRIAARFGFWLGGKAKPAPKKVAKTSTSSDRPLWFPGAMAPDYLDGSLVGDYGFDPFGLGKPVEYLQFELDSLDQNLAKNEAGGIIGTRFESSEVKSTPLQPYSEVFGLQRFRECELIHGRWAMLATLGALSVEWLTGVTWHDACNVELVDGSSYLGQPLPFSISTLIWIEVLVISYIEFQHNANLDSEDRLYRCAPTSIRSDWRATLRRMSGCS

SEQ ID NO: 76132 - DNA, 817 bp, Zea mays
  misc_feature: Ceres CLONE 1560748
  misc_feature: Translation starting site: 87
  misc_feature: SWISSPROT Homolog: EC 3.1.3.16 Phosphoprotein phosphatase
  misc_feature (627)..(627): n is a, c, t, g, unknown, or other
ctggagctcaccgcggtggcggccgctctagaactagtggatcccccgggctgcaggaattcgtctcacccctagaaaaagaaaaaatggcgttgctgagcccgcgcgtgccgcggctgccgccctccaccttcacctccgttgccggtgcccggtgctttggccctgccgcgaggtgccaggcgacggcggcgggcggcgtggcggccgcggggcccccgtcgtcggagctggaggccatacggtggggcagcgccaagctgcagggcgctcgcgacgagatggaggatgaggtcttgctccgcccgggctccctcctcgatggcttctccttcgccgccgtcttggatggacacgccggcttctccgccgtccagttcctcagggatgagctgtacaaggagtgcgcagctgcgttggacggcggcgcggtgctcagcactaagaatctcgacgctatcacggcctccatccagcgtgccttcgccgctgtcgacgccaagctctccacctggctcgagcaaacggacaaggacgactctggtgcgacggccactgtcatgtttctcaggagcgatgtgcttgttgtctcgcacattggggactcttgcctggtgatatcacgtnggtggaagatctgaagctttgacgggctctcatcgaccgtatgggaacaacaaaacgtcccttgaagaggtcaagaggatcagagcagcaggtggatgggattgttgatgggcgcatatgtggagacatatctgtatctcgtgcttttggggacataagatttaagaccaaaagaatgaaatgctgggtt

SEQ ID NO: 76133 - DNA, 791 bp, Zea mays
  misc_feature: Ceres CLONE 1560756
  misc_feature: Encodes the peptide sequence at SEQ ID NO. 76134
ggagctccccgcggtggcggccgctctagaactagtggatcccccgggctgcaggaattcgtctcacccctagaaaaagcagcaagtagtgaccaggagcgagcagccgacgaaaggagtcaagcaatggagaacgccgtcgacaggcagcgggtcctgctgcgacacctgaaccccgccgcggcgtcgagccccgccccgcccgccatctccgcaagcgcgtgcgcggcgggggacagctcggcgtaccaccggatgccggccttcaccgacgacgtcgtcatcgtctctgcttacaggacggcaatttgcaaggccaagagagggggtttcaaggatacctttgctgaggacctcttggttcctgtcttctaggctttggtagacaagacgaagctggacccaagtgaagttggccacattgttgttgggactgtcttagctcctggttcccagagggcaatcgaatgcagaatggctgcactgtatgctggtttccctgacactgttcctcttaagactgtaaacaggcagtgctcttctggccttcatgcatttgcagatgttgccactgctattaaagcatggctctatgacattggtattgctgctggtgttggagtccatgacagtgaacaaagttagtcttgatggccaagcgaatcccaggcctgagctattttctcgagcaagtgattgtcttcgtccaatgggcctcacatctgacatatgtgcacaccgttgtgggataacactactggagctagatcagcctgctgttgagtcacata

SEQ ID NO: 76134 - protein, 82 aa, Zea mays
  misc_feature: Ceres CLONE 1560756
  misc_feature: SWISSPROT Homolog: EC 2.3.1.16 Acetyl-CoA C-acyltransferase
MENAVDRQRVLLRHLNPAAASSPAPPAISASACAAGDSSAYHRMPAFTDDVVIVSAYRTAICKAKRGGFKDTFAEDLLVPVF

SEQ ID NO: 76135 - DNA, 831 bp, Zea mays
  misc_feature: Ceres CLONE 1560758
  misc_feature: Encodes the peptide sequence at SEQ ID NO. 76136
ctccccgcggtggcggccgctctagaactagtggatcccccgggctgcaggaattcgtctcacccctagaaaaaagcagccagctcccactcgcaccgcccgtccgcccagaactatctcgctcgtccgcgttcagctcagctactccaatttcgcaacaagttgcaagcaataaccgaccaaggacgacgaacgggtcgatggccacgctctcctcctgcagccgcctgagtagcggcaccggcgccgcggccatccaccggcagccggcccgtgctggagccgtcctcgtcgtcacctgcaggcggagctcctccgcgaccgtccgcgccgcagccgctgccacggcggcggcgccggctgccgtagagctgcagaacaagggggtgtcgctgccgacgtgggcggagttcgagctcgggcgggcgccggtctactggaagaccagcagcggcctcccgccctcgccgggcgaggggctgaccctgttctacaacccggcggcgacgaagatggccccgaacgaggtgttcggcgtggcgttcaacggcggcttcaaccagcccatcatgtgcggcggagagccgaggcagatgacgctgcaggagcggggcaaagccgacccgcccatctacaccatcaggatacgcgtgccgcagcacggtggagagacagacagcccatccatctctttcatctcatctcactagttacctctcgctgatttctctcggtgcgtgcgtgcagccgtaagcttgatcttctccctcaccaacggggccgagggggacgggccgtacacgctcaaggtcagggtcccaagccatggca

SEQ ID NO: 76136 - protein, 169 aa, Zea mays
  misc_feature: Ceres CLONE 1560758
MATLSSCSRLSSGTGAAAIHRQPARAGAVLVVTCRRSSSATVRAAAAATAAAPAAVELQNKGVSLPTWAEFELGRAPVYWKTSSGLPPSPGEGLTLFYNPAATKMAPNEVFGVAFNGGFNQPIMCGGEPRQMTLQERGKADPPIYTIRIRVPQHGGETDSPSISFISSH

SEQ ID NO: 76137 - DNA, 820 bp, Zea mays
  misc_feature: Ceres CLONE 1560763
  misc_feature: Encodes the peptide sequence at SEQ ID NO. 76138
ctccccgcggtggcggccgctctagaactagtggatcccccgggctgcaggaattcgtctcacccctagaaaaaaatgcgctgctattataacgcgaacgccgcgcaggccttccgtggtatacagcagcagaagcgcagcatcacgatcccggcccggcggcgcgtacgtcgacgaggaggaggaggacgtacgtacgcagaggcaaaggcagagagcagctgctggcaccatggctcccgtgagcatcagcgctgttccgttcctcccgacggcggcggagggggagacgaagctgcgcgcgtcgttcgtgcgcgaggaggacgagcgccccaaggtgccgcacgaccgcttcagcgacgaggtgccggtggtgtcgctcgagggcatcgacggcgcgcggcgggccgagatccgcgcgcgcgtggccgcggcctgcgaggactggggcatcttccaggtggtggaccacggcgtggacgccgcgctcgtggccgacatggcgcgcctcgcgcgcgacttcttcgcgctcccgcccgaggacaagctccgcttcgacatgtccggcgggaagaagggcggcttcatcgtctccagccacctccaggggggaggcggtgcaggactgggcgtgagatcgtgacctacttctcgtaccccggtgaatgcccgcgaactactcccggtggccggacaaaccaggcgcttgccaggcggttggtggaccggtacagcgagcagctgaagggcgctggcgtgcaggcctccggggcgtgcttctcggaggccatgggccctggaacccggaggcgcttgccca

SEQ ID NO: 76138 - protein, 136 aa, Zea mays
  misc_feature: Ceres CLONE 1560763
  misc_feature: SWISSPROT Homolog: EC 1.14.11.9 Flavanone 3-dioxygenase
MAPVSISAVPFLPTAAEGETKLRASFVREEDERPKVPHDRFSDEVPVVSLEGIDGARRAEIRARVAAACEDWGIFQVVDHGVDAALVADMARLARDFFALPPEDKLRFDMSGGKKGGFIVSSHLQGGGGAGLGVRS

SEQ ID NO: 76139 - DNA, 754 bp, Zea mays
  misc_feature: Ceres CLONE 1560772
  misc_feature: Encodes the peptide sequence at SEQ ID NO. 76140
  misc_feature (186)..(186): n is a, c, t, g, unknown, or other
  misc_feature (187)..(187): n is a, c, t, g, unknown, or other
ctggagctcaccgcggtggcggccgctctagaactagtggatcccccgggctgcaggaattcgtctcacccctagaaaaatttacatcaagattgctaactgtcatttgaagggagatagctaagcatgaggctgcctcagcgtacgtcgaggcagcaaattgctacaaaaagttttcaccgtcannggaagctgcagcaagcgctaaaccagtctgttaatcttttcttgggaaattggtaggttgaacatggctgcaagatacagcaaggacattggtgagatatatcagcaagaaacagatttagagaaagctacagattaccctggaaaagggccagcttgaccttttttgacagtgaagggaaaagtccgtcctcaatcaaaacccccttcaaacgaaaaagttgcaaaaaatggctgcctcagttggaaaccgtcccacaaagccaccggaaaaatttggaaacgaatcccccccccaaaataaaaaaaaaaaaaaaacttttctttaaaaaaaaaaggggccaaaaaagaaaaatcctctcttaaaaagggggggggattcttgtgcaaaatttttggggaaaggggggaatccccctttttggcccccaccaaaaaaaaattttttttggtggggggcctcccccccccccgaaaaaaatatttgcccccccccccttttttttttttcttttttgggggaacaccccccaaaataaaaacaaaagcttttttttttttaacaaaa

SEQ ID NO: 76140 - protein, 31 aa, Zea mays
  misc_feature: Ceres CLONE 1560772
MAARYSKDIGEIYQQETDLEKATDYPGKGPA

SEQ ID NO: 76141 - DNA, 846 bp, Zea mays
  misc_feature: Ceres CLONE 1560775
  misc_feature: Encodes the peptide sequence at SEQ ID NO. 76142
taagctcaccgcgatggcggccgctctagaactagtggatcccccgggctgcaggaattcgtctcacccctagaaaaagcaaacatcctcctctcctcgcagacatcttatcccctcccgatcgaggcccccgtttcctcctcctccggccaccgcacctagctgtcttaacttgccgttcgcagcctcacgcccatggctaggaagtgctctagctgtgggaacaacggccacaactcgaggacctgcagcggccacggcgccgggggcgtgaggctgttcggggtgcagctgcacgtggggtcctcgcccgtggccatgaagaagtgcttcagcatggagtgcctgtcgtcgtcggcgtccgccgcgccggcgtactacgcggccgctctcgccgcgaccaacagcgcctcgccgtcggcctcctcctcctcgtcgctcgtctcggtggaggaggcccccgagaagatggcccacgggtacctctccgacgggctcatgggcagggcggccgcaggagaggaagaagggcgtccatggacggaggacgagcactggcgattgctggggggcctggaaaaactcgggaagggcaactggcgagggatcttccgggacttcgtgacgacgaggaaccccaacgcaggtggccatcccacgcccagaaataacttgccgccagggagaagcgagcgggacccaaaaggaaggggacggttccgcctcacttgggtcgtgggaagatgaaaatacaaagagggtgcggtcgacggaacctaccataaatgggggatggagaggtgcccataacgagtcgcggggaaaaagctgtgcaagaaaacaaag

SEQ ID NO: 76142 - protein, 183 aa, Zea mays
  misc_feature: Ceres CLONE 1560775
MARKCSSCGNNGHNSRTCSGHGAGGVRLFGVQLHVGSSPVAMKKCFSMECLSSSASAAPAYYAAALAATNSASPSASSSSSLVSVEEAPEKMAHGYLSDGLMGRAAAGEEEGRPWTEDEHWRLLGGLEKLGKGNWRGIFRDFVTTRNPNAGGHPTPRNNLPPGRSERDPKGRGRFRLTWVVGR

SEQ ID NO: 76143 - DNA, 713 bp, Zea mays
  misc_feature: Ceres CLONE 1560776
  misc_feature: Encodes the peptide sequence at SEQ ID NO. 76144
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (586)..(586): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
tggagctccccgcggtggcggccgctctagaactagtggatcccccgggctgcaggaattcgtctcacccctagaaaaaacctccacagctagcatcgatccgccattgctcaccgcacaagtgcacgctcacctcacacacgcagctaagtagctaacgccgtaggcgagaacaagaaaaggctcgacatggccgaggagaagaagcagggcctgcagctgctggacttctgggtgagcccattcgggcagcgctgccgcatcgcgctggacgagaagggcctggcctacgagtacctggagcaggacctggggaaaaagagcgagctgctcctccgcgccaacccggtgcacaagaagatccccgtgctgctgcacgacggccgccccgtctgcgagtccctcgtcatcgtgcagtacctcgacgaggcgttcccggcggcggcgccggcgctgctcaccgccgacccctacgcgcgcacgcaggccccgcttcgtgggcggactacgtcgacaagaaagctgtactactgccggcacccggggggggggaaaccctcaagggggggaaacgggggnnnnnggnggtccccaaaaaaaaaannnnnnnnnnccccccccccccccagggggggggggggggaggtactctcccccccccccccggaggggggggggggggaaaaaaaaaaaaaaaaaaatacattttcttt

SEQ ID NO: 76144 - protein, 174 aa, Zea mays
  misc_feature: Ceres CLONE 1560776
  misc_feature (7)..(80): Pfam Name: GST_N Pfam Description: Glutathione S-transferase, N-terminal domain
  misc_feature: SWISSPROT Homolog: EC 4.4.1.5 Lactoylglutathione lyase
  misc_feature (131)..(131): Xaa is any aa, unknown, or other
  misc_feature (132)..(132): Xaa is any aa, unknown, or other
  misc_feature (133)..(133): Xaa is any aa, unknown, or other
  misc_feature (139)..(139): Xaa is any aa, unknown, or other
  misc_feature (140)..(140): Xaa is any aa, unknown, or other
  misc_feature (141)..(141): Xaa is any aa, unknown, or other
  misc_feature (142)..(142): Xaa is any aa, unknown, or other
MAEEKKQGLQLLDFWVSPFGQRCRIALDEKGLAYEYLEQDLGKKSELLLRANPVHKKIPVLLHDGRPVCESLVIVQYLDEAFPAAAPALLTADPYARTQAPLRGRTTSTRKLYYCRHPGGGKPSRGGNGGXXXSPKKKXXXXPPPPRGGGGEVLSPPPPEGGGGEKKKKKNTFS

SEQ ID NO: 76145 - DNA, 1134 bp, Zea mays
  misc_feature: Ceres CLONE 1560777
  misc_feature: Translation starting site: 498
  misc_feature (6)..(6): n is a, c, t, g, unknown, or other
  misc_feature (7)..(7): n is a, c, t, g, unknown, or other
  misc_feature (75)..(75): n is a, c, t, g, unknown, or other
  misc_feature (320)..(320): n is a, c, t, g, unknown, or other
  misc_feature (517)..(517): n is a, c, t, g, unknown, or other
gggggnnttaaaatatgtatgcgggggggggggcgggatgggggatatttaatctcgaaaaacgtgggggggggnagtgggggggggggggcctccccgcggagggcggccgctctggaacgagagtatcccccggcggtgcagagaattcttcctcccccctagtaaaaagggccgcctagcggccagctccgcttcgggggctctccccggcgtgtcccctctcgtacgcagcctcgacccagctgaagatgttcagccgtaggcgatcgaaggcggccggcgccgttagtctgtgactccgccagcaggaagaacanaagaacactccagccacccgagaggaacgacaaccgcccagaacgacgaagaagaagtccagtcgacagccgcaagcacatcttctcccccgcgaagccgtgcagccgaggaatgcgatggccacgagaaggaactggtgcagctcaagcgcgaggcccgtttgaagggtggtttctatgtcagtcctgaagcacanctactctctgtggagccgcatcggggggattggcgccatgcaccccaagagccgggaacatctttgcgcccttctgcgattgaggcagatctttccatgggggtgccccctacagaggtcaggtaagggcgatctatttgtcatgactggcgcaggggtgtgaggcccatatgctggctttatgggggtgcccaaggcgttctaaggagtcgccagagaggagtgtgtttcctccacatgagggggggttattaagggaaggcttagaaacataagtctggcagggggattctctcagctgtgtgtccacaccaatcgcagaagtttccctccggagtgtgtagggggcttaatgggggccaaagtcggtccgagcaattgccgttctgggtagggtagggacagtcatccttcgtgtatccaccaaagaggatctcctttggggctggtctatatggcctcacgaacgggtcactgggggagggagggcgagttcttcctctgtcccggtggggcgctaccgatccgcacgggctttagaatgagctcgccccttatctgagaggaagggggccttggcagatgagaggaagaggtagggcaaacccgccccagaa

SEQ ID NO: 76146 - DNA, 806 bp, Zea mays
  misc_feature: Ceres CLONE 1560778
  misc_feature: Encodes the peptide sequence at SEQ ID NO. 76147
tggagctccccgcggtggcggccgctctagaactagtggatcccccgggctgcaggaattcgtctcacccctagaaaaagtccgggagacggggactaggggtagcgactagtgagcccagaagtgcgcgcgcgcgatggcggcgcgtctgccttgtcgaccgtggcctccccatcccacaatgcgtgttgcgggggcccagggtgacgcatccggtctcgggatgctggacgaccacctcgactagccgctggcgggaagccagctccacgtctgaagggtctccttcctcggcgacgtccggcggggcttcgaagggagcagagcgggcagcgaccgctacgagatgctggaccagggtatcaatacagtgatcgttctcgcggccagctcctacgcgctcaacaagctgctctccgacaatcaagacttctggcacggttggacgatcatccagatcctgccttatatgccagagcacttgctggtctccgtaccaagaggcgctcaaggcttacccggttctatcccagatgatgatcatttgctatcttctactcacttggtggactggattggacagagcttcgaaggctaacctatatttgatttctaccgtacacagatgttcatgtcacggtcgtgacgggtgcggacatcatgggtgaggttaagattactactaccatctctgtggagcactattcacatctcaggattggcttggttgataccgctaaggtagactacgatcttaccgttgagtctaacatcgagacagtatctgcgtcgtggtctgatgtacc

SEQ ID NO: 76147 - protein, 83 aa, Zea mays
  misc_feature: Ceres CLONE 1560778
MLDQGINTVIVLAASSYALNKLLSDNQDFWHGWTIIQILPYMPEHLLVSVPRGAQGLPGSIPDDDHLLSSTHLVDWIGQSFEG

SEQ ID NO: 76148 - DNA, 815 bp, Zea mays
  misc_feature: Ceres CLONE 1560779
  misc_feature: Encodes the peptide sequence at SEQ ID NO. 76149
  misc_feature (741)..(741): n is a, c, t, g, unknown, or other
tggagctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcagcagcttcgaccccctcggcctgggcgacgaccccgaggccttcngccagctcaagtgaaagagctcaagaacggcgccttcgcatgttttcatggtcgggctcttcgtccaggcaatg

SEQ ID NO: 76149 - protein, 207 aa, Zea mays
  misc_feature: Ceres CLONE 1560779
  misc_feature (61)..(208): Pfam Name: Chloroa_b-bind Pfam Description: Chlorophyll A-B binding protein
  misc_feature (204)..(204): Xaa is any aa, unknown, or other
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGGPLGEVVDPLYPGSSFDPLGLGDDPEAFXQLK

SEQ ID NO: 76150 - DNA, 793 bp, Zea mays
  misc_feature: Ceres CLONE 1560780
  misc_feature: Encodes the peptide sequence at SEQ ID NO. 76151
agctcaccgcggtggcggccgctctagaactagtggatcccccgggctgcaggaattcgtctcacccctagaaaaacccactcttggtgctcttgcttgaatatagtccccctcctctctctctcacacacctgttcttcgatctcggcctagctagctagctagcgagcaagctatagcttagctcggctagccgggtgtgtcgccggtcggctaggcaacgccgctagcgatcgcaaaatggcagatgcgggggaggggcggcgggtgtgcggcatgccggagaaggcgcagctgcacgttgcgatgctggcgctgcagttcggctacgcgggcttccacgtggtgtcgcggctggcgctcaacatgggcatcagcaagctcgtcttccccgtctaccgcaacatcatcgcgctctgcctcctcgtgcccttcgcctactttctagagaagaaagacaggccgcagctgaccctcaacttcgtcgtccagtttttctttctcgcgctctgcggcatcacggcgaaccaagggttttacctcctgggcctggacaacacgtcgccgacgttcgcgtccgccatccagaactcggtcccggccatcaccttcgccatggccgcggcgctgcggatcgagaaggtccggctggaccgccgcgacggcgtagccaaggtggcgggcacgctggcgtgcgtggcgggggcatccgtcatcacgctttacaagggccccaccatcttcggtcccagcgccagcggcggcctcaagctggcggcaaaccagaaggcgc

SEQ ID NO: 76151 - protein, 184 aa, Zea mays
  misc_feature: Ceres CLONE 1560780
  misc_feature (28)..(161): Pfam Name: DUF6 Pfam Description: Integral membrane protein DUF6
MADAGEGRRVCGMPEKAQLHVAMLALQFGYAGFHVVSRLALNMGISKLVFPVYRNIIALCLLVPFAYFLEKKDRPQLTLNFVVQFFFLALCGITANQGFYLLGLDNTSPTFASAIQNSVPAITFAMAAALRIEKVRLDRRDGVAKVAGTLACVAGASVITLYKGPTIFGPSASGGLKLAANQKA

SEQ ID NO: 76152 - DNA, 968 bp, Zea mays
  misc_feature: Ceres CLONE 1560782
  misc_feature: Encodes the peptide sequence at SEQ ID NO. 76153
  misc_feature (530)..(530): n is a, c, t, g, unknown, or other
  misc_feature (558)..(558): n is a, c, t, g, unknown, or other
  misc_feature (564)..(564): n is a, c, t, g, unknown, or other
  misc_feature (571)..(571): n is a, c, t, g, unknown, or other
  misc_feature (596)..(596): n is a, c, t, g, unknown, or other
  misc_feature (598)..(598): n is a, c, t, g, unknown, or other
  misc_feature (605)..(605): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (788)..(788): n is a, c, t, g, unknown, or other
  misc_feature (816)..(816): n is a, c, t, g, unknown, or other
  misc_feature (820)..(820): n is a, c, t, g, unknown, or other
  misc_feature (821)..(821): n is a, c, t, g, unknown, or other
  misc_feature (823)..(823): n is a, c, t, g, unknown, or other
  misc_feature (832)..(832): n is a, c, t, g, unknown, or other
  misc_feature (846)..(846): n is a, c, t, g, unknown, or other
  misc_feature (856)..(856): n is a, c, t, g, unknown, or other
  misc_feature (865)..(865): n is a, c, t, g, unknown, or other
  misc_feature (870)..(870): n is a, c, t, g, unknown, or other
  misc_feature (898)..(898): n is a, c, t, g, unknown, or other
  misc_feature (899)..(899): n is a, c, t, g, unknown, or other
  misc_feature (903)..(903): n is a, c, t, g, unknown, or other
  misc_feature (904)..(904): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (959)..(959): n is a, c, t, g, unknown, or other
ctggagctcaccgcggtggcggccgctctagaactagtggatcccccgggctgcaggaattcgtctcacccctagaaaaaaagcctgtggacgccagtgagtgaacaccagccgtcttggcccgcttctcccctgctgcggccatggcgacctccgcggcgctctcgaccgccgccaaccccacccagctctgccggtcccgcgctgcgctgggcaagccagtgaaggggcttggcctggggatggggcgggagcgcgcaagccagcggagcatcacgtgccaggcggcgagcagcatcccccgccgaccgcgtccccgacatggagaaacggaagctgatgaacctcctccccccggggcgccctatcccctggccacccgtcgggattgggttgttcccccttacccccccccttcttttgtgcccccggccgggcccccccgggaaaaaggggcggcccgggccggggaaccctttctcccccaaaggggacaaaagagctggggggcacaaacccccccctctccnttgggtgggggaaaaagaaaaaaagggnctcccnatacaanacgcccgcgacggcgggggcccccnanatagagnaccgnnncccgcgcaacgcaggtgtttctcttcgcccacgaaagaggaggaggggggtcctcttcctacgggagggggtgagggtgtaccccccacccacacctcgggtgacaacctcctgnnnggggggggtgtggcgggggggagcacgctcacaccaccacaccacaaaaccaaaaaaanaaaacgccgccccgcaccccaccccaangacnnanatcaccganatcatatcagcccntccacgccgnccggggtgntggtnagaacatcgactccagagctgtcgaggnntggnngnnnnnannnaaaataaagccagagtcacctctcacgaggggaaggaggagtaanatgcaacct

SEQ ID NO: 76153 - protein, 151 aa, Zea mays
  misc_feature: Ceres CLONE 1560782
  misc_feature: SWISSPROT Homolog: EC 1.10.99.1 Plastoquinol--plastocyanin reductase
  misc_feature (139)..(139): Xaa is any aa, unknown, or other
  misc_feature (141)..(141): Xaa is any aa, unknown, or other
  misc_feature (143)..(143): Xaa is any aa, unknown, or other
MATSAALSTAANPTQLCRSRAALGKPVKGLGLGMGRERASQRSITCQAASSIPRRPRPRHGETEADEPPPPGAPYPLATRRDWVVPPYPPPSFVPPAGPPREKGAARAGEPFLPQRGQKSWGAQTPPSPLGGGKRKKGXPXTXRPRRRGPP

SEQ ID NO: 76154 - DNA, 810 bp, Zea mays
  misc_feature: Ceres CLONE 1560785
  misc_feature (424)..(424): n is a, c, t, g, unknown, or other
ctggagctccccgcggtggcggccgctctagaactagtggatcccccgggctgcaggaattcgtctcacccctagaaaaaccgccacgcgacaaccgacaatccttcgcagtcccgcaccgcaccgccgcaccgcaccaccgcaccgcggccaaggccaatagcctcgcctagcgctcactcgctcgccccactaccaccgcaccacgcgctcccgtttccgccgatccgagcgcgcagatcgcggaagcccagcggctcagagtccagggggagggagctcgcggcggctgaggaaggcgttcaccaccgtcgcggtgagtgctcccagtcaagcgcctcttccttcgtagtgtcaacaattccgccccgcgcccgcgcggatctgattgtctcgatcgtccaatcgagcggatttcattgangaagagatggggctctcctttggggagctgtttcagcgcctcttcgcccaggaaggaaatgaggattcctcatgggccgggctccaatgccccccggtaaaacccccttcccctataaactccaagcccgggaaaaatggtcaccaccattcccacccttggggatcaaagggtagaaaacggtggagacaaaaaaaataaccctcccccctttgggaaatttgggggcaaaaaaaaaaaaaaggcccccgggggggggactccttttcaaaaaccccgggggcgttttttttttttgtcaccccattattagggaaacactttttttaaggcctaaaaaaaaaccccccccggaagctcaaaaaagagaaaaaccccccgaaacc

SEQ ID NO: 76155 - DNA, 838 bp, Zea mays
  misc_feature: Ceres CLONE 1560787
  misc_feature: Encodes the peptide sequence at SEQ ID NO. 76156
  misc_feature (122)..(122): n is a, c, t, g, unknown, or other
  misc_feature (129)..(129): n is a, c, t, g, unknown, or other
  misc_feature (345)..(345): n is a, c, t, g, unknown, or other
  misc_feature (356)..(356): n is a, c, t, g, unknown, or other
ctcaccgcggtggcggccgctctagaactagtggatcccccgggctgcaggaattcgtctcacccctagaaaaaacaccaacctcagcacaccaaggagagtacgtggaggagcagccatgngcttcantcggtgggccgccgcgtgcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacgggctcgctggtcggncgactacgggnttcgtacccgttcgggtctcgggaaagcccccgtggaagtaccctggcaggttccgagttgggagatcgctgggaccagaaacctgcccaaaaatagagggccggggggaatcattcggcaccccgggttccaggccccccaaagtcaaaagcccccccccggttcaagcccttaaagggaggggggttcgggcccccagggggtccccccggggtgggaagcttctcccacgggcccctgggggcaatagtttccccaccccttggggggccccccccccgggggagagggggttaccacggggggttccacctgggaagggaaaaccccccaaaagggggggaaccctgttgggaaaaaagggtccctccccccccactgggggggacaaccccccggggcggttttttctccttttttttgagacgccttttatttggttaataaaagggagggggcccctgaataaaaggggagacat

SEQ ID NO: 76156 - protein, 278 aa, Zea mays
  misc_feature: Ceres CLONE 1560787
  misc_feature (40)..(40): Xaa is any aa, unknown, or other
  misc_feature (43)..(43): Xaa is any aa, unknown, or other
  misc_feature (115)..(115): Xaa is any aa, unknown, or other
HRGGGRSRTSGSPGLQEFVSPLEKTPTSAHQGEYVEEQPXASXGGPPRASTFLGTRLADPAPQNGRIVARFGFGLGGKAKPAPKKVAKTSTSSDRPLWFPGAVAPDYLDGLAGRXTTGFVPVRVSGKPPWKYPGRFRVGRSLGPETCPKIEGRGESFGTPGSRPPKVKSPPPVQALKGRGVRAPRGSPRGGKLLPRAPGGNSFPTPWGAPPPGERGLPRGVPPGKGKPPKRGGTLLGKKGPSPPTGGDNPPGRFFLLFFETPFIWLIKGRGPLNKRGD

SEQ ID NO: 76157 - DNA, 842 bp, Zea mays
  misc_feature: Ceres CLONE 1560791
  misc_feature: Encodes the peptide sequence at SEQ ID NO. 76158
ctggagctccccgcggtggcggccgctctagaactagtggatcccccgggctgcaggaattcgtctcacccctagaaaaaaaaaaagaccacatagaccaccacgacacccttccccacaccagcagtcgagctgagcacgacacaaagccggctggggccgcctcgccatggcgatccggatgagcaacaacgtgatcggcgcgctgaacctggtgacactcctgctctcggtccccatcctcgtctcgggaatctggctgcggtcgcgcgccgacggcaccgagtgcgaccacctcctgtccaccccggccatcgcgctgggcgcggtgctcatggccgtcgctgtcgcgggcctcgccggcgcctgcttccgcgccacctggctgctatggctctacctcctcgccatgctcgtgttcatcgtcgcgctgctctgcttcaccgtcttcgccttcgccgtcaccaacaggggcgccggggaggccgtgtcgggggtaggctacaggggagtaccgcctcggggactactccacctggctgcggcgccacgtcgaaagccgcagggactgggccccggatccggagctgcctcgccgacgcgcacgtctgcagggcccctggagaaaaggggaaaaggaaaaacaggaccccgcggggtctggttcggctcggcttgtcccccggtcaaatccgggtgcctgcagccgcccacaaactgtcaactccacgttaccccggcggcccggaattggaccaggaaaagcgggggggtttccccgcccccccggccgggaaatggaacccgggggggcaaacaacaaagaacaactctctgcttgg

SEQ ID NO: 76158 - protein, 224 aa, Zea mays
  misc_feature: Ceres CLONE 1560791
  misc_feature (5)..(217): Pfam Name: Tetraspannin Pfam Description: Tetraspanin family
MAIRMSNNVIGALNLVTLLLSVPILVSGIWLRSRADGTECDHLLSTPAIALGAVLMAVAVAGLAGACFRATWLLWLYLLAMLVFIVALLCFTVFAFAVTNRGAGEAVSGVGYRGVPPRGLLHLAAAPRRKPQGLGPGSGAASPTRTSAGPLEKRGKGKTGPRGVWFGSACPPVKSGCLQPPTNCQLHVTPAARNWTRKSGGVSPPPRPGNGTRGGKQQRTTLCL

SEQ ID NO: 76159 - DNA, 797 bp, Zea mays
  misc_feature: Ceres CLONE 1560795
  misc_feature: Encodes the peptide sequence at SEQ ID NO. 76160
tccccgcggtggcggccgctctagaactagtggatcccccgggctgcaggaattcgtctcacccctagaaaaaaagcctacgcgcagtcgcagagagaccatcccgccacggcagcagccgaagcgagcctagccagccaaaccggggccaggccaggccgccagggggacgggacgggaaggaaaccgaggcaggcggcggcggcggcagcagcagcagtgcagggcgcacgcgcttctcgtttcgtgtccccaggggaaggaggaggagcgagagggttggggggtcggctggcggccgagggtccgggagctccgggcggcatggggagggacgagatgctacggcgtagcctcgtggcgctggcggcggccgtggcgctcacggggctggccaccgcgtcgctgcgcaaggcggcggtcacgtacggcttcggcatcctcgccatcgccggcgtcctgctcccggactgggagttcttcgaccgcgactactcccagtggctaacccccatgcccgcctcccgccgcacggccgccgccgcggctgccgaccgggagcacgacgtttggaaattcaagccgtatcctctccgggtggccatgctgacgacgatctacggcttcggtctttacaagtggtggatgtacgtatctagctagtgtgggtcgtccactcgtcctcctccccccttggccgtccttcattgggagccaatgccgatagatggaagattattgcctgggcaaaatatgctgccggaaagccccggaaatagaagaaaaccacccctcaa

SEQ ID NO: 76160 - protein, 112 aa, Zea mays
  misc_feature: Ceres CLONE 1560795
MGRDEMLRRSLVALAAAVALTGLATASLRKAAVTYGFGILAIAGVLLPDWEFFDRDYSQWLTPMPASRRTAAAAAADREHDVWKFKPYPLRVAMLTTIYGFGLYKWWMYVSS

SEQ ID NO: 76161 - DNA, 780 bp, Zea mays
  misc_feature: Ceres CLONE 1560799
  misc_feature: Translation starting site: 144
ctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccgggctcccagatcttcagcgagggtggactggactacctcgggaacccgagcctcatccacgcgcagagcatcctcgccatctgggcctgccaggtcgtgctcatgggcgccgtcgagggctaccgcatcgccggcggcccgctccggcaatggcgtcgaacccgctctattccggcgggagcttcaaaccgctcgggcctcgccgaagaccccgaggccttttcgctgaagcta

SEQ ID NO: 76162 - DNA, 845 bp, Zea mays
  misc_feature: Ceres CLONE 1560800
  misc_feature: Encodes the peptide sequence at SEQ ID NO. 76163
ctggagctccccgcggtggcggccgctctagaactagtggatcccccgggctgcaggaattcgtctcacccctagaaaaaagagcagacgaagcagctcgatcgagcacacacacacttgatcactactaatataaacacattgcgcaaaggccgccatggcttaccgcgcctttgctacgctgcttgcagtgctagcatttgtgggcttcgcttcagttccccgtggtctggcaactgacccgacccagctccaggacttctgcgttgctgataacaagaaccctgtgctggtgaacggggtggtgtgcaagaacccgaacgtggtgaaggcaaccgacttcttcttcaggatagtgccgatggcgccaaacgggcagggctccgccgtgacgccggtggcggtgaacgagatcccggggctgaacacgctgggcatctcgctggcgcgcatcgacttcgtccccggcgggcagaacccgccgcacacgcacccgcgcgggtccgagatcctgacggtcatccagggcacgctcctcgtcggcttcgtcacctccaaccagctgctcaacaacacgctcttcaccatgcagctgaacatgggcgacgtcttcgtgttcccgcaggggctcatccacttccagctcaacaacggcaagacccccgccgtggccatcgccgcgctcagcagccagaaccccggcaccgtcaccatcgcctacgccgtgttcggggccaagccgcccatcctggacgacatctcgccagggcgttcatgctcgagaaagccaccgtcgactgggtccagcaggcgttcggcgcggcaccagtgggcgggcgcggcgg

SEQ ID NO: 76163 - protein, 229 aa, Zea mays
  misc_feature: Ceres CLONE 1560800
  misc_feature (64)..(205): Pfam Name: Cupin_1 Pfam Description: Cupin
  misc_feature: SWISSPROT Homolog: EC 1.15.1.1 Superoxide dismutase
MAYRAFATLLAVLAFVGFASVPRGLATDPTQLQDFCVADNKNPVLVNGVVCKNPNVVKATDFFFRIVPMAPNGQGSAVTPVAVNEIPGLNTLGISLARIDFVPGGQNPPHTHPRGSEILTVIQGTLLVGFVTSNQLLNNTLFTMQLNMGDVFVFPQGLIHFQLNNGKTPAVAIAALSSQNPGTVTIAYAVFGAKPPILDDISPGRSCSRKPPSTGSSRRSARHQWAGAA

SEQ ID NO: 76164 - DNA, 737 bp, Zea mays
  misc_feature: Ceres CLONE 1560801
  misc_feature: Translation starting site: 205
  misc_feature: SWISSPROT Homolog: EC 2.3.1.74 Naringenin-chalcone synthase
  misc_feature (559)..(559): n is a, c, t, g, unknown, or other
aaagctggagctccccgcggtggcggccgctctagaactagtggatcccccgggctgcaggaattcgtctcacccctagaaaaagccattaagactagctaactagcgtgaaagagctcctccgacgactactagctctcgcttgctccgacgacccctgccggccgcctctggtacaacgtacgagaggaagagagacgatcgatggccggcgccaccgtgaccgtggacgaggtgaggaagggccagcgcgcgaccggccccgccaccgtgctggccatcgggacggcgacgcccgccaactgcgtgtaccaggccgactacccggactactacttccggatcaccaagagcgaccacctcaccgacctcaaggagaagttcaagaggatgtgcgacaagtcgatgatccggaagcggtacatgcacctgacggaggagttcctgtcggagaacccgagcatgtgcgcgtacatggcgccgtctctggacacgcggcatgacgtgctggtgacggacgtgccaaacctggggaatgccgccgcgcataaggcgatcnatgtagtgggggcagccccatgtcgcggatcacggtccctggtggttctgcaaccacgtacggggggggggaccttggcaggggcgccgaaacctaccagactgtacccaagggtgggctggggcccttgccgggcccctcccgttgaaaaaccgccccgggaatggattgggtcccc

SEQ ID NO: 76165 - DNA, 824 bp, Zea mays
  misc_feature: Ceres CLONE 1560804
  misc_feature: Encodes the peptide sequence at SEQ ID NO. 76166
ctggagctccccgcggtggcggccgctctagaactagtggatcccccgggctgcaggaattcgtctcacccctagaaaaagccgatccagtcccccggcaaattcccaaccgccgcacggcaacaccagcggtcggatcgggggagaaacggaagggcaacagcagagcgcgaattccaccgacaaatccaagatttcgagcacagacacaggcgaaactcgatggcggaggggtccaagccggacgtgccgctgttccagctcctcagcgatcttctccagcaggtggagtcaatgagcaatcaggaagaagtagagctgcgcgctaagattgaagcattaggattagaagtcactaaggtaccagagcagcccgctaatcatctcagcgagctagaaatagctgcagagttggacaagctgtcatcgcggcttgataatgtcgacaagatgatatcatctgccatggcctcagatccagaggtgaagtctcttctgagcagcacatctgatatctggatgccggtcataacagcgtctgccaatgagaggcgggggtttgttgggacgagcagcgaaggcagccagaaagagcaggagaattccaagaaatagctggtatatgggctgttaatagtttcgtttttgtgggtctgtaccgaccttatctatgttcattcaaactagtgtttcatgccaaaaaagttgtggcgtaataaacaataaaaacccatgtccttcattcggattaaaaaaaaaaaaaaaaaaaagcttggcgttcactttctcttcagcgggcagcgtggcaaggcaacgagagcaaa

SEQ ID NO: 76166 - protein, 130 aa, Zea mays
  misc_feature: Ceres CLONE 1560804
MAEGSKPDVPLFQLLSDLLQQVESMSNQEEVELRAKIEALGLEVTKVPEQPANHLSELEIAAELDKLSSRLDNVDKMISSAMASDPEVKSLLSSTSDIWMPVITASANERRGFVGTSSEGSQKEQENSKK

SEQ ID NO: 76167 - DNA, 827 bp, Zea mays
  misc_feature: Ceres CLONE 1560805
  misc_feature: Encodes the peptide sequence at SEQ ID NO. 76168
tggagctccccgcggtggcggccgctctagaactagtggatcccccgggctgcaggaattcgtctcacccctagaaaaactgcaacaacgtccagtgcccgcacagtgactacagctatggattccttgaccggaatgcccgcaacagccaccagtacacctgtaagtacaacgatccgatcactcagagcgccgagaacaagcctctgccagcaccgccgcaaccacaagccttccagccggccttcagccaagccaatcaggcagcgaacaatctggacttcagcctgcctatggacgggcagaggtccatcgccgagctgatgaacatgtacgacaccaacttcatgacgagcaagaccatgagcagtagtgacagcgtcaccatcatggagaggccgaacgcgatgccccagaggatccagatggacgagggcttcttcggacagggcaacggagtcttcgacgacgtcaatagcatgatgcagcaacaacagcagcaggcaccacccgtggtgcagcagcagcagcagcagcagttcttcatccgcgacgacacgccattcatgagccagatgggcgacatcaccagcccgggcggagttcaggttcgggctctgggttccaacatggtatagcaaccgcggccgccggctgattacccagggcgccggggccagaaaaataaaacggggaccaaatttgggttcctactagaaagaaaaaaaaacttgtgagggggcgccccccggttagaaaagccttccggaatttcccccccaagagggaatctcccccaaaagtttgttaaaaagatgccctttatt

SEQ ID NO: 76168 - protein, 114 aa, Zea mays
  misc_feature: Ceres CLONE 1560805
MDGQRSIAELMNMYDTNFMTSKTMSSSDSVTIMERPNAMPQRIQMDEGFFGQGNGVFDDVNSMMQQQQQQAPPVVQQQQQQQFFIRDDTPFMSQMGDITSPGGVQVRALGSNMV

SEQ ID NO: 76169 - DNA, 701 bp, Zea mays
  misc_feature: Ceres CLONE 1560807
  misc_feature: Encodes the peptide sequence at SEQ ID NO. 76170
  misc_feature (79)..(79): n is a, c, t, g, unknown, or other
  misc_feature (378)..(378): n is a, c, t, g, unknown, or other
tggagctcccgcggtggcggccgctctagaactagtggatcccccgggctgcaggaattcgtctcacccctagaaaaanatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacngctgggacaccgcggggctgtcggcggacccggagacgttcgccaagaaccgggagctggaagtgatccactcccgctgggccatgctgggcgcgcctcggctgcctcttccccggagctgctccccccccaaggggggtcaaatttcgggcaaagcccttgggggtttaaagggccggggtccccaaaaatttttcacccaaagggggggaaaccgggaactcccccccgggggaaaaccccaaagccctttttccccccggggggaaaaaaaaaccccccctccccccccccttttgggggcccccccccccaagagttct

SEQ ID NO: 76170 - protein, 186 aa, Zea mays
  misc_feature: Ceres CLONE 1560807
  misc_feature (65)..(171): Pfam Name: Chloroa_b-bind Pfam Description: Chlorophyll A-B binding protein
  misc_feature (79)..(79): Xaa is any aa, unknown, or other
MASSTMALSSTAFAGKAVNVPSSSAFGEARVTMRKTAGKAKPAAASGSPWYGPDRVLYLGPLSGEPPSYLTGEFPGDYXWDTAGLSADPETFAKNRELEVIHSRWAMLGAPRLPLPRSCSPPKGGQISGKALGGLKGRGPQKFFTQRGGNRELPPGGKPQSPFSPRGEKKTPPPPPLLGAPPPKSS

SEQ ID NO: 76171 - DNA, 821 bp, Zea mays
  misc_feature: Ceres CLONE 1560809
  misc_feature: Encodes the peptide sequence at SEQ ID NO. 76172
ctggagctccccgcggtggcggccgctctagaactagtggatcccccgggctgcaggaattcgtctcacccctagaaaaaatctctctccgttcattccctctctcatgcgtgcttgggttgggttgggtttgggtatagacagttcttgcagtccacaccacctcaagtgagggggtgaccccccaccctcctccctagcgctcctcaccgccatgctgccaagaaggcagagcatcttccacctcggggaaggagggtggcgccgccgccgtgcaccaccgcgtcagcgtcgtcagcgcggcctcgtcgtccatggccatgggcagcggcggcggccggcgtgctcgcgagcgtgagcgcctcgtcgtggggctccagatcctggtgcaccaccacggccggcacgggcacggacacgcgcacgcggcgaacgtagtcctgaagcacatggtgaggccgcgcgccgccgctggctcgcgccacggccacggcagccacgccttctcgtgcagtttcctcaaggcctgctacctctgcaagcgggagcttagccctgacaaggacgtctatatgtatagaggtgaccacgggttctgcagcgaggagtgccggtggcagcagatcctggtggacgaggcgcgcgagctctaggcggccgcggtgatgaccaacaaggagctgcagcggcgagcgcatgcccgcacacacagcctccaccgcacgcccatgcccatccgtggcaagccgccgaaggatacacttgccgtagcctaactagcaggtcctctgtctgctgaggaggacaaagaatcaatctgt

SEQ ID NO: 76172 - protein, 112 aa, Zea mays
  misc_feature: Ceres CLONE 1560809
  misc_feature (57)..(111): Pfam Name: DUF581 Pfam Description: Protein of unknown function (DUF581)
MAMGSGGGRRARERERLVVGLQILVHHHGRHGHGHAHAANVVLKHMVRPRAAAGSRHGHGSHAFSCSFLKACYLCKRELSPDKDVYMYRGDHGFCSEECRWQQILVDEAREL

SEQ ID NO: 76173 - DNA, 862 bp, Zea mays
  misc_feature: Ceres CLONE 1560812
  misc_feature: Encodes the peptide sequence at SEQ ID NO. 76174
ctccccgcggtggcggccgctctagaactagtggatcccccgggctgcaggaattcgtctcacccctagaaaaaaacaactcccccaatccgtcccgtcggccggacgagcagggcccaagggcccaccttaccatggcgaccgccactgccgcccccgtccccgccggcggccacccgtaccgccgcgcccgcactcgctgcggcccaccgcgcctgcaccgcctgcgcttcccggccgcagcagcagccgcttcgtcttccctgcccgccccgtcgtccatgctgccaccgctgccagatggaggcgggcggctggtggcggagctggtgtgcgcgttcaacgagctcacggagcggatgggggaggacctggcgacgtcctcctcgtcgagcctgctcttccgtgtgctgaagctggcgctccccgccctccgcgacgtggagggcggccgggcactcgcacgcgcgctcgccgtcgccgcgaccctcgctgacctccagatggatgctgaagtcatatcagccggcatactaagagaagcattagatgcaggagctgtaagaatgagggatgtaaaaacacagattgggatcagcacagctcatttgctgcatgacagcttaagggattaagcatgctcctttcgaaacttgacgtattgggaaggatgaaggttgcaggcaccttggaagaagggtttattcttttcatacctaaggaaatccaggggcagtccctatttgggagcctgggaaaatgaaagcttggaatttgattgaaaaaccccttgggatttacccttcccctaaaattattttgcgagggaaaaataaaaaaacctcccccgaaaagagccata

SEQ ID NO: 76174 - protein, 166 aa, Zea mays
  misc_feature: Ceres CLONE 1560812
MATATAAPVPAGGHPYRRARTRCGPPRLHRLRFPAAAAAASSSLPAPSSMLPPLPDGGGRLVAELVCAFNELTERMGEDLATSSSSSLLFRVLKLALPALRDVEGGRALARALAVAATLADLQMDAEVISAGILREALDAGAVRMRDVKTQIGISTAHLLHDSLRD

SEQ ID NO: 76175 - DNA, 859 bp, Zea mays
  misc_feature: Ceres CLONE 1560816
  misc_feature: SWISSPROT Homolog: EC 3.4.23.12 Nepenthesin
  misc_feature (509)..(509): n is a, c, t, g, unknown, or other
  misc_feature (771)..(771): n is a, c, t, g, unknown, or other
aaagctggagctccccgcggtggcggccgctctagaactagtggatcccccgggctgcaggaattcgtctcacccctagaaaaagctgccgacctcccgctcggtggcctaggtctccccactgacaccgggctctacttcacggagatcaagctcgggacgccgcccaagcgctactacgtccaggtcgacactggcagcgacatcctgtgggttaactgcatctcctgtctcaaaatgcccccgcaagagcggactcgggttagacttgacgttctatgaccccaaggcgtcctcgagcgggagcacggtgtcctgcgatcagggattctgcgcggccacctatggggggaagctgccagggtgcactgccaatgtgccctgcgagtacagcgtcatgtacggtgatggtagctcaacgactgggttcttcatcaccgatgcgctgcagtttgatcaggtgactggggatggacagacacagcctggcaatgctaccatcacattcngggtgtggtgctcagcaaggtaggggatttgggcaactcaaaccaagcgcttgatggaattcttggttttggtcaggcaaatacgtcaatgttatcacagctagctgctgctggtaaagcgaagaagatatttgctcattgcttggataccataaaggggtggtggaatttttgctatttggaaatgttgttcagccaaaagtaaaaacatacaccgttagtagctgacatgccgcactacaatggtgaaccttaagtcaanttgatggttggtggcactacattacagctccccggctcatgtttctgaaacagggagagaaaaaaggcacccataatcgacagtggta

SEQ ID NO: 76176 - DNA, 824 bp, Zea mays
  misc_feature: Ceres CLONE 1560820
  misc_feature: Encodes the peptide sequence at SEQ ID NO. 76177
ctccccgcggtggcggccgctctagaactagtggatcccccgggctgcaggaattcgtctcacccctagaaaaaagcagtcagcacagcagcggtagagtacaaatcctcacctgcccccctgcttcctgcttttcgtcctcatccacccacaggccacagtccactcacaactcccccggaacggcggcggcggcgacggcggagtaacgcggccgcgacgcaagatggcgaggaaacctctcgactacgaggagctgaacgagaacgtcaagagggtgcagtacgcggtgcgcggggagctgtacctccgcgcctccgagctgcagaaggagggcaagaagatcatcttcaccaacgtcggcaacccgcacgccctcggccagaaaccgctcaccttcccgcgccaggtggtggcgctgtgccaggctccgttcctcctcgacgatccccacgtcggcctcatgttcccggcggacgccatcgctagggccaagcactatctcgccatggcgcccggcggtctaggtgcgtacagtgactcccgcggcatcccgggaatcaggaaggaagttgccgacttcatccacaagcgtgatggatatcccagtgatccggaactcatctacctcacagacggtgccagcaaaggtgtgatgcagatcctgaacaccatcattagaaacgagatggatgggatcttggtccctgttccgcagtacccactttattccgccaccatttccctctatggtggttctctggtcccgtactacttgggagaagaagctaactggagcctcgactttgtgaatatccggcaaa

SEQ ID NO: 76177 - protein, 199 aa, Zea mays
  misc_feature: Ceres CLONE 1560820
  misc_feature: SWISSPROT Homolog: EC 2.6.1.2 Alanine transaminase
MARKPLDYEELNENVKRVQYAVRGELYLRASELQKEGKKIIFTNVGNPHALGQKPLTFPRQVVALCQAPFLLDDPHVGLMFPADAIARAKHYLAMAPGGLGAYSDSRGIPGIRKEVADFIHKRDGYPSDPELIYLTDGASKGVMQILNTIIRNEMDGILVPVPQYPLYSATISLYGGSLVPYYLGEEANWSLDFVNIRQ

SEQ ID NO: 76178 - DNA, 835 bp, Zea mays
  misc_feature: Ceres CLONE 1560822
  misc_feature: Encodes the peptide sequence at SEQ ID NO. 76179
ctggagctccccgcggtggcggccgctctagaactagtggatcccccgggctgcaggaattcgtctcacccctagaaaaagcagtgaagtgcagtgcaaaagaaggtctttagtttcaccaagatcggcagatcgccaacatccgtctgcctctcctctccggtgccggcgactgacacaccacagggtcatctgcacaccaatagggtctgcgacaatgtctggacattcattctaacagatgcaaccttcaagagcgctgagattcaagaaacaccgagcaagatgggtctcaatgcggtggtagccgcctgctacgtctttccagtacttgtctctgtgctcgcagtcagcttcttctacgtactgtggcacagtggccaaccagagtcaaggttgtgcgccaccagattgcgttgtctcattgtccttggctccggagggcataccgcacaaatgatgaacatagtaacaacacttcagaaggataggttcacaccaaggtactatgtggctgcacttacagacaacatgagtcttcagaaggcacaggtctatgaacaatcacttattcagagcaacggaacgaaggctggcgagagcgctcatttcatgcagatatatcgtagtcgtgaagtgggccagtcttatgttacatccatcgcaacaacattgctagccacgctgcatgctatgtggctggtgataagaatcagaccacaagtgatattctgcaacgggtccagggacgtgcttttactctatgcatctcggctttcgattctgaaggtgcattggcttggagatggtcatcccattttctacattgaaaagc

SEQ ID NO: 76179 - protein, 183 aa, Zea mays
  misc_feature: Ceres CLONE 1560822
  misc_feature (45)..(175): Pfam Name: Alg14 Pfam Description: Oligosaccharide biosynthesis protein Alg14 like
MGLNAVVAACYVFPVLVSVLAVSFFYVLWHSGQPESRLCATRLRCLIVLGSGGHTAQMMNIVTTLQKDRFTPRYYVAALTDNMSLQKAQVYEQSLIQSNGTKAGESAHFMQIYRSREVGQSYVTSIATTLLATLHAMWLVIRIRPQVIFCNGSRDVLLLYASRLSILKVHWLGDGHPIFYIEK

SEQ ID NO: 76180 - DNA, 826 bp, Zea mays
  misc_feature: Ceres CLONE 1560824
  misc_feature: Encodes the peptide sequence at SEQ ID NO. 76181
  misc_feature (492)..(492): n is a, c, t, g, unknown, or other
  misc_feature (580)..(580): n is a, c, t, g, unknown, or other
ctggagctccccgcggtggcggccgctctagaactagtggatcccccgggctgcaggaattcgtctcacccctagaaaaaatcgcactccaccgccgctccgctcagcgaccaccggtgaagacgagtggaacgacgcgtgggagaccgcatggcttccaggcgactcccccgcctcctccccagcgcccgccgcgccatgggagtctcccgcctcggcttcggagtccgccatcccggtcatctccgccgaggtggatccagacactaaggccttcgtggcagacatggacgagcgctgggccgagcgccgcatcgcgtcgaggcggggccagcagcagcgcgcgtctcgcgcggcggaaggcggtggaggggggcgtcgtggcgaggaagaaggcgcaagcggatgattacaggaccaggaagcagcgggtgcacgccgcgctttgggtgaaggagatcgagaagatggaggaggcgcgactcggcggtngggggaggtggcgctgacgatatcgaccggctgctcgactcgtgctcagatatctttgattctggcaacactgattttggtgattccnagatccccaacactactgagatcaaaaccaagcctgatgggtgggaaaactacttcaagaggacagggatgggaacctatgggattatctccccagcaggaaaatgacattcctaataccgggaaattggaaaggggcaatttgggtttttagtaaaacgcaaaaattgcttagctttccctcaaaaccccaaatttttttgtgccggagggggcccccttccgggggggggggaaaggtccctct

SEQ ID NO: 76181 - protein, 168 aa, Zea mays
  misc_feature: Ceres CLONE 1560824
  misc_feature (164)..(164): Xaa is any aa, unknown, or other
GAPRGGGRSRTSGSPGLQEFVSPLEKIALHRRSAQRPPVKTSGTTRGRPHGFQATPPPPPQRPPRHGSLPPRLRSPPSRSSPPRWIQTLRPSWQTWTSAGPSAASRRGGASSSARLARRKAVEGGVVARKKAQADDYRTRKQRVHAALWVKEIEKMEEARLGGXGRWR

SEQ ID NO: 76182 - DNA, 808 bp, Zea mays
  misc_feature: Ceres CLONE 1560826
  misc_feature: Encodes the peptide sequence at SEQ ID NO. 76183
ctccccgcggtggcggccgctctagaactagtggatcccccgggctgcaggaattcgtctcacccctagaaaaacctttccattctctgtcgccttcgcccctccattgttctctgatgccatacgctaccccgctgggtgaatgagccatagggggggtgcacagcgatatttctgccagagatcgaaaccctaaggtagggtttgaggcgccgggctgcggccgccgaaatgtcgacgccggcgaggaagcggctgatgcgggacttcaggcgcctgcagcaggacccgcccgccgggatcagcggcgcgccgcacgacaacaacatcatgctctggaacgccgtcatattcaggccggatgatacgccttgggacggaggcacgttcaagcttaccttgcagtttacagaagattacccaaacaagccaccaactgttcggtttgtctctaggatgtttcatccaaacatatatgctgatggaagcatctgcttggatatcctacagaaccagtggagtcctatatatgatgttgctgcaatcttgacttctattcagtccctgctgtgtgatccaaacccgaactcccctgcaaactcagaagccgcaagactgttcagcgagaacaagcgcgagtacaacctgcaagtccgcgagattgtggagcagagctggacagccgactagtgcaggaggaagatgctcatcctgccccgaaaggcacaataacgaacatgcaaaaccatccctgtggttgtggttcgccagacctgtcgcaacattgaagtactctaagtctagtctg

SEQ ID NO: 76183 - protein, 152 aa, Zea mays
  misc_feature: Ceres CLONE 1560826
  misc_feature (8)..(145): Pfam Name: UQ_con Pfam Description: Ubiquitin-conjugating enzyme
  misc_feature: SWISSPROT Homolog: EC 6.3.2.19 Ubiquitin--protein ligase
MSTPARKRLMRDFRRLQQDPPAGISGAPHDNNIMLWNAVIFRPDDTPWDGGTFKLTLQFTEDYPNKPPTVRFVSRMFHPNIYADGSICLDILQNQWSPIYDVAAILTSIQSLLCDPNPNSPANSEAARLFSENKREYNLQVREIVEQSWTAD

SEQ ID NO: 76184 - DNA, 836 bp, Zea mays
  misc_feature: Ceres CLONE 1560829
  misc_feature: Encodes the peptide sequence at SEQ ID NO. 76185
  misc_feature (690)..(690): n is a, c, t, g, unknown, or other
ctccccgcggtggcggccgctctagaactagtggatcccccgggctgcaggaattcgtctcacccctagaaaaacgagcccgaacccgaagcagcagagctgcaaaatctagtgtagagcgaaagaaatggcgagcgtggcctccgcgaggtgttacggccttctcctcccgccaagcttcgccggagcacggtgctgctcccgtccgtcctcttcgctccgtctgcggccgcggtggggcctgcgccggccgaggacccccctcgcctgcgtcgcgccgcccgactccgcggagccacagacggatgagcaggctgtgaaagctgaatctatccaagaagaagctccgactagtacacccgaggatgctgggcttccagctctcccgaataaggatctcaacagaagggtagcactactgtccactcttggagcggtggctctgtttgcatcccagaggctcaatcttagcgaggcatctcttaaagatcttgcatccaattcggtcccatatgaagaggctctttcaaatggcaggcccactgtggttgagttttatgcagactggtgcgaggtctgcagagaattagctccggatatctacaaagtcgaacagcaatacaaggaccgtgtcaattttgtaatgctgaatgttgacaacacgaagtgggagcaagagcttgacgagtncgggggtggaggcattcctcactttgcctttctggataaggaaggaacgaggaagggcatgttgtcgggagacttcaaaagcagtatttccttggacaacgtggttgcgcttggcttcctggtgatccccgaagaacccgcacgcc

SEQ ID NO: 76185 - protein, 236 aa, Zea mays
  misc_feature: Ceres CLONE 1560829
  misc_feature (117)..(219): Pfam Name: Thioredoxin Pfam Description: Thioredoxin
  misc_feature: SWISSPROT Homolog: EC 1.8.1.8 Protein-disulfide reductase
  misc_feature (188)..(188): Xaa is any aa, unknown, or other
MASVASARCYGLLLPPSFAGARCCSRPSSSLRLRPRWGLRRPRTPLACVAPPDSAEPQTDEQAVKAESIQEEAPTSTPEDAGLPALPNKDLNRRVALLSTLGAVALFASQRLNLSEASLKDLASNSVPYEEALSNGRPTVVEFYADWCEVCRELAPDIYKVEQQYKDRVNFVMLNVDNTKWEQELDEXGGGGIPHFAFLDKEGTRKGMLSGDFKSSISLDNVVALGFLVIPEEPAR

SEQ ID NO: 76186 - DNA, 781 bp, Zea mays
  misc_feature: Ceres CLONE 1560830
  misc_feature (20)..(20): n is a, c, t, g, unknown, or other
  misc_feature (44)..(44): n is a, c, t, g, unknown, or other
  misc_feature (617)..(617): n is a, c, t, g, unknown, or other
ctccccgcggtggcggccgnctctagaaactagtggatcccccngggctgcaggaattcgtctcacccctagaaaaattccccatctccggataaaagataaggagtgtctctcctttgccatcctcctctctttcagctaagtccctgccccctctctttttcttacattcaggtcctcgcagctcctctcttttttcttgtttctttcgatctgcgagccgtccaagtccagtactcttctttcactcaaggaactcttgcagccggcccctctggtttcctcgaattcttgttccccggtccctcctcctgtccccgcgtagatccgtccgatcgaggagcacaccgtacccaccaccatgtttacccaccagttcctctgacggccggcgtgctccgatgaaactgagcgtgctccgtataccgcgatccgaatcctttctccgtcccctgcgctaaagggttcaacgtcttccaagaaaagcaaggaccccttttccaaagtggtgaacttttaacgtttttaccctcttttttttttctcgaaaaaaaccttttcaaacccacggtggggggtcctttttttttccaaaattttacccccaaccaaccccnaaaaaaaaaaagtttaatttcgagaaaaaaaaaatctccttttgtggcccccccccggaagatcttgacccccccgggggacacacaccctgggagaagaagctcccccccccaaataatttgttgtccacaaaagaagaaacccggccgcccggtttcaacac

SEQ ID NO: 76187 - DNA, 1354 bp, Zea mays
  misc_feature: Ceres CLONE 1560834
  misc_feature: Encodes the peptide sequence at SEQ ID NO. 76188
aagggccacaggcagcgcagcatcgcggtcgcagcttgccgtgccgagcgaagcgaccacaaagcggccagcgaggctctccgacaccgagccgcgctccgtggcgcacgcaacgatgcccttcttgctcacgccgggcgctcgggcggtgccctcaccgtcaacgctctcgcgcctactgcttccgctccacctacaaattactaatggccggcataaccgtcacgtccccgcctcccccctcctataccctcgcctccgcaaccgccgcagacgattcttcgcggcctcctcctcctcctcgcctcagatggcggcgcctgccgacgccgccggtggctcctctgacgcgttcgaggtgatccgcgttcaccaggcaaaagctgttcgtctttctccagctgaagaaatacggaccattatggaccgaagtgtcagaggtgttcttgctacccattctcaggattatgctggttatccatctggttcaatggttgattttgcatgtgatcaggatggttaccccatattagcagtgagtagtttagcagtccattcaaagaatctctctggaaatcctaaatgctcacttcttgttgccaaagatcctgaggacagaactgatactgtaatcactgtatatggcgatgctgttcctgtttctgacgaagaaaaagattcagtgagaagtgcttacctacgcaggcaccctgatgctttctgggttgactttggtgacttcagtttcctgcacatcaaacctaaagctgtgcgctatgtatctggcgttgcaactgctctccttggttctggagaattcaatgttgcagagtataaggaagcaaaagttgatccaatatctcaattctcaactcctatcacaagccatatgaacaaggatcatgccaatgatacaaagctcattgtgcaacactccactactgtcaaggtggattttgcttatatgctggacgtggacagccttggttttaatgtgaaggctggttatgatggaagtgttctgaagttgagaatccccttcccaagacaggcgcaagacaggaaggatgttaagacactaattgtggaaatgctccaagctgcaagagcctcatcttcagatcctgaatgatgtcgtcgttctggaatgtgaagaatcgtgcaaattgaagtaaacctaatgaataagagttattgggtttccgtccaatctctgcaccgactgaaggtggggccacagacattccatggattgatacacgaccttgtatataatataacaaagagcgcttgaagtacttgtagttgaatgaatacaaagtgacggaaattagttcaaaaaaaaaaaaaaaaa

SEQ ID NO: 76188 - protein, 338 aa, Zea mays
  misc_feature: Ceres CLONE 1560834
  misc_feature (95)..(186): Pfam Name: Pyridox_oxidase Pfam Description: Pyridoxamine 5'-phosphate oxidase
MPFLLTPGARAVPSPSTLSRLLLPLHLQITNGRHNRHVPASPLLYPRLRNRRRRFFAASSSSSPQMAAPADAAGGSSDAFEVIRVHQAKAVRLSPAEEIRTIMDRSVRGVLATHSQDYAGYPSGSMVDFACDQDGYPILAVSSLAVHSKNLSGNPKCSLLVAKDPEDRTDTVITVYGDAVPVSDEEKDSVRSAYLRRHPDAFWVDFGDFSFLHIKPKAVRYVSGVATALLGSGEFNVAEYKEAKVDPISQFSTPITSHMNKDHANDTKLIVQHSTTVKVDFAYMLDVDSLGFNVKAGYDGSVLKLRIPFPRQAQDRKDVKTLIVEMLQAARASSSDPE

SEQ ID NO: 76189 - DNA, 901 bp, Zea mays
  misc_feature: Ceres CLONE 1560835
  misc_feature: Encodes the peptide sequence at SEQ ID NO. 76190
  misc_feature (24)..(24): n is a, c, t, g, unknown, or other
ctcacccgcggtggcggggccgcntctagaactagtggatcccccgggctgcaggaattcgtctcacccctagaaaaaatccacacacgcacaacacagcagagagattactacgatccaacagttctagagcaagagagaggaagacacaccgcagagttagcaggctaataacttgcaggagcagcaggaatggcggcgacgcgtcgcctctcttgctttctcctcgccgtgcttctggcaggagtggccgctgccaccgccttcgacgaagcggctgctgacggcttcgagcttggccaacgcgcgcgtttcgcgcgcaaacattgacgtgcctgccgctgagattgcccaaccgaaccacaaccctaaactaaacccggaaccccatttgggagccctggcccacggccgaaagcttaaacccaaaacctttgtccaaagttcaaagcccaatgcccggaaaactaaacccgaagggcctttccctcaaacctcaaaaaaatggggcaaaatcttttaaaacaaaaatctaaaccaaagggggttttgccctaaccaccaaaaacgtggaaatttttaaggctaaaaacacattgagagaaaaaaggatgagctccctttccccttgtaataaagaaaccgtgtggcccccccccttttgttccctataataagaggtgcgcgggaggccccgagataaaaaaatacgatgtctggtgggagaaggagaagtggggtgccccaacacttgtttatcaaataaataatccttgcgggagggaggaatgtggtacgttttggtgttgcgtcgattgtagtggggcgccgacagcgtccccgctattgttaaacgacaacaaaagaattggcggaggtgtatagtggatttgtcgtatct

SEQ ID NO: 76190 - protein, 45 aa, Zea mays
  misc_feature: Ceres CLONE 1560835
MAATRRLSCFLLAVLLAGVAAATAFDEAAADGFELGQRARFARKH

SEQ ID NO: 76191 - DNA, 804 bp, Zea mays
  misc_feature: Ceres CLONE 1560838
  misc_feature: Encodes the peptide sequence at SEQ ID NO. 76192
ctccccgcggtggcggccgctctagaactagtggatcccccgggctgcaggaattcgtctcacccctagaaaaaggctggctcccaccgaattcattccacccccgtctcctccgatcggaccaccgggccagcagcggggcggatcgtgacgtcagcaggcatggtgaaggcctaccccacggtgaacgaggactacctcaaggcggtcgacaaggccaagcgcaagctccgcggcctcatcgccgagaagaattgcgccccgctcatgctccgcctcgcatggcactccgcgggcaccttcgatgtggccaccaaaaccgggggccccttcggcaccatgaagaaccccgccgagcaggcgcacggagccaacgccggactggaaattgccatcaggctgctagagcccatcaaggagcagttccccatcctatcctacgctgacttctaccagcttgctggagtcgtggcagtcgaggtaaccggcggacctgatgtccccttccaccccgggaggcaggacaagcctgaggctccacccggaaggcccgccttcctgatgccacccaaggttctgatcacctcaggcaggttttctccacacagaatgggtttgagcgaccaggacattggttgcgcttttcgggtggtccacccctggggaaaagcccaaaaggaaagggcctgaatttgaggggaacctggaacctcccaacccctttgatcttttgaaaacctccttacctcaagggaaatctttttaacccggaaaaaaaaagaaagggccttctcggcacttcac

SEQ ID NO: 76192 - protein, 175 aa, Zea mays
  misc_feature: Ceres CLONE 1560838
  misc_feature (19)..(158): Pfam Name: peroxidase Pfam Description: Peroxidase
  misc_feature: SWISSPROT Homolog: EC 1.11.1.11 L-ascorbate peroxidase
MVKAYPTVNEDYLKAVDKAKRKLRGLIAEKNCAPLMLRLAWHSAGTFDVATKTGGPFGTMKNPAEQAHGANAGLEIAIRLLEPIKEQFPILSYADFYQLAGVVAVEVTGGPDVPFHPGRQDKPEAPPGRPAFLMPPKVLITSGRFSPHRMGLSDQDIGCAFRVVHPWGKAQKERA

SEQ ID NO: 76193 - DNA, 837 bp, Zea mays
  misc_feature: Ceres CLONE 1560841
  misc_feature: Translation starting site: 229
agctccccgcggtggcggccgctctagaactagtggatcccccgggctgcaggaattcgtctcacccctagaaaaaactcaagtcttgacactactcgggatcacataaaaccagtgtgaagcagaagcagcgcaatggcgagcagcaccatggacctctcctctgcatgcttcgccggctaggcagtgaacgtggcgtcttctctcttcggcgaggcccgcttgactatgcgcaagacggcggctaaggcgaagactgcggctagctccggcagcccgtggtacggccccgaccgggtgctctacctgggcccgctgtccggcgcgcccccgagctacctgacaggcgagttcccgaggcgactacagctggaacaccaccgggctgtctgctgacacagagacgttcgccaagaaccgggagctggaggtcatcaactcccgctgggccatgctgggcgcgttgggctgcgtgttcccagagctgctcgccctcaacagcatcaaattcggcataggccgtgtggttcaaggcagggtcacagatcttcagcgagggtgggctggactacctccgcaacccgagcctgatgcacgcgcagagcatcctcgccatctgggactgacaggtcgtgctcatgggctccatcgaggggtaccgcgtcgccagcggccagatcagagacgtcgtcgaacctctctaccgcgggagctggcttcgatcgctcgggctagacgagaaccctgaaggcttcgcggagctcaaagtggatggagctcaccaaaggccgcaaggccatgattctcatgatcgggatcttccgtcaaccccatctg

SEQ ID NO: 76194 - DNA, 849 bp, Zea mays
  misc_feature: Ceres CLONE 1560847
  misc_feature: Encodes the peptide sequence at SEQ ID NO. 76195
  misc_feature (461)..(461): n is a, c, t, g, unknown, or other
  misc_feature (517)..(517): n is a, c, t, g, unknown, or other
  misc_feature (547)..(547): n is a, c, t, g, unknown, or other
  misc_feature (773)..(773): n is a, c, t, g, unknown, or other
ctccccgcggtggcggccgctctagaactagtggatcccccgggctgcaggaattcgtctcacccctagaaaaagcgccgcttgctttgtccgttgtcgcagagcgaggaagcacgcagagagtgagtaaaagaaagagagggatgccgatggagaggtcggtgtcgtgcgcggagaggggcagcacgttcggcggcggggcggcggtggacgtccggagctacagcgcctcctacgcgaggccccagccgcggccgccgacgtccagggtgcagcgcgccaggagcgtgagcgcgtggacgcgcccggcgccgccgcccgtgcagcggaccgggagcaccaagagcggcgccgccgcggcccgccccaccccggggctcaacctgcgctcgtacagcgcctcctacgcggcctcctacggccccagccttgtcggggcggggcgggccggggtggcccgncgggggaacctgaaccgcttccggcagcgtcaccaactggggacctccgccaaccngccgctccgtcaacctcaggggggtacacngccgttccttcgccgcgactggacgacaccggccgcggcgggtcccggtcgcccagggaaggtgcatggcggtgatggacgacgccgagcctgcagcggaggaagcgcctgggcgtgtacaaggacctacgacgtcgaggggaaagtccgggaattcggtgccccccggcgtgaactggatcaagggcaagtgctcccgcgtggtgttcggcctggtggtgattcnctagctccttcgtccggcctagcccaccccgcccccgggcggatttccccgccgttccggtccagcataatggtat

SEQ ID NO: 76195 - protein, 235 aa, Zea mays
  misc_feature: Ceres CLONE 1560847
  misc_feature (125)..(125): Xaa is any aa, unknown, or other
  misc_feature (135)..(135): Xaa is any aa, unknown, or other
MPMERSVSCAERGSTFGGGAAVDVRSYSASYARPQPRPPTSRVQRARSVSAWTRPAPPPVQRTGSTKSGAAAARPTPGLNLRSYSASYAASYGPSLVGAGRAGVARRGNLNRFRQRHQLGTSANXPLRQPQGGTXPFLRRDWTTPAAAGPGRPGKVHGGDGRRRACSGGSAWACTRTYDVEGKVREFGAPRRELDQGQVLPRGVRPGGDSLAPSSGLAHPAPGRISPPFRSSIMV

SEQ ID NO: 76196 - DNA, 815 bp, Zea mays
  misc_feature: Ceres CLONE 1560849
  misc_feature: Encodes the peptide sequence at SEQ ID NO. 76197
ccccgcggtggcggccgctctagaactagtggatcccccgggctgcaggaattcgtctcacccctagaaagaaactcgctctcactttaatactattccatttccctttcttctgaagtcgtcctcttcttcccgtcgcttcgccgtgccgcacctgcgaggagaggagacttcgccgcgaagctcaccatgatctcgccggagaggagctcgtcacagagccagcggtcggcggcggcgggggcgccgttcctgtcgatctccgtcacggatcccgtaaagatgggtaccggcgtgcagtcctacatctcctaccgcgtcatcaccaagaccaacctccctgaatttgagggaccagagaaaattgttattcggcgctatagtgattttgaatggttgcatgatcggcttgctgagaggtacaaaggcatttttataccccctcttccggagaagaatgctgttgagaaattccggtttagcaaggagttcattgaattgcggcgtcaagctctggatttattcgttaacaggatagcttcacaccctgaactcaagcaaagtgatgtcttgaggacatttttgcaagcggatgaagagataatggatagggcaagatcttatgagactggtatttttaagaaaccggcagatttcatacagatgtttaaggatgtgcagtcaaaagtcagtgatgttgttctgggcaaaagacagcctgtgggagaatctactcctgaatatgagaagcttaaaattacatatttgagctagaaaatcatttagcagaggcccaaaaacaagcataccggtta

SEQ ID NO: 76197 - protein, 194 aa, Zea mays
  misc_feature: Ceres CLONE 1560849
  misc_feature (19)..(135): Pfam Name: PX Pfam Description: PX domain
  misc_feature: SWISSPROT Homolog: EC 2.7.11.1 Non-specific serine/threonine protein kinase
MISPERSSSQSQRSAAAGAPFLSISVTDPVKMGTGVQSYISYRVITKTNLPEFEGPEKIVIRRYSDFEWLHDRLAERYKGIFIPPLPEKNAVEKFRFSKEFIELRRQALDLFVNRIASHPELKQSDVLRTFLQADEEIMDRARSYETGIFKKPADFIQMFKDVQSKVSDVVLGKRQPVGESTPEYEKLKITYLS

SEQ ID NO: 76198 - DNA, 774 bp, Zea mays
  misc_feature: Ceres CLONE 1560850
  misc_feature (224)..(224): n is a, c, t, g, unknown, or other
  misc_feature (517)..(517): n is a, c, t, g, unknown, or other
  misc_feature (603)..(603): n is a, c, t, g, unknown, or other
  misc_feature (670)..(670): n is a, c, t, g, unknown, or other
  misc_feature (671)..(671): n is a, c, t, g, unknown, or other
  misc_feature (676)..(676): n is a, c, t, g, unknown, or other
  misc_feature (710)..(710): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
ggagtccccgcggtggcggccgctctagaactagtggatcccccgggctgcaggaattcgtctcacccctagaaaaaaccaccactcgtccactcctcctcccgtcaagcgaagccactcctgatcgccgatcgctcgccacctcacgcggaccgcccctcgagctgcaacgaccggcctcccctgctccggctcccaccgagcctcgatcgatcgccgcagcnagcgccaatggctgatgcgtggagagcgcggcgggcggcgcgctggtctcggactgggcgcgtgcaggactggtgcgccagctcgagctgcagctgcgcgcgcccggggacgcaagcctccgtcgaccttctgcccgccggcttgggtccaccagaattcggcggggctccacccggacagaccccccctgcggggttggctcccaattatttcccccggggacccttcggcctttgcgccctttggcccccccccattttgggggaaccgggggagacccccaaatataaancccaagggaaagccccccgcccccccgagaaaaaaaccccccccctttttctcgggggggcggcgccggttccaggagggggccanggaggcgcggccctccgcccccccaaaaaaaaaaaatcccgccggtggggggggggcgccccacacnnaccgnaggaggccccggcgggaggaacaaacacacaccnttaatagnnnnggaaaaaagcagggagggggggcaccggggaagatacggcggcgcgaggcggg

SEQ ID NO: 76199 - DNA, 803 bp, Zea mays
  misc_feature: Ceres CLONE 1560851
  misc_feature: Encodes the peptide sequence at SEQ ID NO. 76200
ggagctccccgcggtggcggccgctctagaactagtggatcccccgggctgcaggaattcgtctcacccctagaaaaagtcctcaatctgaatcccacaccaccaccacctcctccggtctccaacagctgtagcaccgtagccggcggccatggtctgcctcaccgacctcggcaacctcaacctctcggacaccaccgaaaagatcatcgaggaatacatatggatcggtggatctggcatggatctcaagagcaaagcaaggaccctctccggcccggtgaccgatcccagcaagctgcccaagtggaactacgacagctccagcacgggccaggaccccagcaaggacagcgaggtcatcctgtacccgcaggccatcttctaggacccattcgcgaggggcaacaacatccttgtgatgtgcgattgctacaccccagcaggcgagccgatccccaccaactagaggtacaacgccgccaaaatcttctgcatccatgaggtcgccgccgaggagccgtggtatggtattgagcaggagtacaccctcctgcaaaaggacaccaactggccccttgggtggcccatctgtggcttgaccggccctcgcggtccttactactgtggaatccgcgccgaaaagtcgttcggccgcgacatcgtggacgcccactacaaggtctgcttgtatgccggcatcaacatcagtggcatacacggcgaagtgatgccatggcagtggagagttccaagtcaggccttacgtgggaatatcttcacgcgaccaggtctaggtcgct

SEQ ID NO: 76200 - protein, 78 aa, Zea mays
  misc_feature: Ceres CLONE 1560851
  misc_feature (17)..(79): Pfam Name: Gln-synt_N Pfam Description: Glutamine synthetase, beta-Grasp domain
  misc_feature: SWISSPROT Homolog: EC 6.3.1.2 Glutamate--ammonia ligase
MVCLTDLGNLNLSDTTEKIIEEYIWIGGSGMDLKSKARTLSGPVTDPSKLPKWNYDSSSTGQDPSKDSEVILYPQAIF

SEQ ID NO: 76201 - DNA, 835 bp, Zea mays
  misc_feature: Ceres CLONE 1560863
  misc_feature: Translation starting site: 171
aaagctggagctccccgcggtggcggccgctctagaactagtggatcccccgggctgcaggaattcgtctcacccctagaaaaaactctttgcgccgccgcagccccaaacccgcatcccccatcaatctcaggggcgccccagccaccccacccttcactcacctaaacatggcggatcgcggcggcaagcgtggtggacagcgcggcgggttcggccgtggcttcagtcgcggcgggcacggtgaccgtggtgggcgtcgcgacggccgccgtggcccgcgccaagaggaagagaagtgggttcccgtcaccaagctcggccgccttgtcaaggagaacaagatcaccaagatcgaggagatctacctgcactcgctccccgtcaaggagcaccagatcgtctagaccctcgtcccggggctcaaggacgaggtcatgaagatcacgcccgtacagaagcagacccgtgccgggcagcgcacccgcttcaaggccttcgtcgttgtcagcgatggcgacagccacgtctgactgggagtcagtgcgccaaggaggtggccaccgccatccgcggcgccatcatcctagccaagctctccgtcgtccccgtcaggagggggtactggcgggaacaagatcggacagccccgcaccgtgcactgcaacgtaaacggttagtgtggctacttcactgtgcgcatggtgccaacgccaagagattctggcatcatcaggctcgcgagtagcccaagaaagagctgcaattcgctggggactgaggatgtcttaaacatcgtgccgatgcctccagctaagaccccgagactactgtg

SEQ ID NO: 76202 - DNA, 835 bp, Zea mays
  misc_feature: Ceres CLONE 1560864
  misc_feature: Encodes the peptide sequence at SEQ ID NO. 76203
ctggagctcaccgcggtggcggccgctctagaactagtggatcccccgggctgcaggaattcgtctcacccctagaaaaaagctggtcgcccgcccgcctcccttcttcccaccacacctccagtcctccactgacaagccgccgccgctcttccacctacctctccccggcctcgcacccatggccacggctttgatggttgcagccaccacctcctgctccccgggccgcgccgcgccgcgcctgaagccggtggcctcctcctcctccagcagcagcagcagcagctcggcgcggccgcggcggcccttggcgcagcagctcccgcggctgctggcgacggcggcggcggcggcggtagcagccgcgccgctcccggcgctggcggagcagatggagaaggccgcactgtttgacttcaacctgacgctcccggcgatcgcgaccgagttcctgctgctcatggtggcgctggacaagctctacttcacgccgctaggcaagttcatggatgagcgggacgccaagatccgcggtgagctcggcgatgtcaagggcgcctccgaggaggtgaagcagctggaggaccaggcggcggccatcatgaaggcggcgcgcgccgagatcgcggcggcgcttaacaagatgaagaaggagaccaccgcggagctggaggccaagctggacgaaggacgcagccgtgtggaggccgagctcgtagaggcgctcgccaacctcgaggcgcagaaggacgaggctgtcaaggcgctcgacgcccagatcgcctcgctcagtgatgagatcgtcaagaggtgctcccatccgcgtgatgat

SEQ ID NO: 76203 - protein, 218 aa, Zea mays
  misc_feature: Ceres CLONE 1560864
  misc_feature (83)..(214): Pfam Name: ATP-synt_B Pfam Description: ATP synthase B/B' CF(0)
  misc_feature: SWISSPROT Homolog: EC 3.6.3.14 H(+)-transporting two-sector ATPase
MATALMVAATTSCSPGRAAPRLKPVASSSSSSSSSSSARPRRPLAQQLPRLLATAAAAAVAAAPLPALAEQMEKAALFDFNLTLPAIATEFLLLMVALDKLYFTPLGKFMDERDAKIRGELGDVKGASEEVKQLEDQAAAIMKAARAEIAAALNKMKKETTAELEAKLDEGRSRVEAELVEALANLEAQKDEAVKALDAQIASLSDEIVKRCSHPRDD

SEQ ID NO: 76204 - DNA, 866 bp, Zea mays
  misc_feature: Ceres CLONE 1560865
  misc_feature: Encodes the peptide sequence at SEQ ID NO. 76205
  misc_feature (653)..(653): n is a, c, t, g, unknown, or other
  misc_feature (769)..(769): n is a, c, t, g, unknown, or other
  misc_feature (793)..(793): n is a, c, t, g, unknown, or other
tggagctccccgcggtggcggccgctctagaactagtggatcccccgggctgcaggaattcgtctcacccctagaaaaagaaagcgcctctgggggagtcagacgaacgaagcaatccaaccgaacgaaccgacctaggtcgtcgtcggctcgtcccctccgcaggaccggttcgccgtctcgtcccgatctcgccgcctgcccgccgcgccctattaccgccatggaggcgctgtggaagcaggccttcaggctcaaggaccaggtctctcggcagggtgtgttcaagcagtttggctacgggaattctgataatgcgtttacagatgagtcagaggttaaactgcatcagagattggaaaagctttacttatcgactcgtgctgctaaacattttcaaagggacattgttcggggcgtggagggctatatagtcacaggatctaaacaagtcgaaatagggaataaattgtctgatgacagccagaaatacggtgttggaaacacatgtacaagtggtgatactttgtccaaagctgctacatatttcggaaaggcacgctcacagatggaaaaggagcgtggcaatatgttgaaagcatttggcacacaggtggcagagccactgcgggcgatgggttatgggtgcaccntttagaggatgccagacatatggcccagagatatgacagaacgaggcaagaagctgaagcacgggctgtcgaagtatcaagacggcagaacagggtggagggaatctactgggaantggcgatatggtatcaaaattggnaagctgccgagtacaagcttggaagactgaagtcaaccatggggggggtttagggaagggagctattggcact
